United States Patent 11,098,302 (IDENTIFICATION OF POLYNUCLEOTIDES ASSOCIATED WITH A SAMPLE) - sequence listing, part 28

SEQ ID NO: 93772 - DNA, 716 bp, Homo sapiens
  misc_feature: GYAE6OF01EGMCI.29.85.H08.1.454.CMB.1.raw
  modified_base (341)..(341): a, c, t, g, unknown or other
  misc_feature (341)..(341): n is a, c, g, or t
  modified_base (686)..(692): a, c, t, g, unknown or other
  misc_feature (686)..(692): n is a, c, g, or t
  modified_base (694)..(716): a, c, t, g, unknown or other
  misc_feature (694)..(716): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggcccccccgatcattaatttatgatgtcaattaagcggccctgacggggtccctgatcgcttctcgtggcctccaagtctggaccaaccactcgcccttccctgacctattcctcgtcgggcctccgaggtctagacgagtcggaacggttgtatttaattacgtggtacttcgtcttctaagtttcggaccgacgggaccccaccccggtntaaccggttggttacgtaccggtttccgggttacccgggggacggggaaccgggaaccccgaaaggttccccgtaaccggttaaccccggttacccggttagggtaacccgtacggtaccctacccggggtaaaccgggtcccccgttccccgggttccccccccggtttaaccgggtccctttacccggtttcccccgttttaccccggttcccccccctaaacccccgtttccccttaaccgttaaccgttttaccctttaccgtttaacgttcccgggttaacggggccgggtcccggggttacggtacgggggaacaaccggggtccgtacgtagtagctnnnnnnngnnnnnnnnnnnnnnnnnnnnnnn

SEQ ID NO: 93773 - DNA, 669 bp, Homo sapiens
  misc_feature: GYAE6OF01C84UE.29.85.H08.1.454.CMB.1.raw
  modified_base (282)..(282): a, c, t, g, unknown or other
  misc_feature (282)..(282): n is a, c, g, or t
  modified_base (539)..(539): a, c, t, g, unknown or other
  misc_feature (539)..(539): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagtcgttgggttttccttgttgtcttaagttttaaaggtgtccagtgtgaagtgcagcgtgggtggaggtcggtgggggagtcggtggtacgacggtccggtggggggtccctgacgtcctcgtccgtgtcgcncgccctgtgtattactaagtttatgttacttttacactactacgtcggtccgtcaacggtccggtacgggggtaaggtcgtaggggtaggttcgggttccttcttactttaagttaacgcggtaaggtccggtcgtaacctacttaactagttactatcgctagtaccgtcgttaggacgtaacgggtccttaactacgaccctaatcctaaccgaagaacgaaccaacaaacttacgtaacctcctagtacactanaactaatacgaatcgtgaagaagagtacgacgtacaggtccgttgttactaagttgtaaggtagaaacggaaaggaacggacggaacgttacgaagttacggaaggtttcgggtacgttggttaaccggg

SEQ ID NO: 93774 - DNA, 723 bp, Homo sapiens
  misc_feature: GYAE6OF01BG3WD.29.85.H08.1.454.CMB.1.raw
tcagatagagtactcacgaccggtgctcgatttagtatcactcagtcgcggggggggtctcaggaggcagcactctcgggacgtctccaccatggcctggtctctgctcctcctcagcctcctcactcagggcacgaggatcctgggctcgagtctcgccctgactcagcctcgcctcagtgtccgggtctcctggacagtcagtccacctatctcctgacctacgtcggaaaccaggccaggccgtagtcggttcgggttgtttaactaaccgtttgtcctaccgttacgggttaaccaaacctaacccgaccccgaggtcccggtaccggcccccccgtaactcctaactttaacgtttactacggtactcgttacctaacgttaacggccgggtacccctcgggtaaccggggtccctacggtacttccggtccttaccgtcgtccggtctaccgtaacgttccgtacggaccaactacgtccgtaccctacccgtcgaaccctgtcctcggtcgggtacctcccgaggtcctaggacgtacgtcggacggtactacgttacgtcgtcgtcgtcgtctcgttacgttcgacgtccgaccgtccgaccgtcgttggtcctacggttcccgttacgggggaccgttaacgggtaaccgaacggtccctaaccgggtacccgttacggtacggtacccgtacgtccggtaaccggtaacccgg

SEQ ID NO: 93775 - DNA, 838 bp, Homo sapiens
  misc_feature: GYAE6OF01CHNUM.29.85.H08.1.454.CMB.1.raw
  modified_base (250)..(250): a, c, t, g, unknown or other
  misc_feature (250)..(250): n is a, c, g, or t
tcagatagagtactcacgaccggtgctcgatttagtatcactcagtcggcggggggggtctcaggaggcagcactctcgggacgtctccaccatggcctgggctctgcctcctcctcagcctcctcactcgagggcacgaggactccgtgggctcgagtctcgccctgactcgacgcctcgctcgacggtcggtccggtctccgtggactagtcacgtccacctatcctcctcgactacgtacggaaccngcacggcgtagtcggtcggttagttaacttacgtttcgtccttccgtacggtaaccaaaccgtaaccaaccggacggaccggaccccgggaccccccctaagtaccgtaaaacgtttaactttacgtacgtaacgttcgttaactaacgttaaacggccccggtaccccgttacggtaccggggttaccctaggtaccgttccgttccgtttccgtccggttcggtcccgttaaccgtaacggtccgtaacgggaaccctaaccgtaccgtcccggttacccctacccggttactaccccttacgttccgttaccggtccggtaccgtacccggtaccgtcggtaacgacggtacgtacgggttaacggttacttaactttaccgttacgttccgtacgttcgtccttacgttacgttccgggtaccgaccgggtaccctacccggtacgtacgtttacggttaccgtaccggtttccggggttacggggaacccgggtaacccgggtaccgtaaccgggttccccggtaaccggaccggttttaccggacggttaccggtaccggtaacccgtcggttaacccccgg

SEQ ID NO: 93776 - DNA, 707 bp, Homo sapiens
  misc_feature: GYAE6OF01CKRDH.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcagggcacaggactccgtgggctcagtctcgccctgactcagcctcgctcagtcggtccggtctccgtaggacagtcagtcaccatctcctgctacgtacggaaccagcgagcgtagttcggttacggttaggtttaattaaccgttttcgtccttaccgttacggtaacccaaacaaccgaacccgacgggcccgaaccggccccccgtatacctaatttaactttagtagtaactcgtactaagttaaccgcccggtccgtacggtacgggtccctgtacgtcgtcttctcgtcgcctacgacgtcgtgaccacgtcgtccgtcctaccgtacgacctcgttaccgttcgtacggtcctccggaagtccgtaggactagggtacggtacgtagttaactttacgttacgtcgttacgtcgtacttcgtacttcgggactaccgggtaccctaaccgtcgtaccggttaggttccgtaccggttacgggttacggggaaccgggtacccggaacggtaccgtaccgttccggttaacccgtccggtaacggtccaacggtcccgtaaccggtacccggg

SEQ ID NO: 93777 - DNA, 580 bp, Homo sapiens
  misc_feature: GYAE6OF01AM3GM.29.85.H08.1.454.CMB.1.raw
  modified_base (224)..(224): a, c, t, g, unknown or other
  misc_feature (224)..(224): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataactttgtctctgtaccaacaacaccaggcgacggccccccgactcataatttatgatgtcattaagccggccctcgacggggtccctgactcgcttctctcggcctcaacgtctggccaactactcgccctccctacgacccacttcctcgtcgggcctacccgacggctagaccgagtacggtacggtagtatttacttacgtcgtcctgtcttctatttcgacacggtccacccgctacgtcgtcgtacgttccggtcgggaccgggagggaacccgacggtccgttaccggacccggttccgtacgggtacccacgtccgtcggtaacccggg

SEQ ID NO: 93778 - DNA, 653 bp, Homo sapiens
  misc_feature: GYAE6OF01A9B53.29.85.H08.1.454.CMB.1.raw
  modified_base (239)..(239): a, c, t, g, unknown or other
  misc_feature (239)..(239): n is a, c, g, or t
  modified_base (409)..(409): a, c, t, g, unknown or other
  misc_feature (409)..(409): n is a, c, g, or t
  modified_base (438)..(438): a, c, t, g, unknown or other
  misc_feature (438)..(438): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggacgtcctgggctcagtctcgcctgactcacgcctcgctcacgtcggtccggtctccgtggacctgtcagtcaacctatcctccgtgcacgtacggaaccngacacgcgtagtcgggtacggttacggttaacttaacgttttcgttcctacgttacggtaaccaacgaaccgtaccgacggccgaccggccccgactacgtaacgtttaacttacgacgtactacgtactaacgtacgccgtacctcggacggtcctgacgtcgtcttcngtcgctcgagtcgtgacacgctcgcctcncgactcgtctacgtcgctacgcgtctacgacgtagtcggtacgtagtacgttacgtacgtcgtacttcgtaccttcgtacgttacgaccggaccgtaccgcgtaccgtagtcggttacgttaccgttaccgggtcggggacggtaacgggaaccttcggtccggttaacggtacccgttacgtacgggtaccgtacctcggtaacggtaccccgg

SEQ ID NO: 93779 - DNA, 725 bp, Homo sapiens
  misc_feature: GYAE6OF01DHBOJ.29.85.H08.1.454.CMB.1.raw
  modified_base (582)..(582): a, c, t, g, unknown or other
  misc_feature (582)..(582): n is a, c, g, or t
  modified_base (662)..(662): a, c, t, g, unknown or other
  misc_feature (662)..(662): n is a, c, g, or t
  modified_base (684)..(684): a, c, t, g, unknown or other
  misc_feature (684)..(684): n is a, c, g, or t
tcagatagagtactcacgaccggtgctcgatttagtatcactcagtcggcgggggggggtctcaggaggcagcactctcgggacgtctccaccatggcctgggctctgctcctcctcacgcctcctcactcgagggcaacgaggactccgtgggctcagtctcgccctgactcacgcctcgctcgaggtcggtccggtcctccgtggactagtcacgtccacctactccttccgtgacctacgtacggaaccagacgacgtacgtagttcgggttacgggttagttaacgtttaacgtttccggtcctttaccggtaacggtaaacccaaacctaacccgaccggtacggacccggtaccccgggaccccctaagttacttaaaacgtttaacgtttagtacgtactttacgttaacgtaaacggttaccggtcccggtacccgtacgggtaccgggttccctaggtcgttccgtccttcgtacgtcggttacctaaccggtacgtcgtacggacctaccgtacgtccgtaccctacgtacgaccttacgtccgtcggtcggaccgtacgacggtacggtanacggtacgtcggttaacgttacgtatttaacgtcgctccgtctcttacgtacgtcgacgtcgacctcgacgtgtgtaccncgttccggagggaccgaggacncggtcctacggtaccgtgtacggactcggacgcgtaacccg

SEQ ID NO: 93780 - DNA, 688 bp, Homo sapiens
  misc_feature: GYAE6OF01EDAJU.29.85.H08.1.454.CMB.1.raw
  modified_base (228)..(228): a, c, t, g, unknown or other
  misc_feature (228)..(228): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtccaccatcctcctgccactcggaaccngcagcgatggtcggtgttataactttcgtctcctggtaaccaacaaccaccaggccgaccggcccccactcaattaatttatgtatgtactagttaacgcccggcctcgacggggtccctgatccgtcttctcgtggcctaccaagtcctggaccaacctcgtctccctccctacgacctacttccgtccggtcgggtccctaccgaggcctaggaacgtacgttacgggtaacgttacgttagtttaaccgttcgttacgtccgtcgttaccttcgttacgtttcgggaccgtaccgggacccctacccggtacggtaacctttcgggtaccgttaccggttacccgggttaccggggacgggggttaacccggaaccgaacgggttccccgtaacgggttaccccggtttaaccggtaccggttaaccgtaccggttcccgtaaccggtaacccgggg

SEQ ID NO: 93781 - DNA, 548 bp, Homo sapiens
  misc_feature: GYAE6OF01C8LDS.29.85.H08.1.454.CMB.1.raw
  modified_base (212)..(212): a, c, t, g, unknown or other
  misc_feature (212)..(212): n is a, c, g, or t
  modified_base (522)..(548): a, c, t, g, unknown or other
  misc_feature (522)..(548): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggcccccccgactcataatttatgatgtcattaagcggccctcaggggtccctgatcgcttctctggctccaagtctggcaacnctgccctccctgacccatcctcgtgggcctccgaggctgacgatgaggctgactattactgctcctcatatgcaggaccaaacaacttagtttttgacgtttttccggggacgggacgggaacctaaggctacggacccgttcctcagtcagtcctacgaacggtcctaccggtccccccgtcggtaccctacccgttccgttcccgttcccccctaaccccttcccttacgtaacgttacccttcttaaccttcgtcgggacgggtccggggcgttacgggaccgtaacgggccgtacgtaagtagctnnnnnnnnnnnnnnnnnnnnnnnnnnn

SEQ ID NO: 93782 - DNA, 595 bp, Homo sapiens
  misc_feature: GYAE6OF01DQBBO.29.85.H08.1.454.CMB.1.raw
  modified_base (235)..(235): a, c, t, g, unknown or other
  misc_feature (235)..(235): n is a, c, g, or t
  modified_base (312)..(312): a, c, t, g, unknown or other
  misc_feature (312)..(312): n is a, c, g, or t
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
  modified_base (469)..(469): a, c, t, g, unknown or other
  misc_feature (469)..(469): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggatccgtgggctcagtctgccctgactcagccctcgcccagtcgtccgggtctccgtggacagtcagtccaaccatcctcctgccacgtcggaaccngcagcgtagtggtcggtagttatacttgtctctgaaccaacaacaccgaggcgacgccctccgactcaattaattangtatcgtatagttaacggccgtccgtcgacgggtcctggactcgtcttctcgtcgactcaagtcgtcgaccaacnctcgtccctcccgngaacctctccgtcgtcggcctccgaggtctaggaccgtagtcggtacggttgtaactttacgttacgngtcgttcgtcttactagttcgacgaccggtcccaccgtctacgtcgtcgtacgttccggtcgggaacggtacggacctacgtccgttaccgacccgttcgtacggactacgtccgtacggtacccg

SEQ ID NO: 93783 - DNA, 151 bp, Homo sapiens; identical to SEQ ID NO: 93409
  misc_feature: GYAE6OF01A1HNI.29.85.H08.1.454.CMB.1.raw
  modified_base (150)..(151): a, c, t, g, unknown or other
  misc_feature (150)..(151): n is a, c, g, or t

SEQ ID NO: 93784 - DNA, 675 bp, Homo sapiens
  misc_feature: GYAE6OF01BTOFI.29.85.H08.1.454.CMB.1.raw
  modified_base (482)..(482): a, c, t, g, unknown or other
  misc_feature (482)..(482): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcggcctcgctcagtgtccgggtctcctggacagtcagtcaccatctctgcactggaaccagccagcgatgtcggtggttataactttgtctccgtggtaccaaacaacacccaggcgacggccccccgatacataatttatgatcgtacattaacgcgcccctagacggggttcccctgacgtccgtcctttctcgtcggacctcccgtaagttccgtaggtcccaaactaccgttcggtcccctccccgtcgtaaccctacttcccgttccgtcgggtacctccgacggtctcggaaccggtagtacggtaccgggtnttaacgtttaacttacgtcgtacttgtaccttgttacgtttggaccgtacggtaccccacccggtactaccgttggtacgtacgttacccgggttacgggaacggggtaccgggaaccgtaacggcccggtttaaccggccccggtttaccgttacgggtactacccgggcttacccgggaggttacccccgg

SEQ ID NO: 93785 - DNA, 520 bp, Homo sapiens
  misc_feature: GYAE6OF01CBP9F.29.85.H08.1.454.CMB.1.raw
  modified_base (224)..(224): a, c, t, g, unknown or other
  misc_feature (224)..(224): n is a, c, g, or t
  modified_base (341)..(341): a, c, t, g, unknown or other
  misc_feature (341)..(341): n is a, c, g, or t
  modified_base (396)..(396): a, c, t, g, unknown or other
  misc_feature (396)..(396): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttataactttgtctcctggtaccaacaacacccaggcgaggcaccccgactcataatttactgatgtcattaagcggccctcagggtccctgatcgcttcnctgctcagtctggcaacactgcctcctgaccatcctctgggctccagcctgacgntgcgtgattacttactcgctcgctcgatttcgctacggccacccggctaccgtcgtcgtatccggttcgggacgggacggaccgacggcctcggacccgttccgtaaggtccaggtccgtaccg

SEQ ID NO: 93786 - DNA, 153 bp, Homo sapiens; identical to SEQ ID NO: 93437
  misc_feature: GYAE6OF01BIK7E.29.85.H08.1.454.CMB.1.raw
  modified_base (150)..(153): a, c, t, g, unknown or other
  misc_feature (150)..(153): n is a, c, g, or t

SEQ ID NO: 93787 - DNA, 647 bp, Homo sapiens
  misc_feature: GYAE6OF01B5G8G.29.85.H08.1.454.CMB.1.raw
  modified_base (227)..(227): a, c, t, g, unknown or other
  misc_feature (227)..(227): n is a, c, g, or t
tcagatagagtactcacgaccggtgctcgatttagtatcactcagtcgcgggggggtctcaggaggcagcactctcgggacgtctccaccatggcctggctctgctcctcctcagtcctcctcactcagggcaccaggatccgtgggctcagtctgccctgactcagcctcgctcagtcgtcccggtctccgtggacagtcagtcaccatcctctgcactggaaccngctagcgatcggtacggtgttaataactttcgtctctaggtaccaacgaacaccgaggccgacggcccccagtaccaattaacttagtgacttcgtactaacgttaagccggtacctacgacgggtccctagacttccgtctttcgtcgtcggtcctaccgtaaggttcgtacggacctaaacgtccttcggcccttaaccccgtagtacctaacgttccgttcgtcggttaacccgtccgtaacggtccgtagaccgtagtacggacgttagtacttaacttacgtgtactgacttacgtactttcgacgtacggtaccacccgctaaccgtgtaacgtcgttccggtcgggtacggaacggtaccgaacgtccgtaccgacccgttaccgtaggttaccacggtctacggtaacccgg

SEQ ID NO: 93788 - DNA, 602 bp, Homo sapiens
  misc_feature: GYAE6OF01BPO0H.29.85.H08.1.454.CMB.1.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (465)..(465): a, c, t, g, unknown or other
  misc_feature (465)..(465): n is a, c, g, or t
tcagatagagtactcacgaccggtgctcgatttagtatcactcagtcgcggggggggtctcaggaggcagcgctctggggacgtctccaccatggcctgggctctgctcctcctcacctcctcactcagggcacaggctcttgggcccagtctgccctgattcagccctccctccgtgtccgggtctcctggacagtcagtcgccatcctcctgcactggaaccngcagtgatgttgagtaattangactgtcctccttggtaaccaaacaaccaccagaccacacgtaccaacaaacacatagataatacaatgtacaatacgccgccctcgtacgggtccctgtactcgtttctacgtcggctaccgaagtctcggactatcgccggtcctcatcgacctatcctcgtcggacctccgaggtctaggacgggaacgaggtcgtagtatttagttagtgtcgtntacgtactaattataagtaacgagtaggttacgtacgttaagggtttacgggtcgggttacggggacgggtaacgggaaccgagggtcctacgggtacccgttcggtacgggtacaccggcccggaacggtccccgg

SEQ ID NO: 93789 - DNA, 556 bp, Homo sapiens
  misc_feature: GYAE6OF01BQ7MI.29.85.H08.1.454.CMB.1.raw
  modified_base (257)..(257): a, c, t, g, unknown or other
  misc_feature (257)..(257): n is a, c, g, or t
  modified_base (288)..(288): a, c, t, g, unknown or other
  misc_feature (288)..(288): n is a, c, g, or t
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
  modified_base (397)..(397): a, c, t, g, unknown or other
  misc_feature (397)..(397): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcacatctcctgcactggaccagcagcatgtcgtgttatacttgctctagtaccaanacaccaggccgacggccccactcataatttngatgtcattacgcggcctcgacggtccngactcgcttcncgtgcctacaagtctgacaacnctcaccctccgacacctactccgtcgtcggcctaccgcgactcgacgntacggacggttgtattacgttcgtatcgtgtctagtcgttacgactacgccctaccgtacgtacgtcgtacgtccgttacggtacgggaccggtaacgggacccaggtacccgaccgtaacccgtttaccgtacggtacgacgtccgttacgaacccgg

SEQ ID NO: 93790 - DNA, 656 bp, Homo sapiens
  misc_feature: GYAE6OF01AOWYW.29.85.H08.1.454.CMB.1.raw
  modified_base (295)..(295): a, c, t, g, unknown or other
  misc_feature (295)..(295): n is a, c, g, or t
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (379)..(379): a, c, t, g, unknown or other
  misc_feature (379)..(379): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatctcctgcactggaaccagcagcgatggtcggtggttataacttgtctctgtaccaacaacaccaggcgacgccccgatcataattangatgtcatagcgcctcgacgggtcctgactcgcttcnctgctcagtctgcacnctcgcctccngaccntctcgtcggctaccgngctagacgtagtcggtacggtcgtaactttacttacgtgtaccgttcgtaccgttcgttaacgttttcggacccggtaacgggacccctaccccggtaccgtaccggttcggttaccgttaacggttccccgggtttaccggggaacccggggtaaaccggggtaacccccgtaaacgggttccccggttaacccgggttacccccgggtttaaccccggttaacgggggttacccctaacgggttacccccgtttaaccggtaaaccccccggggg

SEQ ID NO: 93791 - DNA, 679 bp, Homo sapiens
  misc_feature: GYAE6OF01CAQ3N.29.85.H08.1.454.CMB.1.raw
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatccgtgggctcagtctgccctgactcagcctcgctcagtcgtccgggtctcctggacagtcagtcacntcnctgcactggaaccngcagcgatcggtggtagttataactttgtctccgtacgtaaccaacaaccaccgaggccgaccggcccccgaactctaattaatttatcgtattcgtactaacgttaacggcccgggtacccctacggtaaccggggttccctaggtaccttccggtcctttacgtcgttcggtcctaccgtaaggtccgtacggacctaacctaccggtcctacccttcccgtacgaccctacttccgtcgtcggtcctaccgtaggtctacggacgtcgtacgggacggttagttaactttacgttacgtgtaccgttcgtcctttacgtacggtttcgacgtaccggtcccacccgtactacgtggtctaccggttcgggtccgggacgggtaacgggaccgtacggtccgtaccgttacccggtacgtccggtaccgtacgtcccgtacggtaacccggg

SEQ ID NO: 93792 - DNA, 795 bp, Homo sapiens
  misc_feature: GYAE6OF01EQW24.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccagtggtagtttggactgagtcgtttgggttttccttgttgtacttaattttaaaaggtgtaccagtgtagaagtgcagcgtggtggaggtcggtagggggtagtcggtaggtacgacggtccgggttcggggggtccctaggacgtacctcctccgtgtcgcacggtcctcgtggtacttactaaaggttttaatgtttacttttacatactacgttcgggtcctacgagtccggtaccgggggtaaggtcgtggtaggtcggtcttcgttactttaattaacgcggtagtacgggtacacttaacctattactttacctagttcgacgtaacgtacctttcgtaggtaacgggaaccggggtacccttagtttacccgaacccttacttccgttaacccgaacggaaacggaaaacccaaaacctaaaaccgtaaaccgtttaccccttaacccgttagttaactttccgtaacgtaactaaacgtaccgtaaacgtagttaccggtaagaaggtaacggtaacgaacgacgacggtccgttacttagtttaagtttagttacggtaagtaaaaccggaaaagggtaagggaaacggtacgaaacgggttacttaaacggttaaaggggtttccggggttacgttcgggtttaaaccgggg

SEQ ID NO: 93793 - DNA, 645 bp, Homo sapiens
  misc_feature: GYAE6OF01CVXG5.29.85.H08.1.454.CMB.1.raw
  modified_base (521)..(521): a, c, t, g, unknown or other
  misc_feature (521)..(521): n is a, c, g, or t
tcagatagagtactcacgaccggtgctcgatttagtatcactcagtcgcggggggggtctcaggaggcagcactctcgggacgtctccacatggcctggctctgctcctcctcagcctcctcactcaggcacaggatcctgggctcagtctgccctgactcagcctcgctcagtcgtcccgggtctcctggacacgtcacgtcacctatctcctgccactcggaaccagcagcgagtggtcggttagttactaacttttcgtctaccgtcggtaaccaaacaacctaacccgacggccggtaacccggccccccggtactaccgaattaactttagtacgtagtcgtactaagttaacggccggtaccctcggtaccgggtcctgtacgtcgtacttcctcgttcggcctttaccaacggttcgttacggacctaaacctacgtcgtaccctcctacgaacctactccgtacggtcgtcctaccgcggtctagacgtagcgtacggttgtaactttatcgntcgttcgactactagtttcgctacggccctaccgtctacgttcgtacgtacttccggtcgggaacggacgtaaccgacgttcccgtagacccgttccggagacttacggcctaaggtaacccgg

SEQ ID NO: 93794 - DNA, 564 bp, Homo sapiens
  misc_feature: GYAE6OF01A5735.29.85.H08.1.454.CMB.1.raw
  modified_base (224)..(224): a, c, t, g, unknown or other
  misc_feature (224)..(224): n is a, c, g, or t
  modified_base (357)..(357): a, c, t, g, unknown or other
  misc_feature (357)..(357): n is a, c, g, or t
  modified_base (397)..(397): a, c, t, g, unknown or other
  misc_feature (397)..(397): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataactttgtctctggtaccaacacaccaggccaggccccccgatcataattatgatgtcattaagcggccctcgaggggtccctgatcgcttctctggctccaagtctggcaacnctgccctccctgacctatctcgtggctccgaggctgacgntgacggttgattattactgctgcttctagtttcgcgacggtcccacccgtctaaccgtggtacgtacgttccgtttaccggggccggggtaagggacccctaaaggtcccgttaccggtacccggttacccgttaacgggtacctacggtcctaccggtaacccggg

SEQ ID NO: 93795 - DNA, 659 bp, Homo sapiens
  misc_feature: GYAE6OF01CO1RM.29.85.H08.1.454.CMB.1.raw
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcgagggcacaggatccgtgggctcagtctgccctgactcacgcctcgctcaggtcgtccgggtctccgtggacagtcagtccaccntcctctgcacgtacggaaccngcagcgatggtcggtagttacttacgttgtctctgtaaccaacaaccaccgaggccgaccggccccgatctaacttaattagcagttcgtactaacgttaacggccgtaccctacggtaccgggtccctggtacctcgtcttcctcgtcggtacctacgtacgtcgtacggaccaaacgtccgtccgtacccctccgtacgtaacctcttccgtacggtccgggtcctaccggtacggtcgtacggaccgtagtacggtaacggttactaagtttactacgtcgtcttgtccttaccgttgttccgcgtaccgcccaccgtcgtacgtgttacgtcggttccggtgggaaaccgggtacggaaccgtcggtacctaccgggttcccgttacggtaacggccgtacgtaccgtaacgtacccggg

SEQ ID NO: 93796 - DNA, 765 bp, Homo sapiens
  misc_feature: GYAE6OF01A2606.29.85.H08.1.454.CMB.1.raw
  modified_base (557)..(557): a, c, t, g, unknown or other
  misc_feature (557)..(557): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggttttccttgttgcttattttaaaaggtgtccagtgtgaagtgcagctgggtggagtcgtgggggatcggtggtacagtccggtgggggtccctggacgacctctccgtgtgcacgcctcgtggtattactaaagtttatgttacttttccacttactacgtcgggttcccgtacgaacggtccggtaccgggggtaagggtccgtaggggtacggttcgggttaccttccgttacgtttaattaacgtcggaacggtacgggtcgtacctaacgtacttatttctactgacagtactcgtaggtaggaacgggtcctaacttccacctacgttcctacgaggaacaaaccaactaactaaccgttcccaccgtttagtaaccttacgtagaaccgttaaanacgtaaccgagttaccgtaaggtaaacggtacgttacggaaccgtacgtacgggtcccgtttattaccgttaaagtttacgttacggtaaaaccggttaagaaaaaaggggttcggaaaaccggtccggtaaaacggggtttactaaccccgggtttaaaggggggttcccgggggttaaccggtttaccggggttttaaacccgggg

SEQ ID NO: 93797 - DNA, 673 bp, Homo sapiens
  misc_feature: GYAE6OF01DW7CN.29.85.H08.1.454.CMB.1.raw
  modified_base (193)..(193): a, c, t, g, unknown or other
  misc_feature (193)..(193): n is a, c, g, or t
  modified_base (640)..(640): a, c, t, g, unknown or other
  misc_feature (640)..(640): n is a, c, g, or t
  modified_base (645)..(645): a, c, t, g, unknown or other
  misc_feature (645)..(645): n is a, c, g, or t
  modified_base (650)..(650): a, c, t, g, unknown or other
  misc_feature (650)..(650): n is a, c, g, or t
  modified_base (664)..(664): a, c, t, g, unknown or other
  misc_feature (664)..(664): n is a, c, g, or t
  modified_base (666)..(668): a, c, t, g, unknown or other
  misc_feature (666)..(668): n is a, c, g, or t
  modified_base (670)..(670): a, c, t, g, unknown or other
  misc_feature (670)..(670): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatggtcggtgttatactttgtctcctgtaccaacaacaccgaggccgacgcccccgatctattaatttngattgtactagttaacgccggccctgacgggtcctgactccgtcttcgtcgtcggctccgtagtcgtcggaccaacgaccgtccgccctccctacgacctacgttccgttcggtcggtccctaccggtaggtcctacgaaccggtagtacgggtacggttagtacgttttacgtaccgtcgtactcgtacttcgttaacgttcgaccgaccgtcccacccgtcgtacgttgtcgtacgttccggtcggacgggaccgaactacgaccggttcgtaacccgtacgtacggtacctacgtccgacggtaccgtcccgtcccgtcccgtcgtcccgtacgttcccgttaccccgttccccgtaccccttaccgttacgttaacccgttaccttaaccggtctaccggcggtaccggtccggttcgacggacggaccgcgtacgtaacggntcgtntacgngtcacgtcgtcgcngnnngngcg

SEQ ID NO: 93798 - DNA, 630 bp, Homo sapiens
  misc_feature: GYAE6OF01C36GA.29.85.H08.1.454.CMB.1.raw
  modified_base (249)..(249): a, c, t, g, unknown or other
  misc_feature (249)..(249): n is a, c, g, or t
tcagatagagtactcacgaccggtgctcgatttagtatcactcagtcggcggggggggtctcaggaggcagcgctctggggacgtctccaccatggcctgggctctgctcctcctcacctcctcactcagggcacaggctcttgggcccagtctgccctgattcagcctccctcgtgtccgggtctcctggacagtcagtcgccatcctcctgcacgtggaacccagcagtgattggttgaagtattancgacttgtccttcccgttgtaaccaacaaccaccagacacacgtaccaacaaacacatgatactacatcgtactaactaccgtccgcccgtacgtacggggtcctgtacgtttcgttacctcgtcgtcctactacgtcgtacggctaagtcggccgtcctcactcgacctcgtctcgtacggacctcaggtcgtaggacgacgtggtactgttaattagtacgtcgtcgtcacttactaattataagtaagtcgtagttacgtacgttaacggttaacgggggttcggtacgggacggggaaggtaaccggtaggtaccggttaccggtaccggttaccgggtacgggttacccgaccgggtacccggtaacggtccccgg

SEQ ID NO: 93799 - DNA, 560 bp, Homo sapiens
  misc_feature: GYAE6OF01C7MJY.29.85.H08.1.454.CMB.1.raw
  modified_base (298)..(298): a, c, t, g, unknown or other
  misc_feature (298)..(298): n is a, c, g, or t
  modified_base (359)..(359): a, c, t, g, unknown or other
  misc_feature (359)..(359): n is a, c, g, or t
  modified_base (501)..(501): a, c, t, g, unknown or other
  misc_feature (501)..(501): n is a, c, g, or t
  modified_base (510)..(510): a, c, t, g, unknown or other
  misc_feature (510)..(510): n is a, c, g, or t
  modified_base (515)..(515): a, c, t, g, unknown or other
  misc_feature (515)..(515): n is a, c, g, or t
  modified_base (522)..(522): a, c, t, g, unknown or other
  misc_feature (522)..(522): n is a, c, g, or t
  modified_base (527)..(527): a, c, t, g, unknown or other
  misc_feature (527)..(527): n is a, c, g, or t
  modified_base (532)..(532): a, c, t, g, unknown or other
  misc_feature (532)..(532): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagccgtggggggtccctgagactctcctgtgcagcctcgtggattcaagtttaatgtatttttccatacncgttgggtcctcaagcgtccggggaaggtctggagtgggtctctcttataatcgagcggtnctactacattctatcgctagacttctggtaggaacgggcccgtattccaaccctattccgtaccaagacgaaccaaacaaacaacgtacctcccgtagtactcgtagaacaatcgaactagtctaggaagtagtgacgacgngacgtcttntattntgtgaanaaagngaagnagtatacgtaaggtggtcgtggttacgg

SEQ ID NO: 93800 - DNA, 736 bp, Homo sapiens
  misc_feature: GYAE6OF01DMLOJ.29.85.H08.1.454.CMB.1.raw
  modified_base (199)..(199): a, c, t, g, unknown or other
  misc_feature (199)..(199): n is a, c, g, or t
  modified_base (233)..(233): a, c, t, g, unknown or other
  misc_feature (233)..(233): n is a, c, g, or t
  modified_base (721)..(721): a, c, t, g, unknown or other
  misc_feature (721)..(721): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcgagggcacaggactccgtgggctcagtctgccctgactcagcctgctcagtcgtccggtctccgtggacngtcacgtcaccatcctccgtgccacgtggaaccngcctagcgatggtacggtggttataactttgtctccgtacgtaccaacacacccgagccggaccggcccccataccgtattaactttcagtattcgtactaacgtttaacggcccgtcctccggaacgggtcccgtagtacttccgtccttcgtaccgtcggtcctaacgtaacgtccgtacggacctaacctacgttccgtacccttcccggtactaccgtactccgttccggtcgggtcccttaccggtacggtaccgtacgtaaccggtcgttacggggtacggtttaactacgttttaactttaccgcgtcctttaacgtccgttacttacggtttaccggaccgtacgggcccctaacccgtccgtaacgttggtccggtacgtttcccgggttaaccggggaccggtaaccgggaaacccgtacgggttaccccgttacgggtaaaccccggttcggtaaacccggttcgaacggttacccnccgggtaaccccggg

SEQ ID NO: 93801 - DNA, 733 bp, Homo sapiens
  misc_feature: GYAE6OF01D24VE.29.85.H08.1.454.CMB.1.raw
  modified_base (225)..(225): a, c, t, g, unknown or other
  misc_feature (225)..(225): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcaggtgtccgggtctcctggacagtcagtcaccatctctgcactcggaaccngcagcgattcggtacggttaggttaattaactttcgtccttccgtacggtaaccaaacaaccaccccgaggacccggaccggcccccccgtatacctaacttaatttacgtagtattcgtactaagttaacggcccggtacccgtcgtaaccggggttccctagtacttccgtcttcgtcgtcggtcctaccgtaacgtccgtcggaccaacctcgtccgtccctaccgtacgacctacttccgttacgtcgggtacctacccggaggtaccgtacggaccgtagtacggtacgttgtaactttacgttacgtcgtacttgtaccttacgttaacgtttcggacgtaccgggtaccctacccgtccgtaacggttcggtacgttaccggtttaccgggttaccggggtaaccggggtaaccgggtacccgtaaccgggtcccgtacccgggttaaccccgttccggtaaacggttccgaaccggttcccggtaaccggtaaccccggg

SEQ ID NO: 93802 - DNA, 683 bp, Homo sapiens
  misc_feature: GYAE6OF01B61TC.29.85.H08.1.454.CMB.1.raw
tcagatagagtactcacgaccggtgctcgatttagtatcactcagtcggcggggggggtctcaggaggcagcactctcgggacgtctccaccatggcctggctctgctcctcctcagcctcctcactcagggcacaggatcctgggctcagtctcgccctgactcagcctcgctcagtcgtccgggtctccgtggacagtcagtcaccatcctcctgacacgtaggaaccagcagcgatggtcggtggttaatactttgtctcgtacgtaaccaacaccaccgcggacgaccggccccctagtctaattacttatgtaatcgtactagttaacgccggccgttacggacgggttccctagtacgtcgtctttacgtcgtcggaccttccgaagttccgtaaggcctaaaccgcgtcgtaccccttcccgtacgtacctacttccggtcgtcgggtaccttaccgacggtacgtacggtacgtaacgtcggtaacggttacgtaactttaacgttacgtagttccgtagtccttacgttacgtttacggacccgttaccgccgtaccccgtacgtacgttcgtacgttaaccgttccggtacggggtaacgggtacgggaacccgttaacgccggtaccgtaccggttacgttaccggactaacggtccgtaccggtaacccgg

SEQ ID NO: 93803 - DNA, 161 bp, Homo sapiens; identical to SEQ ID NO: 93455
  misc_feature: GYAE6OF01E2UWZ.29.85.H08.1.454.CMB.1.raw
  modified_base (150)..(161): a, c, t, g, unknown or other
  misc_feature (150)..(161): n is a, c, g, or t

SEQ ID NO: 93804 - DNA, 762 bp, Homo sapiens
  misc_feature: GYAE6OF01ESMDN.29.85.H08.1.454.CMB.1.raw
  modified_base (258)..(258): a, c, t, g, unknown or other
  misc_feature (258)..(258): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacgaggtactccgtgggctcagtctcgcctagactcacgcctcgctcgaggttcggtcccgggtctccgtggactacgtcaacgtccaacctacttccgtcctgacctacggtaccggaaaccngccaggcgtattgggtacggttagttaacttacgtttcgtccttaccgtacgtaaccaacctaaccgacccggacggaccggaccccggtaccccccgtaataccgtaatttaacgttacgtgtacttacgtactaacggtacggtcccggtccgtacggtacgggttccctggaccgttcctccgtttcaccggttccgtacgtaccgtacgtcgtacgaccaaccgttcgaccgtccctacctacgtacctcgttccgtggtaccgtcctaccggtgtaacctcgggttaacgtccggtacggttacggtacgttacgtttaacgtcgttccggtaagttcgtaaccgttacttacgggtttccgaccggtaacgggtccctaccgggactacggttcgggttaccgtaccgggttccggtacccggggtacggaaacgtaccgggtcttaccggtacccggtcggttaccgtaacgccgtacggccgttaagggacccccg

SEQ ID NO: 93805 - DNA, 782 bp, Homo sapiens
  misc_feature: GYAE6OF01CEXLO.29.85.H08.1.454.CMB.1.raw
  modified_base (230)..(230): a, c, t, g, unknown or other
  misc_feature (230)..(230): n is a, c, g, or t
tcagatagagtactcacgaccggtgctcgatttagtatcactcagtcggcgggggggggtctcaggaggcagcactctcgggacgtctccaccatggcctgggctctgcctcctcctcagccctcctcactcgagggcacaggatccgtgggctcagtctcgccctgactcagccctcgctcgagtcggtccgggtctccgtagggacagtcagtccaaccctatctccncgcaacgtcggaaaccaggcaacggtcgagttcgggttacggttaggttaattaacgttttgtccgttaccgttaacggtaacccaaacgaaccgacccgaacggacccggaccggacccccccgaactaccgtaattaacttagtatacgtgtacgtaagttaacggtcccggacccgtcggtaccggggtccctaggtactcgtccttctcgtcggcctaccgtaacgtcgtacggtaacaaccgtacctccggtacccctacccgttaccggaacctaccgttcgttacccggtccgggtacccccttacccggacgggtaccgttacgggaaccggttaacggtacggttaaccgggttagttaaacgttttagtttaaccttccggtccgttacgttaccttacgtacgttttacccggacgtaccgggccctaaccccgagtaacccgttggtacggttacgtccgggttacggggccgggtaacgtaccggacggtcgttaccgggtaccgttaccgtacggaccacggtacgtaccgtacccgg

SEQ ID NO: 93806 - DNA, 728 bp, Homo sapiens
  misc_feature: GYAE6OF01CKCLK.29.85.H08.1.454.CMB.1.raw
  modified_base (242)..(242): a, c, t, g, unknown or other
  misc_feature (242)..(242): n is a, c, g, or t
tcagatagagtactcacgaccggtgctcgatttagtatcactcagtcgcggggggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcgccatctcctgcactggaaccagcagtgacgttggtgttangactatgtctctggtatcaacaacacccggacaaacgtccccaaactcctagtactttagtgtaacgtcgactaacgtcgtaacccgtcgacggggttcccctgtactcgtcctttttcgtcggtacctaccgaaaggttcgttacgggaccaaacccgacccgggtccccttaccccgtacggtaccccgttccttccgtcggggtcccttcccgaagggtccgtaggacgtaagtcgggacggtacgtacgtaacgttacgtttaacgtcgtccttccgtacctaattacgtcgaccgtaacgggaacctaaaactaaccgttaagtttttacggttaacgtttttaccggggaacgggtaaccggggtaacccaaagggttccgtaccgtaacccggttccctacgtaggtacctacggtacccgtacggtaaccgtcccgttacccgtccccccggtacggttcccgtaccgtttcccccgg

SEQ ID NO: 93807 - DNA, 498 bp, Homo sapiens
  misc_feature: GYAE6OF01ANPOM.29.85.H08.1.454.CMB.1.raw
  modified_base (411)..(411): a, c, t, g, unknown or other
  misc_feature (411)..(411): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataacttttgtctcctggtaccaacaacacccaggcgaggcccccccgatcataatttatgatgtcattaagcggccctcaggggtccctgatcgcttctctggctccagtctggccaacactgccctccctgacccatctctgggcctccaggctgacgatgacggtnatttattactgctgctcatttgcaggccacccgnactgtgntcgtcggcggagggaccagcctgacccgtcctaggccagctgacgg

SEQ ID NO: 93808 - DNA, 630 bp, Homo sapiens
  misc_feature: GYAE6OF01BW9GZ.29.85.H08.1.454.CMB.1.raw
  modified_base (224)..(224): a, c, t, g, unknown or other
  misc_feature (224)..(224): n is a, c, g, or t
  modified_base (293)..(293): a, c, t, g, unknown or other
  misc_feature (293)..(293): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcgtgttataacttgtctccggtaccaacaacacccaggcgacgcccccgatcataattntgatgtacattaacgcggccctcgacgggtccctgactcgcttctcgtcggtcctccaagtctggcaacgactcgcctccctcgacctatcgtcgtacgggccttaccgacggtccgttacggaacgtacgttcggtaccgggttagtaacgttttaactttaaccgtcggtcctttcgtctttacctagttttcggaccgtacggtacccgtacccggccttacggttacggtcggtaacgtttccggttccggggacgggtaacgggacccgaacggtccgtaccggtacccgttaccggttacggccgtaacggcctccggaacgggttccccg

SEQ ID NO: 93809 - DNA, 798 bp, Homo sapiens
  misc_feature: GYAE6OF01B9GOX.29.85.H08.1.454.CMB.1.raw
  modified_base (730)..(730): a, c, t, g, unknown or other
  misc_feature (730)..(730): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcgttgggttttccttgttgcttaattttaaaaggtgtccagtgtgaagtgcagctggtggagtcgtggggtagtcgtggtacaggtccgtgggggtccctgagtaccttcgtccgtgtcgcgacgtcccgtcgtaggtaatttacgtaaagttttaatcgtttaacttttttacccaattaaccgtacgttcggggtccgtacgaaacggtccggtaccgggggaagggttccgtgggtacggttcgggttacttcgttactttaagttacgtacggtaggtacggttctaccgttaaccttactacgtttctaagtcgactagtacttcgtaggtacggaacgggtccgtacttaccgaaccttacgtcccgtaaccgtaacggaacgaaacccgaaactaaaaccgttaaccggttacccttaccccgttaagttaaccttaccggttaacgtaaccttaaacgtacgtaaacgttcgtaacgtaaaggtaaggtaaacgtacgtaaacccggaactacgggttccgttaccgtttacgtttaagtttaacgtttaggtaacgaaacgtaaaaagggnggaaaaccggtacgtaagggttaacctacgggtttaagggtccgggttaccggttacggtttaaccgg

SEQ ID NO: 93810 - DNA, 601 bp, Homo sapiens
  misc_feature: GYAE6OF01CGOHL.29.85.H08.1.454.CMB.1.raw
  modified_base (227)..(227): a, c, t, g, unknown or other
  misc_feature (227)..(227): n is a, c, g, or t
  modified_base (291)..(291): a, c, t, g, unknown or other
  misc_feature (291)..(291): n is a, c, g, or t
  modified_base (582)..(582): a, c, t, g, unknown or other
  misc_feature (582)..(582): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatccgtgggctcagtctgccctgactcagcctcgctcagtcgtccgggtctccgtggacagtcagtcaccatctcctgcactggaaccngcagcgatgtcggtgttatacttgtctctgtaccacacaccagcgacgccccgatcatacttangatgtcatagcgcctcgacgggtcctgactcgcttctcgtcgctacgacgtcgtacgactaccgtacgtccgccctcccgtacgacctacttccgtcgtcggcccgtccgacggtcgtacgaccgtacgtcggtacggttgtactttacgttaccgtgtaccgtcgttacttacctttaggttaccgacgtacgacccgtacccgtctaaccgtgtacgtccgttccgttaccgggcgggtaaccggacccgtacgtcccggtaccgtacccggttaccgtacggttaccnccggtcgttacggacccgg

SEQ ID NO: 93811 - DNA, 707 bp, Homo sapiens
  misc_feature: GYAE6OF01EJHKC.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcggtggtacagccgtggggggtccctgagactctcctgtcgcagcctctggtattctaaagtttaatgttactttttccatactacgttcgggtccgtacgaagtccggtaccgggggaaggttccgtagggtaggtcgggttctcgttactttaagttaagtcggaaggtacgggttgaccttaacgtactaactttctaagttcggctaacggtacctcgttaggtaggaaacggggtcccgtaatttcccgaaccctaacttccctaccgaaaggtaacgaaaccctaaaacgaaaccgtaaaccgttaccccttaccccttagttaaccttcctaggaactaaagttacaaacgtgttaccaggaaggtaacgtaggaaccgaacgacggtccggtactttaccgttattagtttgacgtaaacgaaaaggtacgaagggtacaaggtaacgttacgtaagggtcgggtcgtcggtttaacgg

SEQ ID NO: 93812 - DNA, 555 bp, Homo sapiens
  misc_feature: GYAE6OF01EZLHR.29.85.H08.1.454.CMB.1.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
  modified_base (274)..(274): a, c, t, g, unknown or other
  misc_feature (274)..(274): n is a, c, g, or t
  modified_base (281)..(283): a, c, t, g, unknown or other
  misc_feature (281)..(283): n is a, c, g, or t
  modified_base (318)..(318): a, c, t, g, unknown or other
  misc_feature (318)..(318): n is a, c, g, or t
  modified_base (357)..(357): a, c, t, g, unknown or other
  misc_feature (357)..(357): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacngtcagtcacntctctgcactgaaccagcagcgatgtcggtgttatacttgtctctgtaccaacacacgngcacgccccancatattnnntgcatacgcgcctcgacgggtcctgactcgcttcncgtcgctcaagtctggcaactctcgccctccacgacctntccgtcgtcgggtcctccgtacggtcctacggaccgtagtacggtacggtgttaacgttactttacgtcgtcttacgtcttacgtgttacgaccgtacggtcccacccgtctacgtcgtcgttacgtccgttacgggaccggtaggaaccggtagccgtacggtacccgttacggtacgtacgacgtcaccggtacgg

SEQ ID NO: 93813 - DNA, 528 bp, Homo sapiens
  misc_feature: GYAE6OF01CTNL1.29.85.H08.1.454.CMB.1.raw
  modified_base (196)..(196): a, c, t, g, unknown or other
  misc_feature (196)..(196): n is a, c, g, or t
  modified_base (316)..(316): a, c, t, g, unknown or other
  misc_feature (316)..(316): n is a, c, g, or t
  modified_base (335)..(335): a, c, t, g, unknown or other
  misc_feature (335)..(335): n is a, c, g, or t
  modified_base (462)..(462): a, c, t, g, unknown or other
  misc_feature (462)..(462): n is a, c, g, or t
  modified_base (514)..(528): a, c, t, g, unknown or other
  misc_feature (514)..(528): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgactcataatttangatgtcattaagccggccctcgaggggtccctgactcgcttcctctggcctccaagtctggccaaccgactgccctccctcgaccatctcgtgggcctccgaggctgacgatggacggtnaactttatactgctgctanatttcgacgcgacccgcacgtagtgattccgtggcggcggaaccgacgcgtcgaccgtcgtaggtcagtccgtcgaacggcctccgtcccctcggtcctactccgttcgtccctcccctcctaccgnttacccttctacgtactcggtacgccgggctcggacgacggcgcacgatagnnnnnnnnnnnnnnn

SEQ ID NO: 93814 - DNA, 622 bp, Homo sapiens
  misc_feature: GYAE6OF01EYOV3.29.85.H08.1.454.CMB.1.raw
  modified_base (210)..(210): a, c, t, g, unknown or other
  misc_feature (210)..(210): n is a, c, g, or t
  modified_base (232)..(232): a, c, t, g, unknown or other
  misc_feature (232)..(232): n is a, c, g, or t
  modified_base (314)..(314): a, c, t, g, unknown or other
  misc_feature (314)..(314): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
tcagatagagtactcacgaccggtgctcgatttagtatcactcagtcgcggggggggtctcaggaggcagcactctcgggacgtctccaccatggcctgggctctgctcctcctcagccctcctcactcgagggcacaggatccgtgggctcagtctgccctgactcagcctcgctcagtcgtccggtctcctggacagtcagtccaccnttctcctgcctactcggaaccngcagcgtatggtcggttgtatactttgtctctcgtaccaacacaccgaggccgacgcccccgatccgaattaattactgatntactattaacgcggtcctcgacgggtccctgacttcgtcttcgctcggctacctaagtcgtgaccaactccgtcgtccctcctgacctacgtccgtcgtcggtcctaccgacgtcgtacgtacgacgttggacggtagttacttaactttcgtcgtacgttcgtcttacgtaacgtttgaccggtaacggccttacccggnttaccggtntacggtcgtttcgaccgggggtccgaaagggtacctaggccgttaccggaccccggttaccgttacgggaccgtaacggtcccgtccggtaaccgggg

SEQ ID NO: 93815 - DNA, 662 bp, Homo sapiens
  misc_feature: GYAE6OF01DNNX5.29.85.H08.1.454.CMB.1.raw
  modified_base (207)..(207): a, c, t, g, unknown or other
  misc_feature (207)..(207): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcacntctcctgcactggaaccagcagcgatcggtcggtagttataacgtttgtctccgtacgtaccaacaaccaccaggccgaccggccccgactacaattaacttatgtatgtactaagttacgccgtccgtcgtacgggtcctggacttccgtcttcgtctcggtctaccgtacgtcgtcggacctaacctacgtccgtccccttacccgtaccgaaccttacgttcccgttaccggttccgggacccgttacccgacgggtaccgtacggtacggtacgtacggtaaccgggttacgttaacttttacgtttacgtcgttccgttacgtcttagttacgtttcgacgtcggtaccctacccggtctacgttcggtactccggttcggttaccgggacgggtaacggacggtacgcgtcccggtaccgtccggtagcccgtagccgtacgtacccgg

SEQ ID NO: 93816 - DNA, 639 bp, Homo sapiens
  misc_feature: GYAE6OF01B7GPJ.29.85.H08.1.454.CMB.1.raw
  modified_base (139)..(139): a, c, t, g, unknown or other
  misc_feature (139)..(139): n is a, c, g, or t
  modified_base (230)..(230): a, c, t, g, unknown or other
  misc_feature (230)..(230): n is a, c, g, or t
  modified_base (291)..(291): a, c, t, g, unknown or other
  misc_feature (291)..(291): n is a, c, g, or t
  modified_base (323)..(323): a, c, t, g, unknown or other
  misc_feature (323)..(323): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggntcctgggctcagtctcgccctgactcaggcctcgctcaggtcgtccgggtctcctggacagtcacgtcaccatcctctgcactcggaaccngcacggcgagtcgtcggtagttacttacttcgtcctccgttagtaaccaacgacctaccgnggaccggaccgcccccgataccatttacttancgtactactactattacgccggtcctacggtacgggtcctacgcgttaccgtcttcgtcgtcggtcctaccgtaagtccgtaggacctaactcgtaccgtcccttaccgtacgtacctacgttccgttcgtccggtcctaccggaacgtcgtacgaccgtagtaccggcggttaacgtacgttacgttcgtcgtcttcgcttactagtttacgacgtaccggtcccacgtctacgttcgacgttccgtcggtacgggacgaaggaccgtcgtaccgacggttacccgtacggacgtccacgtcgtacggtacccgg

SEQ ID NO: 93817 - DNA, 711 bp, Homo sapiens
  misc_feature: GYAE6OF01D6SAT.29.85.H08.1.454.CMB.1.raw
  modified_base (234)..(234): a, c, t, g, unknown or other
  misc_feature (234)..(234): n is a, c, g, or t
  modified_base (686)..(686): a, c, t, g, unknown or other
  misc_feature (686)..(686): n is a, c, g, or t
tcagatagagtactcacgaccggtgctcgatttagtatcactcagtcgcggggggggtctcaggaggcagcactctcgggacgtctccaccatggcctgggctctgctcctcctcagccctcctcactcgagggcacaggactcctgggctcagtctgccctgactcagcctcgctcagtcgtccgggtctccgtggactagtcagtccaccatcctcctgcacgtcggaaccngcagcgatggtcggttaggttactacttgtctcctacgtaaccaacaacaccgacggccgaccggcccccgatctaacttaattactagtactagtactagttaacgcccggcctacggtaaccgggttcctagtactccggtcttcgtccgtcggtacctaccgtaacgttcgaaccggaccaacctacgtccgtaccccttaccgacgtaccctacgttccgtaccggtcggtcccgtacgacggtaccgttgaacccgttagtacgggttaacggttacttacgtttacgtaccggttagtccttccgtacctttacgtacgtttaacgccggtaccgtacccgaccctacgtaaccgttggtaacctcccggttaacgggttccggggaaccgtaacggggtaacctccgggtacgtaccccgtaccccggttgtacccgggttaccnccgggttacctaaaccgggtcccgg

SEQ ID NO: 93818 - DNA, 649 bp, Homo sapiens
  misc_feature: GYAE6OF01AFC20.29.85.H08.1.454.CMB.1.raw
  modified_base (601)..(601): a, c, t, g, unknown or other
  misc_feature (601)..(601): n is a, c, g, or t
  modified_base (609)..(609): a, c, t, g, unknown or other
  misc_feature (609)..(609): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgcttattttaaaaggtgtccagtgtgaagtgcagctggtggagtcgtggggggagtcggtggtacaggccgtggggggtccctgagacctctcctgtgcagccctctggattctaagtttaatgtatttttccatactactggggtccgtcgaagtccgtaccgggggaagggttccgtggggtacggttggggttccttcgttctttaatttaagtcggaaggtaccggtgtaccttaactaactatttacctatcgactagtacctcgtggtggaacgggccgtattccaccgtatcctaccagaacgaaccaacaactaacgtaccttccctagtactctcgaactaaagtcgaacacgttctaggaaggtaacgtagaaccgaccgtacggccggtcttacgttatttagtaggttacgaacgtaaaaggngaaacggngaaggtactacggtaagggtcggggttccgttggttaacg

SEQ ID NO: 93819 - DNA, 562 bp, Homo sapiens
  misc_feature: GYAE6OF01D0XWR.29.85.H08.1.454.CMB.1.raw
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (269)..(270): a, c, t, g, unknown or other
  misc_feature (269)..(270): n is a, c, g, or t
  modified_base (277)..(278): a, c, t, g, unknown or other
  misc_feature (277)..(278): n is a, c, g, or t
  modified_base (281)..(281): a, c, t, g, unknown or other
  misc_feature (281)..(281): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcgagggcacaggatccgtgggctcagtctgccctgactcagcctcgctcagtgtccggtctccgngacngtcagtcacntctctgcatggaccngcagcgatgtgtgttatacttgtctctgacacacaccngcncgcccnncatattnnatntcatacgcgcctcgacgggtcctgactcgtcttcgtcgtcggtctaccgtaagtccgtggaccaacgtcctacgtcccctcccgtacgaccctacttccgtcggttcggtaccgttcccgaagtccgtagaccgtagttcggaacggttctatttaaccgttatcgtcttacgtcttacgtagttcgacgacgtaccacccgctagtgtcgtgttccgtcgggacgggacggactaacgccgtacgtaccgtcgtacggtaccacggtcctggtaacccgg

SEQ ID NO: 93820 - DNA, 832 bp, Homo sapiens
  misc_feature: GYAE6OF01DOPZN.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgtcttattttaaaaggtgtccagtgtgaagtgcagctgggtggagtcgtgggggagtcggtggtacaggccgtggggggtccctggagtacctctccgtggtcgcacggcccttgtcgggtaattttaccgaaaagtttttaagtgtttaactttttttaccccaatttaccctaccggttcgggggtttcccgtacctaaagggccgttaccgggggggaagggttccgtaggggtaggttccgggggtcttcctttacgttttaacttaaacgttccgggaaggtaccggttcggtaccttaccttaactagttttcctaaattcggaccgtaagtactttccgttaggtacgggtaaacggggaccccgttattacccgaacccctattacccccgtaccgaaagggtaacaacccgtaaaacaaaccgtaacggtttaacccttccccgttaggttaactccgttagtaaaccgtaaattacggaaacctaaggtttccgtaagggaacgtaacggttcgaaacccgtacgacggtacccggttactttaccttaattttacggttagggtacgaaacgtaaaaagggacgtaaacggggactaaggggtactttaaccgggttaagggtttcggggtacccgtttcgggttttaaaccggg

SEQ ID NO: 93821 - DNA, 579 bp, Homo sapiens
  misc_feature: GYAE6OF01BADHO.29.85.H08.1.454.CMB.1.raw
  modified_base (224)..(224): a, c, t, g, unknown or other
  misc_feature (224)..(224): n is a, c, g, or t
  modified_base (292)..(292): a, c, t, g, unknown or other
  misc_feature (292)..(292): n is a, c, g, or t
  modified_base (332)..(332): a, c, t, g, unknown or other
  misc_feature (332)..(332): n is a, c, g, or t
  modified_base (353)..(353): a, c, t, g, unknown or other
  misc_feature (353)..(353): n is a, c, g, or t
  modified_base (419)..(419): a, c, t, g, unknown or other
  misc_feature (419)..(419): n is a, c, g, or t
  modified_base (559)..(559): a, c, t, g, unknown or other
  misc_feature (559)..(559): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcgtgttatacttgtctctgtaccaacaacaccaggcgacggcccccgatcataacttntgatgtcattagcgcctcgacgggtccctgactcgcttcnctggctctagtctggacaacnctcgccctcctcgaccattcctcgtcgggccttaccgaggtcctacggacgacgtcggtacggttntaacgtttacttaccgtgtacctgtccttactacgtttcgaccgtacggtcccaccccgtgtaccgttggtacgtacgttcccggttccgggacgggtacggaacctaacggccgttaccggaccgttccgtacggtacncggtacccgtgtaacccggg

SEQ ID NO: 93822 - DNA, 700 bp, Homo sapiens
  misc_feature: GYAE6OF01DG2OC.29.85.H08.1.454.CMB.1.raw
  modified_base (615)..(615): a, c, t, g, unknown or other
  misc_feature (615)..(615): n is a, c, g, or t
tcagatagagtactcacgaccggtgctcgatttagtatcactcagtcgcgggggggggtctcaggaggcagcactctcgggacgtctccaccatggcctgggctctgctcctcctcacgcctcctcactcgagggcacaggatccgtgggctcagtctcgcctgactcagcctcgctcagtcgtccggtctccgtggacagtcagtaccaccatcctcctcgactacgtacggaaccagacagcgtagtcggtacggttagttactaacgttcgtccttccgtacggtaaccaacgtaaccaccgacggaccggacccggacccccgtatacctaattactttagacgtactacgttactaacgttaacgcccggtacccgtacgaaccggggttcctacgtcgttccgtccttcgttcccgtcggtacctaccgtaacgtccgttacggaccctaaacgccgttaccgtccctaccgtacgaccttacgtcctaccggtacggtcctaccgagtacccgtggaccgtagtccgggtaagtacgtactttactacgtcgtccttagttccttaacgttcgtcgtacgacccggtccaacccggtctacgttcgtnttaccggttcggtccgggaacggtaccggaactaggtcccggtaccgtaaccggtcgtaacgtcgaacgtccgttaggaccccgg

SEQ ID NO: 93823 - DNA, 477 bp, Homo sapiens
  misc_feature: GYAE6OF01ARAU3.29.85.H08.1.454.CMB.1.raw
  modified_base (230)..(230): a, c, t, g, unknown or other
  misc_feature (230)..(230): n is a, c, g, or t
  modified_base (462)..(477): a, c, t, g, unknown or other
  misc_feature (462)..(477): n is a, c, g, or t
tcagatagagtactcacgaccggtgctcgatttagtatcactcagtcagtcaccatctcctgcactggaaccagcagcgatgtcggtggttataactttgtctcctgtaccaacaacacccaggcgaggccccccgatcataatttatgatgtcattaagcggccctcaggggtccctgatcgcttctctggctccaagtctggcaacactgcctccctgaccatctcgngggcctccgaggctgacgatgacggtgtattattactgctgctctatttggcacggccacccgcacttgtgactcgttcggcgggaagggcccaaggtcctcggtacccggtaccgttaggtccaacgcctacgaacggtccctcggtccccccgtcggtcctacctccttcgttccccaccctccctctacgtctctactctaggcggtcggcgtggcgaggcgacatagnnnnnnnnnnnnnnnn

SEQ ID NO: 93824 - DNA, 641 bp, Homo sapiens
  misc_feature: GYAE6OF01BJOG2.29.85.H08.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
tcagatagagtactcacgaccggtgctcgatttagtatcactcagtcggcgggggggtctcaggaggcagcactctcgggacgtctccaccatggcctgggctctgctcctcctcagcctcctcactcgagggcacaggatccgtgggctcagtctgccctgactcacgcctcgctcgagtcgtccggtctccgtggacngtcagtccaccntcctcctgcacgtggaaccagcagcatggtcggtgttatacttcgtctctacgtaaccaacaacaccgacggtaccgaccggcccccagtacacttaagttatgtatgtactaacgttacgccgtcctacggtacgggtccctgtacctcgtcttcctcgtcgtacctacgtaacgtccgtacggtaccaaccgtctcgtccctccggtacaacccgtgttcctccggtcggcccgtacgacggtcgtacgaacggtagtcgggtaacgtagtaacgttaattccgtgtccgtagttctaacgttacgttcgaaccgtacgggaccctacccggtacgttaaccgtggtaccgttacggtaccggttccggggaccggtaacgaccggtaacgtccgtaccgtcgtactacggctacgcgtacgtcccg

SEQ ID NO: 93825 - DNA, 555 bp, Homo sapiens
  misc_feature: GYAE6OF01AYKAZ.29.85.H08.1.454.CMB.1.raw
  modified_base (290)..(290): a, c, t, g, unknown or other
  misc_feature (290)..(290): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccggtctcctggacagtcagtcaccatctcctgcactcggaaccagcagcgatgtcggtgttatacttgtctctgaccaacacaccaggcgacgccccgatcattattangatgtctagtacgccgtcctcgacgggtccctgactcgtcttcgtcgtcgcctacctagtctacggacaacgtctcgccctccgacgacctactcctacgtcggcctccgagtcgtagtacgagtggtacgtgtaatttacgtactcgtctgtctacttagttcgacgtccggtaccacccgctacgtcgtacgtaccgttcggtaccgggacggtacggacgtacgtcgtaccgtaccgtccgtacgcgacgtcgtcgtaccgg

SEQ ID NO: 93826 - DNA, 563 bp, Homo sapiens
  misc_feature: GYAE6OF01CCJNB.29.85.H08.1.454.CMB.1.raw
  modified_base (221)..(221): a, c, t, g, unknown or other
  misc_feature (221)..(221): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (433)..(433): a, c, t, g, unknown or other
  misc_feature (433)..(433): n is a, c, g, or t
  modified_base (489)..(489): a, c, t, g, unknown or other
  misc_feature (489)..(489): n is a, c, g, or t
  modified_base (548)..(551): a, c, t, g, unknown or other
  misc_feature (548)..(551): n is a, c, g, or t
  modified_base (553)..(555): a, c, t, g, unknown or other
  misc_feature (553)..(555): n is a, c, g, or t
  modified_base (557)..(563): a, c, t, g, unknown or other
  misc_feature (557)..(563): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtgttataactttgtctctgtaccaacacaccaggcgacgcccccgatcataatttatgatgtcagttaagccggccctgacggggtcccngactcgcttctcgtgctaccagtctggcaacactcgtccctcctcgacctatcctcgtcggcctaccgngctaggacgagtcggacggtntaagtttactacngtctgtcttacgtacgtttcgcgtacggaccacccgtctacgtcgtggtaccttcggttccggggaccgggacggaaccgtacggtctacggacccgtcggtcgtaccngtcgtacgacgtccgcccgtccctcggtcctccgtccttcccgtccctccctcctntaccgttctccttacgtcgacggtcgggccggtcgtaggaccggacgcgtacgtagcgnnnncnnntnnnnnnn

SEQ ID NO: 93827 - DNA, 835 bp, Homo sapiens
  misc_feature: GYAE6OF01A7E7T.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagttggactgagcgtggtttctgtgctatttaaagtgtcagtgtgaagtgcagctggtggagtcgtggggagtcgtggtacaggccgtgggggtccctgacgactcgtcctgtcgcacgtcctcgtggtacttacgtaagtttaatgtactttttaccattacctacgttcgggtacccgtacgaacggtccggtaccgggggtaagggtccgtaggggtacgggttcggggttccttaccgttacgtttaacgttaaacgttaccgggtaagggtaaccggttacggtacccttaaaccgttaacgtaaccgtttaccttaagtcggaccgtaacgtacccttcggttaggtaacggggtaaacggggtacccgtaacgtttacccgaacccttacgttaccccgtaccgaaacgtaaacgaaacccgtaaaaaccgtaaaccgtaaaaccgttaccccttacccgttaacggttaactttcccgtaacgaaaccttaaacgtacggtaaactacggtaacgtaggaaacggtaaggttacgaacgtaacgtacgggtaccgttactttaccgttaaagtttacggtttagtaaacggaaaccgaaaaagggtacgggtaaaacggaacgtaacggggtaaactttaccggggttaaaagggttacccgggggtttaacgttcccgggtttaaacgg

SEQ ID NO: 93828 - DNA, 748 bp, Homo sapiens
  misc_feature: GYAE6OF01D50AW.29.85.H08.1.454.CMB.1.raw
  modified_base (678)..(678): a, c, t, g, unknown or other
  misc_feature (678)..(678): n is a, c, g, or t
tcagatagagtactcacgaccggtgctcgatttagtatcactcagtcgcggggagctctgggagaggagcccccagcccctgagattcccaggttgtttccattcggtgatcaggcactagaacacgagagacgcaccagtggagtttggactgagtcgtcggtttcgtgtagctagtttaaaggtgtctagtgtgagtgcagtcgtggtggagtcggtggggagtcggtggtacgaggtccggttcggggggtccctaggacgtaccttccgttccgtgtcggacctacgtccctgtaggtaatttaccgtaaagttttaattgtttacttttttccaacgttaccgtacggttcgggtaccgtacggaacggtccgggttaccggggggtaacggtcggttaggggtacgggttcgggttaccttacgttactttaagttaacggcggtaacggtacggtacgtactaacctattagttcctagtcgactacgtacgtcgtaggtaggaaccggtccgttactaccaaccgtactccgtaaccgaggaaacaaccaaaccgtacgtaaacccgtaccttacccgttagtaccttcgtagaacgtaaattcgaaactcgttaaccgtagaacgtaagacggaccgaacggtcgacgttcttacgttattagttacgngtaaaacgaaggtaacggaacggtagaaacggttagtacggttaaggggtcgttaccgtcggttaacggg

SEQ ID NO: 93829 - DNA, 792 bp, Homo sapiens
  misc_feature: GYAE6OF01CGFIC.29.85.H08.1.454.CMB.1.raw
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
tcagatagagtactcacgaccggtgctcgatttagtatcactcagtcgcggggggggtctcaggaggcagcactctcgggacgtctccaccatggcctgggctctgcctcctcctcagccctcctcactcgagggcacgaggatccgtgggctcgagtctcgaccctgacctcacgtccctcgcctcgacggtcggtccgggtctccgtaggacngtcacgtccaccatcctccgtgctacgtcggaaaccngtcgacggacgtagttcggtcggttagttaacttaacgtttcgtcctacgtacgtaaccaaacctaccgaccgtacggccgacccggacccccgtaactacgtaattaacttacgtagtacgttaggtaactaacggttaaccggcccggtacccgtacgggtaccgggttacccctggtaaccgttccgttcgttccgttacccgggtcgttaccgtaacccgtacggtttccgaccggtaaacctaccgtacccttcccggtccccttacccgtaccggtaacccttacgttccctaccggggtccgtaccccggtcggtacggcgttaaccgggtagtacggtccgggttaatacgttaacgtttaccgtacgttcgtaccttacgtccttaagtcggtcgaccgtacccgtacgtacccggtactacgttacgtccggttacggtccgggtaccggggaacccgtacgggtaacggtcccgacgggtaaccctacgggttcctacgggtcccaacgttcccggtcccgacccgggg

SEQ ID NO: 93830 - DNA, 709 bp, Homo sapiens
  misc_feature: GYAE6OF01DCNZY.29.85.H08.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (319)..(319): a, c, t, g, unknown or other
  misc_feature (319)..(319): n is a, c, g, or t
tcagatagagtactcacgaccggtgctcgatttagtatcactcagtcgcggggggggtctcaggaggcagcactctcgggacgtctccaccatggcctggctctgctcctcctcagcctcctcactcgagggcacgaggactcctgggctcagtctgccctgactcacgcctcgctcgagtcgtccggtctcctggacngtcagtcaccatctctgcacgtcgaaccngcagcgtagtgtcggttagttaatacgttgtctacgtagtaaccaacaaccaccgaggccgaccggcccccgactactaagttaatttacngtactgtacgtaacttaacggcccggtcccgtacggaccgggtccctagtacgttcgtccttcgtcgtcggtacctaaccgtacgttcgtacggaccaaccgtactccgtacccctaccgtacgtaaccctacgttccgttacgtcgggtacccttaccggtacggtaccgttacggaacggtaacgttacggggtaaccggtttaagtttaaaccgttttaaacgtttacgttccgtaaccgttcggttaaccctttacgttaacgtttccggaaccgaccggtaccctaccgtcgtaccgttagccgttaccggtacggtccgggaaacgggtacacggtacgtccgtacccgtaaccggtcgtacgccgaacgtcgtcgaacccggg

SEQ ID NO: 93831 - DNA, 685 bp, Homo sapiens
  misc_feature: GYAE6OF01CZPQD.29.85.H08.1.454.CMB.1.raw
  modified_base (441)..(441): a, c, t, g, unknown or other
  misc_feature (441)..(441): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
  modified_base (685)..(685): a, c, t, g, unknown or other
  misc_feature (685)..(685): n is a, c, g, or t
tcagatagagtactcacgaccggtgctcgatttagtatcactcagtcgtgccctgactcagcctcgctcagtgtccgggtctcctggacagtcagtcaccatctcctgcactggaaccagcagcgatgtacggtggttataactttgtctcctggtaccaaacaaccacccgtaggcgtacggcccccccgactaccgaattaatttactcgtatcgtctaagttaacggccggaccctcgaacgggggttcccctggaactccgtcttcgtctcggcctaccgaagtctaggaccaacacgtcgccctccgtacgaacctactcctcgtcgggccttacccgagggtcctacggacgtacgtacggaacggtaacgtaacgttttactacgtgcctacggtccttccgtaagtttcgaccgtacggtacccaccccggtntaccggttcggtacgtaacgttcggttaccgggacggtaaggtaaccccagtccgtaccggtacccgttacgtacgccaagtccgacgacgtccgtacccgtcccgttggtcctaccgttcgttacccctaccccgtcctcctacgtacgtacccttctaactcggtcgtaccggtcgggtaccgtggtaccgaagggtccctagtacgtgacctgagtcncncncgcgtactacatctctgtn

SEQ ID NO: 93832 - DNA, 739 bp, Homo sapiens
  misc_feature: GYAE6OF01EMNKB.29.85.H08.1.454.CMB.1.raw
  modified_base (240)..(240): a, c, t, g, unknown or other
  misc_feature (240)..(240): n is a, c, g, or t
  modified_base (461)..(461): a, c, t, g, unknown or other
  misc_feature (461)..(461): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggactccgtgggctcagtctgccctgactcagcctcgctcagtcgtccgggtctccgtggacaggtcacgtcactactccttccgtgcctaacgtcggaaccncgcgacgcgtagtcggttcggttaggttaacttaaccgtttgttaccttccgtaggtaacccaaaccaacctaccgtacggaccgacccggacccccagtacctaatttaacgtttacgtggtaacttacgtacgtaacgtttaacggccggtccccgtacggtaaccggggttccgtacgacgttcgtccttacctcggtcgtactaccgttaagtccgnggtaccaaaccgtcgtccgtccccgtcgtaccgtacctcgtcgtccggttcggccctcgacggtcgtagtaccgtagtacggttaacggtagttaacgtttaccgttacgtctaccgttccgtctttaacggttaccgtcgtaaccggttccggaacccttccccgagttacttcggtaaccggttcgttacgggtaccccggggaaggacccggtaactacccgtcggtttacccggacccgtttcgacgtacgaaccgtcgtaacggtaccccggg

SEQ ID NO: 93833 - DNA, 590 bp, Homo sapiens
  misc_feature: GYAE6OF01CDJGR.29.85.H08.1.454.CMB.1.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
  modified_base (298)..(298): a, c, t, g, unknown or other
  misc_feature (298)..(298): n is a, c, g, or t
  modified_base (373)..(373): a, c, t, g, unknown or other
  misc_feature (373)..(373): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatccgtgggctcagtctcgccctgactcagcctcgctcagtcgtccggtctcgtggacngtcagtcacatctctgcacgtgaaccngcagcgatgtcgtgttactacttgtctctacgtaccaacacaccgaggcgacggccccgatctattaattacncgtatcgtactagttaacgcgtccgtgacgggtcctgactcgtctctcgtcgtctacgtagtctacgacctaacnctccgtcctcccgtacgacctactcgtcgtcggtcctcgtacgcgtagacgtacgtcggtacgtagtactttagtactgtctcgtcctgttacgtcgaccgtaccgccgtaacccgcgtaacgttcgtcgtaaccgtcgtaccgggtacggaacgggtaccgtacgtaccgttaccgaccgttacccgtacggtacgtacggtccgtacggtaccgg

SEQ ID NO: 93834 - DNA, 536 bp, Homo sapiens
  misc_feature: GYAE6OF01BSOT5.29.85.H08.1.454.CMB.1.raw
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (431)..(431): a, c, t, g, unknown or other
  misc_feature (431)..(431): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatcctcctgcacgtggaaccagcagcgatgtcggtgttatacttgtctctgtaccaacaacaccagcgacgccccgactcatattngatntcatagcgccctgacggtcctgatcgcttctctggctcaagtctcgacacactcgcctcccagtacccattcctcgtcgggtctccgaggtctagaccgagtcgacggttagatttacttactggtaccttgccttntagtttcgcacggccacccgtcacgttcgtagtacgtcgttcgggccggaaggacccaaggtccgtacggacccgttcgtacggtactacggtcgtacgtaccgg

SEQ ID NO: 93835 - DNA, 695 bp, Homo sapiens
  misc_feature: GYAE6OF01E3JG7.29.85.H08.1.454.CMB.1.raw
  modified_base (675)..(675): a, c, t, g, unknown or other
  misc_feature (675)..(675): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccggtctcctggacagtcagtcaccatcctcctgcacgtcggaaccagcagcgtagtggttcggtggttaattaacgttttcgttcctccgtaggtaacccaaacaaccacccgacgggccgaacccggcccccccgaactctaattaactttagtgtatcgtactaattaacggccggtccccgttcggtaccggggtccctaggtacttccgtcctttcctcgttcgcctaccgtaacggttcgtacggaccaaccgtacgtcccgtcccctaccctacgaaccctagttcccgtacggtcgggtccctcccggacggtccgttacggacgtacgtcgggtaaccggttgttaactttacgttaccgtcgtaccgtcgtccttacgtacgtttcgaccggtaccggccctacccgactacgttggtcgttaccgtccgggtcgggacgggaaccggaaccgtcggtccgtaccgtacccgtacgtacggtacncggtaccgtcggtaacccgg

SEQ ID NO: 93836 - DNA, 646 bp, Homo sapiens
  misc_feature: GYAE6OF01D4V9H.29.85.H08.1.454.CMB.1.raw
  modified_base (271)..(271): a, c, t, g, unknown or other
  misc_feature (271)..(271): n is a, c, g, or t
  modified_base (293)..(293): a, c, t, g, unknown or other
  misc_feature (293)..(293): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctgctcagtgtccggtctcctggacagtcagtcacatctcctgcactggaaccagcagcgatggtcgtgttataactttgctcctgtaacaacaacaccaggcnccggcccccgatcataattacngatgtcattaagcgcctcacgggtcctgactcgcttctcgtcgctcaagtctgacaacactgccctcctacgacctagttcctacgtcgggtacctcccgtaggaccgttaggaaccgtacgttaggtaccggttaaggttaactttaagtttaccttacggtcttacggtccttacgttagtttcggccgaacggtcccgaaccccggcctaacgttaccggtagttaccgttccgggttttaccggggaaccggggttaaaccggaaaccggtaaaccggaccgttaccgggttaaaccccgttcggttaaacgggtaccctaacggttccccgtaagggtaaaccccggg

SEQ ID NO: 93837 - DNA, 774 bp, Homo sapiens
  misc_feature: GYAE6OF01EDSZS.29.85.H08.1.454.CMB.1.raw
  modified_base (246)..(246): a, c, t, g, unknown or other
  misc_feature (246)..(246): n is a, c, g, or t
tcagatagagtactcacgaccggtgctcgatttagtatcactcagtcgcggggggggtctcaggaggcagcactctcgggacgtctccaccatggcctgggctctgctcctcctcacgcctcctcactcgagggcacgaggactccgtgggctcgagtctcgcctgactcacgcctcgctcgacgtcgtccggtctccgtcggactagtcacgtccacctactcctccgtgactacgtacgaaccngcgacgtcgagttggtcggttaggttaactacgtttcgtccttcgtaacgtaaccaaacaaccgtaccgacggaccgaccccgggaccccctatacgttaaactttaacgtttacgtagtacgttacgttaccgtaagttaaccggcccgtaccggtacgggtaccgggtccctagtacgttccgttacttccgtcgtcgtacctacgtaacgttcggacgtaaccaacttcgtccctacccttaccgtacgtaaccttcgtcccgtttcggtccggtaccttaccggtcggtaccgttaccggtaacgtcggttaacgggtaacgttacgtttaaccggtttaacttcgtcggttccgttacgtttctacgtttcgtacggacggtacccgtacccgtacgtaccgttcggtacttacgggtcccgttaccggggttacggaacccgggggtaacggtacccttacgggccccgttacggtaccccggtagggttacctacgggtacccttcgggaacgtccccggg

SEQ ID NO: 93838 - DNA, 695 bp, Homo sapiens
  misc_feature: GYAE6OF01CSQ6R.29.85.H08.1.454.CMB.1.raw
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (485)..(485): a, c, t, g, unknown or other
  misc_feature (485)..(485): n is a, c, g, or t
tcagatagagtactcacgaccggtgctcgatttagtatcactcagtcggcgggggggggtctcaggaggcagcactctcgggacgtctccaccatggcctgggctctgctcctcctcagcctcctcactcgagggcacaggactccgtgggctcagtctcgccctgactcacgcctcgctcaggtcggtcccggtctccgtggacngtcagtccactntcctctgcncgtacggaaccngcagcgattcggtcggttagttaattacgtttcgtccttccgtacgtaaccaacaaccgaccgaggccgaccccgggccccctacgtactaattaactttagtagtacgttgtactacgttaacgcccggtcctcggtacgggtcctagactcgtcttcgtcgtcgtctacgtacgtcgtacgacctaacgtcctaccgtccctaccgacgtaccctacgtccgttaccggtccggtcctacccgnggtacccgtagccgttagcggttaacgtacttactttacgttcgcgtaccgttgtccttacgttaggttaccgacccggtccggtacccctacgggtcttaacggtcgttaccggtccgttccgggtacgggaaccgggaccggtaaaccgcggttacccggtacggtacccgttcggtaacgccgtaacggtcccgtaccggtacccgg

SEQ ID NO: 93839 - DNA, 760 bp, Homo sapiens
  misc_feature: GYAE6OF01BWB3K.29.85.H08.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcgagggcacaggatccgtgggctcagtctcgccctgactcagcctcgctcaggttcggtccgggtctccgtggacngtcagtcaccatctcctgcacgtgaaccngcagcgagttcggtcggttggttattaacgtttcgtctcgtagtaaccaactaccaccgaggccggaccggcccccgtactacgtaacttaacttagacgtatcgtactagttacggtaccggcctacggacgggtccctgtacctcgtacttcgtacgtcgtactaccgtaagtcgtacgacctaaaccgtcgttcccgcccgttacccgtacgtacccttacgttccgttaccggtcgggtacccgtcccggtaggtccgtaacgggtaccgtacggttacgggtaccggttagttacgtttacgtttacgtgtaccgttcgacctttacgttaacgttcgggtaacccgacggtccccgtacccggtacgttacggtacggttcggtaacccggttacgggttaccggggaaccggggtaaccccgggtaaaccggtaaccgggttaccgggttaaccccgggtaacccgtttaccggtaaccggggtacccgtacggttaccccggtagggttaacccccggg

SEQ ID NO: 93840 - DNA, 970 bp, Homo sapiens
  misc_feature: GYAE6OF01AQ4SC.29.85.H08.1.454.CMB.1.raw
  modified_base (233)..(233): a, c, t, g, unknown or other
  misc_feature (233)..(233): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggttttccttgttgcttaattttaaaaggtgtccagtgtgaagtgcagcgtggtggagtcgtgggggagtcgtggtacngccgtgggggtccctgacgactctcctgtcgcgagtcctcgtaggtattcgtaaagttttaatcgttacttttttcccgattaccgtacgttcggggttacccgtacgaacggtccggtacccggggggtaagggttccgtagggtagggttcggggttaccctttacgttacgtttaaacgtttaaacgtccgggtaacgggtaccgggttagtaccgtttaacccgtttaaacgtacgttttacgtaacggttcggtaaccgtaacggtaaccctttaccggttagggtaaccggggtaaaccggggttaccccggttaaacttttaccccgaaaccccgttaacgttaccccgttaaccccggaaagggtaaacccggtaaaaccctaaaaacccgtaaaacccgttaaaaccggtttaaccccctttaacccccggttaaggtttaaccctttaacccgttaacggtaaaccttaaaacgttaaccgggtaaaacgttaaccggtttaacgtaaacgggtaaaacggttaaaccgggtaaccggtaaacccggtaaccggtacgggttacccgggtttaacccgttttaaccgtttaaacgtttttaaaggttacggttaacggaaaaacgttaaaaacgggaacgggtaaaacgggtaacgtaaacggggtaaccgtttaacgggttaaacggggttaccggggttccggttaacgggtttttaaacccggg

SEQ ID NO: 93841 - DNA, 627 bp, Homo sapiens
  misc_feature: GYAE6OF01E5S33.29.85.H08.1.454.CMB.1.raw
  modified_base (223)..(223): a, c, t, g, unknown or other
  misc_feature (223)..(223): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctctgcactggaaccngcagcgatgtcggtgtatactttgtctctgtaccaacaaccaccagcgacgcccccgatcataatttatgatgtcataagcgcctcgacgggtcctgatcgcttctcgcggctaccgaagtcgtacggacaacacgtcgtccctccctcgaacctactctcgtacgggcctccgtaggtctagaacgtagtacggtacggttagtacttaagttacctcgtacgttcgtcccttacttagtttacggaccgtaaccggcccaaccccggtacctaaccgttcggttcggtaaccgtttcccggttacgggggtacccgggaaggggaaccctaaacggccgttacccggtaaccccgtcccgggttaacgggttcccacgggtccgtaacccggtaaacccggg

SEQ ID NO: 93842 - DNA, 675 bp, Homo sapiens
  misc_feature: GYAE6OF01CBEU6.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgcttattttaaaaggtgtccagtgtgaagtgcagctggtggagtcgtgggggagtcgtggtacagtccgtggggggtccctgagactctcctgtgcagcctcgtggattctaagtttatgtatttttccatacacgtgggtcctcgaacgtcggtccgggggaagggtctgggacggttgggtcttcttcttattaatcgagtacggtgacctactactattctagtgacacgtactctggtaggaacgggccgtattccacctactccgtaccaagacgaaccaaacaaacgtaacgttaccctcccgtttagtacttaccgtacgtaactaaagttacgaaaccgtaggttaacctaggaacggttaacggacgaacggaacgtacggtccgggttctttacgttaagttttaagttcggtaacgtaacttaaaaggtgggtaaacggaaacgggacgtaagggttacgttaacggttacggggttaggggttcccgggtttacggg

SEQ ID NO: 93843 - DNA, 163 bp, Homo sapiens
  misc_feature: GYAE6OF01DVOK4.29.85.H08.1.454.CMB.1.raw
  modified_base (151)..(163): a, c, t, g, unknown or other
  misc_feature (151)..(163): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcggggctggcaaggcgcatagnnnnnnnnnnnnn

SEQ ID NO: 93844 - DNA, 893 bp, Homo sapiens
  misc_feature: GYAE6OF01CX5X5.29.85.H08.1.454.CMB.1.raw
  modified_base (181)..(181): a, c, t, g, unknown or other
  misc_feature (181)..(181): n is a, c, g, or t
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactgagggcacgaggatccgtgggctcagtcctgccctagactcacgcctcgctcngtcggtccggtctcgtggacagtcaagtccactatctcgtnacagtacggaaccganccgaaggcgtagtacgggttacggttacggtttaagttaacgtttcgttaccgttaccgttacggttaaccgtaaaccgaacccgtaaccggaccgggacccggaccccggtaccccccggtaacttacccgtaaattaaacttttacgtacgtaacgtacgttaaccgtaacgttaaccggcccgtacccgtacggtaccgggtcctagtacgtcgtcttctcgtcgtcctacgtactcgacggacaaccgtcgccgtcctaccctagtaccctacgttccgtccggtcgtacccgtaccggtaacggcccgttaaggtaccgtaacggttccgggtaaacggtttacgtttaaaccggttttactttacccggtacggttacccgtttacggtaccgtttaaccggttacgtttaaccgggacccgttaacccggaccccgttaaccccggttaaccgggtccgtttacggggtaaaccgtttcccgggttttacccgggggtaacggggaccccgggggtaaaaccgggtacccggtaacccggggttaaccccgggtttacccggaacccccggggttttaccccgggtaaacgggtttacccccgggaaccccggtttaacgggtaaaccccggtttaccccccgggggg

SEQ ID NO: 93845 - DNA, 656 bp, Homo sapiens
  misc_feature: GYAE6OF01B8ZSU.29.85.H08.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (296)..(296): a, c, t, g, unknown or other
  misc_feature (296)..(296): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcacatctcctgcacgtgaaccngcagcgatgtcgtgttataacttntctctacgtaccaacaaccaccagccgacggccccgatctaataattagntatgtactataacgccgtacctcgacggtccctgtactcgtcgtactcgtaggcctacgaacgttcgtaacgtcaaacgtaccgtcgcccgttaacctcgaacttacgtccttcggtacggcccttacccgaggaccgtaacggtacgtacgtaacggttacgggtaacttaagtttaaccgtttaacggtctccgttgtacccttaagttacgtttaccggtaccgtaacggtaccccgaccgtaccgtaaccgttcggttacggtaacgtttcccggtaccggggtaacggaacgggtaccgtacggtacgttacccggtacctacggttaccggactacgtaacccgtgtaacccgg

SEQ ID NO: 93846 - DNA, 589 bp, Homo sapiens
  misc_feature: GYAE6OF01BVB9G.29.85.H08.1.454.CMB.1.raw
  modified_base (224)..(224): a, c, t, g, unknown or other
  misc_feature (224)..(224): n is a, c, g, or t
  modified_base (357)..(357): a, c, t, g, unknown or other
  misc_feature (357)..(357): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcgtgttatactttgtctctgtaccaacaacaccaggcgacgcccccgatcattaattatgatgtcaattagcggcctcgacgggtccctgactcgcttctctcggctacaagtctggacaacnctcgccctcctagaccatctcgtcggcctccgaggtctcggacgtcgtacgtacggtagtatttacgttactcgtactcgtccttacgtacgttttcggaccgtacggtcccgtaacccgctaccgttcggtacgtacgttccgtttcgggacccgggtaacgggaaccctacggtccggttaccgaacccggttaccgttacggtaccgtacggtccgtacggtaaccggg

SEQ ID NO: 93847 - DNA, 715 bp, Homo sapiens
  misc_feature: GYAE6OF01B2QD7.29.85.H08.1.454.CMB.1.raw
  modified_base (237)..(237): a, c, t, g, unknown or other
  misc_feature (237)..(237): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcgagggcacaggatccgtgggctcagtctcgccctgactcagcctcgctcgagtcggtccggtctccgtggactagtcagtccaccatctcctgccacgtacggaaccngccaaggtcgagttcggtacggttaggtttaattaaccgtttcgtcctcgttacggtaacccaaacaacccgtacccgacgggaccgacccggaccccccgtaactaccgtaactttaacgtttatacgtacgttagtactaacgttaacggcccggtacccgtaccggtacggggttccctaggtacgtccgtacttccgtcgtcggtacctaccgtagtcgtacggacctaacgtctaccgtcccttacccgtacgtaaccctacgttcccgtaccggtccgggtaccctacccggaaggtccgtaacggtacgtacgtacgggttacgttagtaacgtttacgttacgtcggtacttcgtaccttagttacggttcgaccgaccgcccgtaccgcttacgtggtacgttcgtcgtcgggacgacggtacctacggtccgtacgaccgttcgtacgacaccgtcgtccggtaccgg

SEQ ID NO: 93848 - DNA, 754 bp, Homo sapiens
  misc_feature: GYAE6OF01CJVRI.29.85.H08.1.454.CMB.1.raw
  modified_base (118)..(118): a, c, t, g, unknown or other
  misc_feature (118)..(118): n is a, c, g, or t
  modified_base (185)..(185): a, c, t, g, unknown or other
  misc_feature (185)..(185): n is a, c, g, or t
  modified_base (739)..(739): a, c, t, g, unknown or other
  misc_feature (739)..(739): n is a, c, g, or t
  modified_base (747)..(747): a, c, t, g, unknown or other
  misc_feature (747)..(747): n is a, c, g, or t
  modified_base (751)..(751): a, c, t, g, unknown or other
  misc_feature (751)..(751): n is a, c, g, or t
  modified_base (753)..(754): a, c, t, g, unknown or other
  misc_feature (753)..(754): n is a, c, g, or t
tcagatagagtactcacgaccggtgctcgatttagtatcactcagtctgccctgactcagcctcgctcagtgtccgggtctcctggacagtcagtcaccatctcctgcactggaaccngcagcgatgtcggtggttataacttgtctctgtacaacacaccaggcgacgccccatctattaattntgatgtacattaacgccgtcctcgacggggtccctgactcgtccttctcgtaggtcctaccgtagttccgtcggtaccaaaccgacttcggccccttaccctacgtaaccctacttccgttccgttcggggtcccctccggtaacgggccgttacggaacgtacgttacgggtaaccggttagtaacttttaacgttaccgtcggttaccgttcgtaccgttccgttaaggttttcgaccggtacggacccctacccgtacgttaaccggttcgttaggttaacccgtttccgggtttaacgggggacccgggtaagggtaaccccgtaaacggtcccgtaaccggttccccggtttaaccgtacgggtaccgaccggtaccgtacgggtaaccgtcccggttaccccggtccccgttccggttacccctaccgttacccgtttacccggttacccccctacccttcccgtaccgttaaccgttaccttacgtacgttcgtacgggacggtccggtacgtgggaccgacggtccgagtaccaggcctgagctcngtgcacanagcngnn

SEQ ID NO: 93849 - DNA, 711 bp, Homo sapiens
  misc_feature: GYAE6OF01EIXDP.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggttttccttgttgctattttaaaaggtgtccagtgtgaagtgcagcgtggtggagtcgtgggggagtcgtggtacagccgtgggggtccctgatactctcctgtgcagcctctggtattctaagtttaatgttactttttccattaccacgttcggggtccgtacgaacggtccggtaccggggggaagggttcgtaggggtacggttgggttcctcgttactttaagtttaacgtcggacggtacggtgtacctaactactattctagtgcagtactcgtggtaggaacggtccgtattccacctactcctaccgaagtaacgaaaccaaactaaacgtaacgttacccttacccgttagtacttcgtacgtaactaaagtacgaaactagttaccgtaggtaacggtaacggtacggaaaccgtaccggacgggtccggttacctttacgttagtttaagttaggtaacggtaaagtaaaaacggagggaaacggtacgaaagggtacttaacgggttaaaggggttcggggttacgttccgggtttaaccggg

SEQ ID NO: 93850 - DNA, 797 bp, Homo sapiens
  misc_feature: GYAE6OF01CIR88.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccagtggagtttggactgagcgttgggttttccttgttgtcttattttaaaaggtgtccagtgtagaagtgcagcgtgggtggaggtcgtgggggtagtcggtggtacgacgccggttcggggggtcccgtaggacgtaccttcctccgtgtcggcacgtcccttcgtggtattacgtaaagttttaatgttactttttaccattaccgtacgtcgggtccgtacgaacggtccgtaccgggggaggtcgtagggaggttcggtctcttacttattagtcggtagacgtgtccttaactactacgttactagtcgtactacgtactcgttaggtacgggaacgggtccctacgttacccgtaacctacttcccgtaaccgaagtaaccaaacccgaaaccgtaaaccctaacgttaacccgttaccccgttagttaacctcgtaacggtaactaaaggttaaccgtaaacgtacggtacgtaacggaaacggtaacgggttaccggtaaccggtaacggtacggtcccggtttaacctttactttacgtttaacggtttaggtaaacgtaaaccgggaaaaaaggtacgggaaacgggtacttaaacggggaactttacgggttaaacggggttccgggttaaccggtttcgggtttaaacccggg

SEQ ID NO: 93851 - DNA, 640 bp, Homo sapiens
  misc_feature: GYAE6OF01EFCIP.29.85.H08.1.454.CMB.1.raw
  modified_base (189)..(189): a, c, t, g, unknown or other
  misc_feature (189)..(189): n is a, c, g, or t
  modified_base (317)..(317): a, c, t, g, unknown or other
  misc_feature (317)..(317): n is a, c, g, or t
  modified_base (491)..(491): a, c, t, g, unknown or other
  misc_feature (491)..(491): n is a, c, g, or t
  modified_base (502)..(502): a, c, t, g, unknown or other
  misc_feature (502)..(502): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctccnggacagtcagtcaccatcctcctgcactcggaaccagcagcgatggtcggttggttaactactttgtcctccgtcggtaccaaacaaccacccgaggccgaccggccccccgatcctaattaatttangtattgtacaagtttaacgccggtccctacgtcggggtcccctaggtactccggtctttcctacgttcggtcctacccgtaaacgttccgtacgggacctaaaccgtaccgtccggtaccccttcccgtacgtaccctactccgtccgtcgggtcctccgaggtctcgaacgtntaggtacggtntatttactacgtctcgtgtctacttagttcgacgtacggtaccaccgtactacgttgtacgtacgtccgtacggggacggacgggaccctaacggtccgtaccggtacccgtccgtacggcctacgtcgtcgtaccgg

SEQ ID NO: 93852 - DNA, 693 bp, Homo sapiens
  misc_feature: GYAE6OF01C6U1D.29.85.H08.1.454.CMB.1.raw
  modified_base (155)..(155): a, c, t, g, unknown or other
  misc_feature (155)..(155): n is a, c, g, or t
  modified_base (185)..(185): a, c, t, g, unknown or other
  misc_feature (185)..(185): n is a, c, g, or t
  modified_base (248)..(248): a, c, t, g, unknown or other
  misc_feature (248)..(248): n is a, c, g, or t
  modified_base (496)..(496): a, c, t, g, unknown or other
  misc_feature (496)..(496): n is a, c, g, or t
  modified_base (513)..(513): a, c, t, g, unknown or other
  misc_feature (513)..(513): n is a, c, g, or t
  modified_base (536)..(536): a, c, t, g, unknown or other
  misc_feature (536)..(536): n is a, c, g, or t
  modified_base (549)..(549): a, c, t, g, unknown or other
  misc_feature (549)..(549): n is a, c, g, or t
tcagatagagtactcacgaccggtgctcgatttagtatcactcagtcggcgggggggggtctcaggaggcagcactctcgggacgtctccaccatggcctgggctctgcctcctcctcagcctcctcactcgagggcacgaggctccgtgggctnagtctcgccctagactcacgcctcgctacnggtcggtccgggtctaccgaggactagtcactaccacactccttccagactacgacggaaccngtacagcgtatcggtaggttagttacttacgttgtactcgtaacgaaccaaacgaaccgaccgacggaccgaccccggtaccccaatacctaaaacttatttacgagtacttacgtacgtaacgtacggtaccgccgtaggtaaccgggttccaagtcctccgtcttcgtagtccgtactaccgtaagcgtacgaactaacgctcgcccttactacgacctactcgaccgttacggccctaggtacgngtacgtaacgtacggtntaacgggtataatttaccggtanacgcgtagttccngtttacgacacggaacgtcccacctacgttcgtactacgggttacaccgggttagggaaccgggtacgaacccggtaggttacccgaccgggttaacccgttacgggtaaaccttcggaacccgtacggcccggttaaacccgg

SEQ ID NO: 93853 - DNA, 712 bp, Homo sapiens
  misc_feature: GYAE6OF01BPU4H.29.85.H08.1.454.CMB.1.raw
  modified_base (639)..(639): a, c, t, g, unknown or other
  misc_feature (639)..(639): n is a, c, g, or t
  modified_base (648)..(648): a, c, t, g, unknown or other
  misc_feature (648)..(648): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggttttccttgttgctattttaaaggtgtccagtgtgaagtgcagctggtggagtcgtgggggagtcgtggtacagccgtgggggtccctgagactctcctgtgcacgcctcgtggtacttactaagtttaatgtactttttccattactacgttcgggtaccgtacgaacggtccgtacccgggggtaagggttcgtagggtaggttcgggttcttcgttactttaagttaaactcggaacggtacgggtgtaccttaactaactagtttactagtcgactaacgaccttcgtacggtaggaaaccggtaccgtaactttaccaacccgtacttacctaccgaacggaacgtaaaccaaacaaacgtaaccgttacctacccgttagtactcgtagaactaaagtacgaacgtagttcgtagaagtaacgtacgaacggacgacggtccgtacgtttacttaacgtttagttacgacggtaaanaaaacgggnggtaaacggacggtaaacggtaacgttaacgttaagggttcggggttccgttacggtttaacgg

SEQ ID NO: 93854 - DNA, 513 bp, Homo sapiens
  misc_feature: GYAE6OF01CAUGR.29.85.H08.1.454.CMB.1.raw
  modified_base (301)..(301): a, c, t, g, unknown or other
  misc_feature (301)..(301): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
  modified_base (491)..(491): a, c, t, g, unknown or other
  misc_feature (491)..(491): n is a, c, g, or t
  modified_base (499)..(499): a, c, t, g, unknown or other
  misc_feature (499)..(499): n is a, c, g, or t
  modified_base (502)..(513): a, c, t, g, unknown or other
  misc_feature (502)..(513): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagccggccctcaggggtccctgatcgcttctctggctccagtctggcaacactgccctcctgaccatctctgggctccaggcctgacgatgatggtnattattactgctgctcatttgcaggccacccgnactgtnatcgttcggcggaggaccagctacgaccgtccgtaggtcagctcgaacggctccgcccccgtcggtcctacctccttccgttcccctccccttcctacgtacgtaccttctacgtcctggacggcgggtccgtgggaccgaacggccgtanagttacgntgnnnnnnnnnnnn

SEQ ID NO: 93855 - DNA, 836 bp, Homo sapiens
  misc_feature: GYAE6OF01B7DZD.29.85.H08.1.454.CMB.1.raw
  modified_base (175)..(175): a, c, t, g, unknown or other
  misc_feature (175)..(175): n is a, c, g, or t
tcagatagagtactcacgaccggtgctcgatttagtatcactcagtcgcggggggggtctcaggaggcagcactctcgggacgtctccaccatggcctgggctctcgctcctcctcacgccctcctcactcgaagggaacgaggactccgtggctcagtctcgaccgtcgactcncgcctcgctcgtacggtcggtccggttcctccgtacggactacgtcacgtaccacctacttccgtcgttcgacctaacggttaccggaaccgacggaccgaacggtccggtacggttacggggttacgggtttacgttaaaccgttttaacgttttccgttacctttaccggtaaccggtaaaacccaaaccgaacccgtaaccgggaaccggggaccccggtaaccccggtacccccgtaagttaaccgttaacttttaaacgtttacgcgttaaacgttcggtttaacgtaacggtttaccgcccgggttccgtaacgggtccggttcgtaaccgtcggttacctccgtttcgtaccgttacgtaccgtacgtacgtccgtaacgaccttaccgtaccgtcccgtaccctaccgtacgaccgttacgtcggtacgtccggtaccgcgttacgccgtagacgtggtaccgtaggtagttactcgttacgtcgttcgtacgtcgttacgtacgtaccggtacgtcccggaccgtacgtccgtagttccggttacgtaccgggtaccgggtaccggtaacgggtaccgtacgggtaccgtcccggttaccgtaaccggtacgtttcgaccggttaccgttacccggacgtccggtaccccgg

SEQ ID NO: 93856 - DNA, 732 bp, Homo sapiens
  misc_feature: GYAE6OF01BQPMC.29.85.H08.1.454.CMB.1.raw
  modified_base (205)..(205): a, c, t, g, unknown or other
  misc_feature (205)..(205): n is a, c, g, or t
  modified_base (715)..(715): a, c, t, g, unknown or other
  misc_feature (715)..(715): n is a, c, g, or t
tcagatagagtactcacgaccggtgctcgatttagtatcactcagtcggcggggggggtctcaggaggcagcactctcgggactctccaccatggcctgggctctgctcctcctcagccctcctcactcgagggcacgaggtactccgtgggctcagtctcgccctgactcacgcctcgctcagtcggtccggtctccgtggacngtcagtcactatctcgtgcacgtcggaaccagcgtagacgtattcggtcggttagttacttaactttcgtcctcgtaacggtaaccaaacgaaccgtaccgaggtaccggaccggcccccgtatactaagtttaacttcgtagtacgttacgtactaagttacggcccggtaccgtacggtaccgggtacctagtactccgtacttcgtcgtcggtacctacgtaacgttcgtacgtacaacctaccgtacgtccctaccgtacgtaaccgtacttccggtaccgttcggtcccgttacgacggtaccttaggaacgtaacgtagggtaaccgtttagtaacgttttacgcgttacggtacttcggtaccttcttaaggttccgaacccggtacgaccccgtaccggtaccttacgtccgggtactttacggtacccgggttacggggaaccggaacggtaaacccggtcgccgttaaccggtacccggttacgtaccggtacgttaccnccgggttacggaaccgg

SEQ ID NO: 93857 - DNA, 719 bp, Homo sapiens
  misc_feature: GYAE6OF01DB7IS.29.85.H08.1.454.CMB.1.raw
tcagatagagtactcacgaccggtgctcgatttagtatcactcagtcgcggggagctctgggagaggagccccagccctgagattcccaggtgttccattcggtgatcagcactgaacacagagaacgcaccagtggtagtttggactgagtcgttgggttttcctgttgacttaagttttaaaaggtgtccgagtgtagaagtgcagtcgtgggtggtagtcggtagggggtagtcggttaggtacgacggtccgggtcggggggtaccctggacgtacctcctccgtgtcgcacgtcctagtggtattactaaagtttatagtttacttttacatactacgtcgggtacctagacggtccggtaccggggtaacggtcggtggtacggttcggtccttcgttacttaagttaacgccggtaaggtccggttagtaccgtaacgttactaagtttacgagtacgtaccgtagtacgttcgtaggtacgggaacgtaccgtattacccactacgttcctaacgaactacgaaacctaacgtaacctaacgtccttacccgtagtacgtctacgaacgtaaagtactacgttcacggtagaagtaacgcgaaacgtctaacgggtccttatttaccgtaaatttacggagttaacggaaagaaaggtacgacggtatagggtaacgttacgtaaggggtcccggtaggttcggtaaccgg

SEQ ID NO: 93858 - DNA, 621 bp, Homo sapiens
  misc_feature: GYAE6OF01CM91M.29.85.H08.1.454.CMB.1.raw
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
tcagatagagtactcacgaccggtgctcgatttagtatcactcagtcggcgggggggggtctcaggaggcagcactctcgggacgtctccaccatggcctgggctctgctcctcctcagcctcctcactcagggcacaggactccgtgggctcagtctgccctgactcacgcctcgctcaggtcggtccgggtctccgtggacagtcagtcaccatctcngcactggaaccngcagcgagtggtcggtggttactaacttgtctcgtacgtaccaacaacaccgacggcgaccggcccccgtatacctaagttacttatagtactgtactattaacgccggacctcggtacgggtcctgtactcgtcttcgtctcggctacgagtcgacgacaacncgtcgcctcccncgtacctatccgtcgtcggccttacgacggtcacgacgtacgtacggtaggtactaatttacgtactggtacttcgacttcgtagttcgaccgtacggacctacccgtataccggttaggtaccggtacgttccggggttacgggaccggggaaacggtaaccgacggtaccgtcccgttaccgtacggacgttacgcgaccgtggtaacccg

SEQ ID NO: 93859 - DNA, 834 bp, Homo sapiens
  misc_feature: GYAE6OF01CVYR3.29.85.H08.1.454.CMB.1.raw
  modified_base (689)..(689): a, c, t, g, unknown or other
  misc_feature (689)..(689): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccagtggagttggactgagtcgttcgggttttccttggttcgtactttaagtttttaaaaggtcgtaccgaggttgtaggaagtgcgagtcgtgggtggtaggtcgggtagggggacgtcgggttacggtacgacgggtccgggttcggggggtccctaggacgtaccttccgtccgtggtcgccgacgtccgtcgtaggttactttaacgttaaagtttacgttacggtttaacctttttaccgaaacgttaccggttaaccggtttcccggggttaacccggttaccggtaaaaccgggttacccggggttaccgggggtaaaccgggttcggttaggggttacgggtccgggtttaccttacgtttaacctttaaggttaacgtcggaacggtacggttcgacttaacacgttattacgtagtcgactaacgtcgtcgtacggaggtaacccgggtcttaacgttacccaacgttaccgtaccgaaccgtaagaaacccgaaaacaaccgtaaaccgttacgtacccgtttcgtaattacgtacacaaacgtaanaccgtagtacgtaaggacgtagaacgtacgacgtacgaggtcctagttacgttaagttaggtacggtaaagtaaacggaaggtaacgggaacgtaggtaacgtacgttaagggttacgggttcgtaccgggttagttacccgggg

SEQ ID NO: 93860 - DNA, 696 bp, Homo sapiens
  misc_feature: GYAE6OF01BDQHT.29.85.H08.1.454.CMB.1.raw
  modified_base (221)..(221): a, c, t, g, unknown or other
  misc_feature (221)..(221): n is a, c, g, or t
  modified_base (508)..(508): a, c, t, g, unknown or other
  misc_feature (508)..(508): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggactccgtgggctcagtcctcgccctgacctcacgcctcgctcgagtcggtccgggtctccgtggactagtcacgtccacctntcctcctgacacgtacggaaccagacaggccgtagtggtcggttagttacttacttgtctcgtacgtaaccaacaccaccgacggaccgaccgccccgatactaattattagtatatgtactagtacgccgtccgtacgtacggtccctagtcgtcgtcttcgtccgtcgactaccgtacgtcgtcggaacctactaccgtccgtccctaccgtacacctcttaccgtcgtcggtcctacggcgtctacggacgtacgtcggtacgttcgttaattacgtcgttacnccgttgaccttgttaccgtggaccgccgtacccgacccgtacttaccggtacggtaccgttacggttaaccggtcgggaaaccgggggtacccgtaaacgggtacccgttaacggttaccccgggttaacccggttaacccgggttaccggaaacggttcccgtacccgggttaacggtacccccggg

SEQ ID NO: 93861 - DNA, 566 bp, Homo sapiens
  misc_feature: GYAE6OF01BVHL4.29.85.H08.1.454.CMB.1.raw
  modified_base (235)..(235): a, c, t, g, unknown or other
  misc_feature (235)..(235): n is a, c, g, or t
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (296)..(298): a, c, t, g, unknown or other
  misc_feature (296)..(298): n is a, c, g, or t
  modified_base (300)..(300): a, c, t, g, unknown or other
  misc_feature (300)..(300): n is a, c, g, or t
  modified_base (553)..(553): a, c, t, g, unknown or other
  misc_feature (553)..(553): n is a, c, g, or t
tcagatagagtactcacgaccggtgctcgatttagtatcactcagtcgcggggggggtctcaggaggcagcactcgtcgggacgtcgtccaccatggcctgggctctgctcctcctcagcctcctcactcgagggcacaggatcctgggctcagtctcgccctgactcagtcctcgctcaggttgttcggtctcgtggacagtcacgtcaccatcgtcctgcctacgtggaaccngcagcgatgtcggtgttatacgttgtctctgtaccacacnccagcgacgcccancatattnnntntctatacgccgcctcgacgggtcctgactcgtcttctcgtcggctcgacgtcgtgaccaacgctcgtcctcctacgactcttccgtcgtcgggtacctcgtagcctggacgtcgtggtaccgtgtacttacttcgtagtctgtcttacttacgttcgacgtacgaccacccgtcacgttcgtaagttccgtcgggttaccgcggtagacggtacccaacggttccgtaccggtaccgttaccggtacgtaccncgtcgtaacccgg

SEQ ID NO: 93862 - DNA, 659 bp, Homo sapiens
  misc_feature: GYAE6OF01BX9VE.29.85.H08.1.454.CMB.1.raw
  modified_base (224)..(224): a, c, t, g, unknown or other
  misc_feature (224)..(224): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatccgtggctcagtctgccctgactcagcctgctcagtgtccggtctccgtggacagtcagtccaccgtctcctgcagtcgaaccngcgagtgtacgttggctacttactacgtgtctccgtcgtacagcaccgccccgagccacaccgaccccaatcatcgtagttttcgactcacgtactccgcctcgacggtcctgactcgtctcgtcgtcggtcctagtcgtgacacgccacggtccctcgtagtacttacgtcgtcgtcggtcctacgtacgtacgtacggacggaccggagtcttaagtaatttacttagtacgcgtaacgtctactaagttaacgtaaaccgaacgggtaacctaaacgttacttaacgttcggtaaccggtttaaccggaaccgttaaccgggaaaccgtaaccggttacccgtaaacccggtttacccgtaaaccgggttaccaacccggtaaccccggtaaaccccgaacccccgtaaacccctccgtaccgttaaccccg

SEQ ID NO: 93863 - DNA, 682 bp, Homo sapiens
  misc_feature: GYAE6OF01BZUYJ.29.85.H08.1.454.CMB.1.raw
  modified_base (201)..(201): a, c, t, g, unknown or other
  misc_feature (201)..(201): n is a, c, g, or t
  modified_base (669)..(669): a, c, t, g, unknown or other
  misc_feature (669)..(669): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggactccgtgggctcagtctcgccctgactcgacgcctcgctcgagtcgtccggtctcgtggacncgtcagtccaccgtattcctcctcgactacgtacggaaccagcgacgacgtagtcggtacggttaggttaacttacgtttcgtaccttaccgttacgtaaccaaacgtaaccaccgacggccgacccggacccccgactaccgtaattaacgtttactgactgtactaagttacgccggacctacggacgggtcctagactcgtcttcgtccgtgtctaccgtagtccgcgaccaactcgtcgtacccttccgacgtacctacgttccgtacgtccggtacctccggacggtacgtacggaaccggttacgtacgggtacggttaacgttaaccttttacggtttacgaccggtactcgttaccgtttaaccgttggttaccgacgtacccggtaccaccggtactacgtcggttactacgttcggtacggaccggttaggaccgtagccgttcggacctcgtagacncgactcggtaccg

SEQ ID NO: 93864 - DNA, 613 bp, Homo sapiens
  misc_feature: GYAE6OF01AOY74.29.85.H08.1.454.CMB.1.raw
  modified_base (261)..(261): a, c, t, g, unknown or other
  misc_feature (261)..(261): n is a, c, g, or t
  modified_base (576)..(576): a, c, t, g, unknown or other
  misc_feature (576)..(576): n is a, c, g, or t
  modified_base (594)..(594): a, c, t, g, unknown or other
  misc_feature (594)..(594): n is a, c, g, or t
  modified_base (603)..(603): a, c, t, g, unknown or other
  misc_feature (603)..(603): n is a, c, g, or t
  modified_base (606)..(610): a, c, t, g, unknown or other
  misc_feature (606)..(610): n is a, c, g, or t
  modified_base (612)..(613): a, c, t, g, unknown or other
  misc_feature (612)..(613): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggccgacggccccccgactcattaattatgatgtcattaacggccgccctgacgggtccctgatcgtcttctctggcctcagtctggccaacnctcgccctccgtgaccatctcgtcgggctccgaggctcgacgtagtcggtacggtgtaactttagttactcggtcgtacgtacctcgtaagtttcgaccgtaacggccctaacccggactacgttgtacgttcgtcggttaccgggacgggtaacggaaccgtaagtcgttccggaccgttccggtacggtcgtacgtcgtaacggacccgtcgtcccggtacccgtcgtacccgtactccgttacccgtcccctccgttaccgagttacccgtctttacctgtccgtaggtacggccgggtcgacgtaaccggngtccgatacggctgtcgntagcgtacnagnnnnngnn

SEQ ID NO: 93865 - DNA, 777 bp, Homo sapiens
  misc_feature: GYAE6OF01CRYPK.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagtcttgggttttccttgttgtacttaattttaaaaggtgtccagtgtagaagtgcagcgtggtggagtcggtgggggagtcggtggtacgaggtcccggtggggggtacccctggacgtactcctccgtgtcgcgacgtcccttcgtaggtatttacgttaaagttttaacttgttactttttaccaatacctacggttcgggtccgtacaacggccggtaccgggggaagggtcgtggggtaggtacgggttccttacttactttaagttaacgtcgaaggtaccggtgtaaccgttactaacgtactttcgtatgacctagtactcgtaggtcgggaaccggtacgtacttaccaaccctcgtaccctaccgaaagtaccaaacccgtaaacaaaaccgtaccgtaacccttcccgttaagttaccgtacccgtagaaacccttaaagtaacgtaacgtaacgtacgttaaggaaacgtaggtaccggaaccgtaaccgtaggtccccgtttatttaaccgttaagtttgttacgggtaaacggtaaacgaaaaacggtaagggaaacgttccggaaggttaactttaacggggtagggttccgggttacggtttcggttaaacgg

SEQ ID NO: 93866 - DNA, 597 bp, Homo sapiens
  misc_feature: GYAE6OF01DW44Y.29.85.H08.1.454.CMB.1.raw
  modified_base (165)..(165): a, c, t, g, unknown or other
  misc_feature (165)..(165): n is a, c, g, or t
  modified_base (223)..(223): a, c, t, g, unknown or other
  misc_feature (223)..(223): n is a, c, g, or t
  modified_base (298)..(298): a, c, t, g, unknown or other
  misc_feature (298)..(298): n is a, c, g, or t
  modified_base (580)..(580): a, c, t, g, unknown or other
  misc_feature (580)..(580): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatccgtgggctcagtctgccctgactnagcctcgctcagtcgtccggtctccgtgacagtcagtcacatctctgcactggaaccngcagcgatgtcggtgttactacgttgctcgtcgtaccaacaccaccgagccgaccgccccgatacaattacttangtattgtactattacgccgtacctggaccgggtcctgactcgtcttacgtcgtcgtccgtacctaagttccgtacggacctaccgtacctccgtccctccgtacgacctacgttccgtcgtcggtcctcgacggtctgaaccgtgtacggtacggttatacttacgttcgtgtcgtcgtcttacgtcgttcgacgtaccgcctacccgtcgtacgtcggtatccgttccggtaccgggacggaacggtacgtacgtcggtaccgtacccgtactacggtacnccgtacgtcgtacccgg

SEQ ID NO: 93867 - DNA, 762 bp, Homo sapiens
  misc_feature: GYAE6OF01C22YO.29.85.H08.1.454.CMB.1.raw
  modified_base (217)..(217): a, c, t, g, unknown or other
  misc_feature (217)..(217): n is a, c, g, or t
  modified_base (342)..(342): a, c, t, g, unknown or other
  misc_feature (342)..(342): n is a, c, g, or t
  modified_base (402)..(402): a, c, t, g, unknown or other
  misc_feature (402)..(402): n is a, c, g, or t
  modified_base (754)..(754): a, c, t, g, unknown or other
  misc_feature (754)..(754): n is a, c, g, or t
  modified_base (758)..(758): a, c, t, g, unknown or other
  misc_feature (758)..(758): n is a, c, g, or t
tcagatagagtactcacgaccggtgctcgatttagtatcactcagtctgccctgactcagcctcgctcagtgtccggtctcctggacagtcagtcaccatctcctgcactggaaccagcagcgatggtcggttagttactaactttgtcctccgtaggtaaccaaacaaccacccgagggccgaaccggtcccccccgaatacctaattaactttancggtaacttcgtactaacgttaacgcccggtaccctacggaccggggttccctaggacttccgtcttcgtcgtacggtcctaccgtaaggttcctaggaccaaccgtcttccggaccctccgtanacctagtctcgcggtcctaccggaggcctaggacgtgtaccggtagtattattcgtacgngactcgtactatgttacgcgaccgtccgacctacgtacgtgtacggtcgttccggtacggggaccggtaccgaacgtcggtaccgtaccgggttaccgtaccggtaacgttccgaaccgtaccgttaaccgggtccggttacccgtcccccgggtacccgttacggttaacccgtcccgtttaccccggttacccctacccccgttacccccgttacgtaaccgttaccgttacccttaacctccgggttaccggaacggggttccggaacccggttcggaacccggacggttaacccgggccttaggaaaccttcggaagttacggtagacgtcgacgtcgacgtacacanctgngtag

SEQ ID NO: 93868 - DNA, 741 bp, Homo sapiens
  misc_feature: GYAE6OF01DQO79.29.85.H08.1.454.CMB.1.raw
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (223)..(223): a, c, t, g, unknown or other
  misc_feature (223)..(223): n is a, c, g, or t
  modified_base (290)..(291): a, c, t, g, unknown or other
  misc_feature (290)..(291): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcgagtctgccctgactcagcctcgctcagtcgtccgggtctccnggacngtcagtcacatctctgcactggaaccngcagcgatggtcgtggtatacttgtctcctgtaccacaacaccaggcgacgccccgatcattattannatgtcattaacgcggtccctacggtacgggtccctgtacgtccgtcgtttaccgtcgtacggaccgttaccgtaaacggtcgttcggggaccctaaacgtaccgtacgtccccgtttaccccgtagtaacccctaagtttcccgttaccggtacgggtaccccgttcccgaacgggttcttaacgggaaccgttacggtacgggtaacggttacgtaagttttaaccttacgtacggttaccttacggtacctttacgttacgttttacggaccgtaaccgggtccctaaacccccgggtcctaacggttacgtaccggtacgttacccgggttaccggggtacgggtaacccggggtaaaccctaacggggtaccctttaacccggggaccccgtttacccggtacggggtttaacccgacgggtaacccgtcccggttaaaccggggg

SEQ ID NO: 93869 - DNA, 494 bp, Homo sapiens
  misc_feature: GYAE6OF01DROK3.29.85.H08.1.454.CMB.1.raw
  modified_base (176)..(176): a, c, t, g, unknown or other
  misc_feature (176)..(176): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
  modified_base (425)..(426): a, c, t, g, unknown or other
  misc_feature (425)..(426): n is a, c, g, or t
  modified_base (429)..(494): a, c, t, g, unknown or other
  misc_feature (429)..(494): n is a, c, g, or t
tcagatagagtactcacgaccggtgctcgatttagtatcactcagtcggcgggtccctgatcgcttctctggctccaagtctggcaacactgcctccctgaccatctctgggctccgaggctgacgatggacggtgtattttattaccgtgctgcctactatttcgcgaacggccnccccggactactggtctcgttccgttccggggacggaccgggggaccaaagggtccgtaccggtacccgtacgtaggttaccgaacgccgttacgaacggtcccacccggtccccccgttcggtccctccgttccgttcccggttccccctacccttccctacgtaccgtaaccttccgttaacttcccggtggtaacgggcgggtcgttaggaccggtaacgggccggactaacgtgcngtcgcangnnatnnnnnnnnnnnnnnnnnnnnnnnnnnnnnnnnnnnnnnnnnnnnnnnnnnnnnnnnnnnnnnnnnn

SEQ ID NO: 93870 - DNA, 452 bp, Homo sapiens
  misc_feature: GYAE6OF01EDQO2.29.85.H08.1.454.CMB.1.raw
  modified_base (234)..(234): a, c, t, g, unknown or other
  misc_feature (234)..(234): n is a, c, g, or t
  modified_base (313)..(313): a, c, t, g, unknown or other
  misc_feature (313)..(313): n is a, c, g, or t
  modified_base (389)..(389): a, c, t, g, unknown or other
  misc_feature (389)..(389): n is a, c, g, or t
  modified_base (399)..(399): a, c, t, g, unknown or other
  misc_feature (399)..(399): n is a, c, g, or t
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
  modified_base (423)..(423): a, c, t, g, unknown or other
  misc_feature (423)..(423): n is a, c, g, or t
  modified_base (434)..(434): a, c, t, g, unknown or other
  misc_feature (434)..(434): n is a, c, g, or t
  modified_base (440)..(452): a, c, t, g, unknown or other
  misc_feature (440)..(452): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggcctcaggggtccctgatcgctttcnctggctccaagtctggcaacactgcctccctgaccatctctgggctcagctgacgatgacggtgattatactgctgctnattgcaggccacccgcactgtgatcttcggcggagggaccaagctgacctcaggtcagctcaagctcgccctcgcntctcgtcccncctctcagtctntanctgagcgcnggacaggccanactagnnnnnnnnnnnnn

SEQ ID NO: 93871 - DNA, 914 bp, Homo sapiens
  misc_feature: GYAE6OF01DJO1N.29.85.H08.1.454.CMB.1.raw
tcagatagagtactcacgaccggtgctcgatttagtatcactcagtcggcgggagctctgggagaggagccccagccctgagacttcccaggtgttccattcggtgatcagcactgaacacacgagaacgcaccagtggtagtttggactgagtcgttcgggtttttcccttgtttcgtacctttaagtttttaaaaaggttcgttacccgtaggttggtaaggtaaaggttcgaccgtaggtccgttgggttacgggtaggttccgggttagggggtacgttcgggttacgggttaccgtacggtccggttccggggggtaccctaggacgtaccgttccgtccgtcgtcgcacgtccgttcgtaggtactttaccgtaagttttacgtcgtttacttttaccattaccgtcggttccgggttaccgtaccgtaacggtcccggtaccgggggtaagggttccggtagggtacggttcggttaccttacgtttacgtttaaagttaacgtacggtaacggtacggttacgtaccgttaacgttacgtacgtttactagttcgacgtaacgtccgttacgtacggtacggtacggtccgttaacgttaccccaacgttactcccgtaacgaacggtaacaaaaccgtaactaaaccgttaaccgttaccttccgttaggttaacctcgtaacgaaccgtaaagttaccgtaaacgtcggttagtaaaccggtaggtaaaccggtccggaaacgtaccgtcggttaaccgttttacctttaaaggttaaacgttttaggttaacccggtaaagggaaaaaccgtaaaggggtaaacgtacccgggtagttaaaaggttcccgttttaacggggtacggtttacccggggtttccgttaaccgggtttaaaccggg

SEQ ID NO: 93872 - DNA, 801 bp, Homo sapiens
  misc_feature: GYAE6OF01EBZ2P.29.85.H08.1.454.CMB.1.raw
  modified_base (684)..(684): a, c, t, g, unknown or other
  misc_feature (684)..(684): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagtcgttgggttttccttgttgcttaatttttaaaaggtgtccgagtgtagaagtgcagcgtgggtggtaggtcggtgggggagttcggtaggtacacggccggttcgggggtccctggacgtaccttccgttccgtggtcgccgtacgccgttcgtacggtatttacttaaagttttaatagttaactttttaccaacttacgtaccgttcgggtccgtacgaacggtccggtaccgggggtaagggttcgtagggtacggttcgggttaccttcgtttactttaacgttaaacgtcggaacggtacggtacgtaccttaacgtactacgtttaccgtatacggtactaacgtacctcgttacggttaacgggacgggtacccgttaagtttaccccgaacccgtacgttacccgtaaccgaaagggaaacaaaccgaaaacctaaacgtaaacgttacccctacgtttaggtaacctacggtcgtaaacaaacgtacgaacttaggtatacgggaagtaacggtagtaaaccgnggacgtacgtacttagttaactaggtttacggtaagaaaaccgtaaagggaacgtaaacgggacgaaacgggttacctttaaaggtacgggttcgggttcgttacgggtttaaccgg

SEQ ID NO: 93873 - DNA, 646 bp, Homo sapiens
  misc_feature: GYAE6OF01EHOT3.29.85.H08.1.454.CMB.1.raw
  modified_base (228)..(228): a, c, t, g, unknown or other
  misc_feature (228)..(228): n is a, c, g, or t
  modified_base (622)..(622): a, c, t, g, unknown or other
  misc_feature (622)..(622): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtcagtcacatctcctgccacgtcggaaccngcagcgagtcgtcggtggttactaacgtttcgttcctcctacggtaaccaacaaccaccgacggccggaccggccccccgagtccaattaactttatgtatgtctaattacgccgtccgtcgtacgggtccctgctcgtcttctcgtcgctcgagtcgtcgacacacgtctccctcctacgacctcttccgtcgtcggcctaccgtacggtactcggtaacgtacgttacggtacgttacgtactttacgttacgtcgtacgtcgtccgttatacggtttaccgcggtaaccgtcccgtacccgtacgtcggttacgtacgtaccgttacggtccggggaccgggtaacgggaaccgtacggtcccgtacggacccgtttaccggacggtaccncggtacccgtacggtaaccccggg

SEQ ID NO: 93874 - DNA, 220 bp, Homo sapiens
  misc_feature: GYAE6OF01DLIQD.29.85.H08.1.454.CMB.1.raw
  modified_base (139)..(139): a, c, t, g, unknown or other
  misc_feature (139)..(139): n is a, c, g, or t
  modified_base (165)..(165): a, c, t, g, unknown or other
  misc_feature (165)..(165): n is a, c, g, or t
  modified_base (175)..(175): a, c, t, g, unknown or other
  misc_feature (175)..(175): n is a, c, g, or t
  modified_base (206)..(206): a, c, t, g, unknown or other
  misc_feature (206)..(206): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggntcctgggctcagtctgccctgactcngcctcgcctnagtgtccgggtctcctggactgtcagtcacntctctgcatgaacc

SEQ ID NO: 93875 - DNA, 645 bp, Homo sapiens
  misc_feature: GYAE6OF01BSGB9.29.85.H08.1.454.CMB.1.raw
  modified_base (173)..(173): a, c, t, g, unknown or other
  misc_feature (173)..(173): n is a, c, g, or t
  modified_base (185)..(185): a, c, t, g, unknown or other
  misc_feature (185)..(185): n is a, c, g, or t
  modified_base (556)..(556): a, c, t, g, unknown or other
  misc_feature (556)..(556): n is a, c, g, or t
  modified_base (586)..(586): a, c, t, g, unknown or other
  misc_feature (586)..(586): n is a, c, g, or t
  modified_base (624)..(624): a, c, t, g, unknown or other
  misc_feature (624)..(624): n is a, c, g, or t
  modified_base (628)..(631): a, c, t, g, unknown or other
  misc_feature (628)..(631): n is a, c, g, or t
  modified_base (633)..(634): a, c, t, g, unknown or other
  misc_feature (633)..(634): n is a, c, g, or t
  modified_base (639)..(640): a, c, t, g, unknown or other
  misc_feature (639)..(640): n is a, c, g, or t
  modified_base (642)..(643): a, c, t, g, unknown or other
  misc_feature (642)..(643): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtgttatactttgctctgtacaacacaccagcgacgcccccanctaataagttangatgtcagttaacggccgccctacgacggggtccctagtacttcgcgtttcctcgtcggcctaccgtaagttcgtggaccaaactgttcgccctacctgaccctatctcgtcgggtcctccgacggtactcggaacgtcgtaggtacggttatagtttaacttcgtcgtactcgtctcgttaactttggaccgacggtacctacccgtactacttgggagtacgttcggtaccgggagggaaccgggaaccaaagtccgttaccggaaccccgttcgtacgggttaccgacgaccgtacgaacgggtccctacccggtccccgtacggtaccttacctcccgggttacccttacccccaacccttccgttnaacccggttacttagtaccgtgtaccgggngggtaccgtcggaacgtccgaagggccctagaccgtancgcnnnncnnctcanncnngc

SEQ ID NO: 93876 - DNA, 834 bp, Homo sapiens
  misc_feature: GYAE6OF01A2Q8G.29.85.H08.1.454.CMB.1.raw
tcagatagagtactcacgaccggtgctcgatttagtatcactcagtcgcggggggggtctcaggaggcagcactctcgggacgtctccaccatggcctggctctgctcctcctcagcctcctcactcgagggcacaggactccgtgggctcgagtctcgccctgactcacgcctcgctcgagtcgtccggtctcgtgactacgtcacgtacacctatcctccgtgcacgtacggaaccagcagcgtagtcggtacggtagttaacttactttcgtccttaccgtacgtaaccaacaaccgaccgacggaccggaccccggaccccccgtaattaccgtaagtttaacgttacgtagtaacgttacggtacctaacggttaaccggtcccggtaccccgttacggggtaccggggttccctacggttaccggttcccgttcctttacgtcggttaccggtacccttaccggtaacggttcccgtacgggtaaaccctaaccgttaccggttaccggtaccccttacccgggtaacgtacccgttacggttacccgtacgggtccgggtaaccctacggtaaccgggttactaacggtaccggtagttacgggtaacggttactttaccgttacgttacgtcgttaccgtcgtaccgttaacgttcggtaacccggtccgtaaccggtcccgtaacccggtattaccgggttagggtaaaccgtttccggttacccggggtacggtaaccgggggaacccgtacggtacgtacccgggttaccgtaccccggttaaggtacccgtaggtacccgtaaccgttacccggtacccggg

SEQ ID NO: 93877 - DNA, 595 bp, Homo sapiens
  misc_feature: GYAE6OF01E3GUZ.29.85.H08.1.454.CMB.1.raw
  modified_base (224)..(224): a, c, t, g, unknown or other
  misc_feature (224)..(224): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgtatacttgtctctgtaccacaacaccagcgacgcccccgatcataattatgatgtctattacgcgccctcgtacgggtccctgactcgtcttctcgtggcctcctaagtctacggacaacctactcgccctccctcgacccacttcctccgtcgggtccctcccgtacggccgttacgacgtacgtcggtaacggttagtaactttacgttaccgtgccgtcgtccttcgtaagtttcgaccgtacggcccacccgctacgtgtcgtacgtccgttcgggccgggtaacggacccgtaacggtcccgttaccggaccccgttccggtaaggtcctacggtcctaacggtaacccgg

SEQ ID NO: 93878 - DNA, 766 bp, Homo sapiens
  misc_feature: GYAE6OF01C1IRH.29.85.H08.1.454.CMB.1.raw
  modified_base (202)..(202): a, c, t, g, unknown or other
  misc_feature (202)..(202): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgaggcacgaggatccgtgggctcagtctcgccctgactcacgcctcgctcgagtcggtccggtctccgtggacngtacacgtccacattcctcgtacgactacgacggaccagcgagacgagttcggtcggttacggtttacttacgtttgtaccttacgtacgtaacctaaacgacctaccggacgggaccgaccccgggtaccccccgtaattactaaacgtttaacgtttacgtacgtacttacgttacgtaaacgtttaaccggcccgtaccgttacgggtaacgggttccctagtaccgttcgtctttcgcgtacggtacctacggtaacgtccgtagtacccacgtaccgtccgtaccccttacgcgtaaccttcgtccgttaccgggtcggtacccgtccggtaacggtcgtaacgggtaacgtacggttaacggttacggttaacgtacgtttaaccgtttcgtcggtcgttacgtaccttacgttacgtttaccggaccgtacgacccgtacccgtagttaccgttagttaccgtacggtaccggttacgggaaccggtacggaaccgtcgtacccggttaccggtacccggttaccgtagtacccgtaccgtcgtaccggtaccccgg

SEQ ID NO: 93879 - DNA, 649 bp, Homo sapiens
  misc_feature: GYAE6OF01A0O6R.29.85.H08.1.454.CMB.1.raw
  modified_base (228)..(228): a, c, t, g, unknown or other
  misc_feature (228)..(228): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatccgtgggctcagtctgccctgactcagcctcgctcagttcgtccgggtctccgtggacagtcagtcaccatcctctgcacgtggaccngcagcgatgtggtgtatacttgctctgtaccaacacaccagcgacgccccactcatatttangntgtcattacgcgcctcgacgggtcctgactcgtcttccgtcgttcggtcctaccgtaacgtctacggactaaaccgtcgtacggtcccttacccgtagacccgtactccgttaccgtcgggtccctaccgtacggtcccgtagtaccgtggtacgtaccgggtataacgtttattaccggtctaccgtgtacccgttcgttacgtttcgaccggtacgtcccgtaacccgtccgtaacgtcgttaccggttcgttacccgggttgggtacccgggaacggtacccgaaacgggtcccgttcgggtaccccgttaccggttaacggtcccgtacgtcccggttcccggtaaacccggg

SEQ ID NO: 93880 - DNA, 781 bp, Homo sapiens
  misc_feature: GYAE6OF01EZ3Z2.29.85.H08.1.454.CMB.1.raw
  modified_base (769)..(769): a, c, t, g, unknown or other
  misc_feature (769)..(769): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatggtcggtggttataactttgtctcctgtaccaacaacacccaggcgacggccccccgactcaattaattatgtatgtcaagttaacgccggccctcgacggggtccctggactccgcttccgtcgtcggcctcctaaagtccgtgggaccaaaccgtactcggtcccctcccgtacgaaccctattcctcgtcggggtcctccgtaagggtcctacggaacggtaagtacggtaacggttagtaaacgtttattaaccgtcgtaccgttgtacccttacgtaacgtttcgaccggtaacggtaccccgtaacccggtaccgtaacgttcggtacgtaccgtttaccggttaccggggtacccggggaacgggtaacccgtaacgtcccggtacggtaaccccgggttaccggttacggttacccgtacgtaccgtaaccggaaccggtcccgtacccggtcccccgttacggtacccgtaccgttcccgttacccgtttacccccaccccgttacccgtaccgtaaccgttaccttacgtaaccggttccgtacggtaccgggttccgggacgttaccggaacgtaccgggacgtacccggtaaacgtacggacgcgtagcgtcgtaccgtcgacgtctaacncgtcgtgtagcg

SEQ ID NO: 93881 - DNA, 629 bp, Homo sapiens
  misc_feature: GYAE6OF01A85MD.29.85.H08.1.454.CMB.1.raw
  modified_base (156)..(156): a, c, t, g, unknown or other
  misc_feature (156)..(156): n is a, c, g, or t
  modified_base (184)..(184): a, c, t, g, unknown or other
  misc_feature (184)..(184): n is a, c, g, or t
  modified_base (326)..(326): a, c, t, g, unknown or other
  misc_feature (326)..(326): n is a, c, g, or t
  modified_base (346)..(346): a, c, t, g, unknown or other
  misc_feature (346)..(346): n is a, c, g, or t
  modified_base (610)..(610): a, c, t, g, unknown or other
  misc_feature (610)..(610): n is a, c, g, or t
  modified_base (614)..(614): a, c, t, g, unknown or other
  misc_feature (614)..(614): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtgttatactttgtctctggtaccanacaccaggcgacgcccccatcatattangatgtcattacggccgtcctgacgggtccctgactcgcttctcgtaggcctaccgaagttcctaggaccaaactcgtacgcccttccgtagacctattctcgtcgggtcctcggacgtcgtacgaacgtacgtggtacggtntaacctttacgtactggtcngtctacgtgttcgacgtaccggtaccaccgcgtacgtgtcgtacgttccgtcgggacgaacggtactacgtgtaccgtccgttcgacggtccacggtacctacggtacggtacctacccggtaccccgttcgggtaccttaccgttcgttacccgttaccccgtaccctcggttactaacccggttcctacttacggtccgtacggtacgggtccgtacgtccggtagtaccggctacgaacgttcgctacggttcaagtccgntacnctacgcacgcngntc

SEQ ID NO: 93882 - DNA, 636 bp, Homo sapiens
  misc_feature: GYAE6OF01CHVG1.29.85.H08.1.454.CMB.1.raw
  modified_base (314)..(314): a, c, t, g, unknown or other
  misc_feature (314)..(314): n is a, c, g, or t
  modified_base (454)..(454): a, c, t, g, unknown or other
  misc_feature (454)..(454): n is a, c, g, or t
  modified_base (519)..(519): a, c, t, g, unknown or other
  misc_feature (519)..(519): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcacctatcctcctgctacgtcggaaccagcagcgatggtcggttgttataactttgtcttcctggtaaccaacaacacccaggccgacggcccccactcaagttaactttangtatgtactattaacgccggaccctcgacgggtccctgactctcttctcgtcgctcaagtctaggccaatcctcgtcctccctcgaccctagtccgtccgtcgggtcctaccgaggcctggaccgtatacggtacggttntaacgtttacttaacgtcgtctggtccttacgtagtttccgacgtaacggtccctaaccccggtntaaccggttcggtactacgttaccggttccggggaacgggtaccgggaaccctaacgggtccctaccgggtaccgttacccggtacggttaccgaacggtccgtacggtaacccggg

SEQ ID NO: 93883 - DNA, 784 bp, Homo sapiens
  misc_feature: GYAE6OF01C97J6.29.85.H08.1.454.CMB.1.raw
  modified_base (732)..(732): a, c, t, g, unknown or other
  misc_feature (732)..(732): n is a, c, g, or t
tcagatagagtactcacgaccggtgctcgatttagtatcactcagtcgcggggggggtctcaggaggcagcactctcgggacgtctccaccatggcctggctctgcctcctcctcagcctcctcactcgagggcacgaggactccgtgggctcgtagtcctcgccctgactcacgcctcgctcagttcggtcccggtctaccgtggactaacggtcacgttaccacctacttcctcctcgactacgtacggaaccagcgaggtccgagttcgggtacggttacggttaacgtttaaccgttttcgtaccgtttaccgttacggtaaaccctaaaccgaaacccgacccgaaccgggaccgtaaccccgggacccccctaacgttacctaagtttaaccgtttacgtacgtacgttagtaccgtaaagttaccgccgggtaccctcggtaaccgggtctacgacttccgtctacgtcgtcgtcgtactacggtctcgacctaccgacgtccgaccgttccgtactacgtaccctcgttaccgtcgggtacccgtaccgtacggtaccgtaaggtacgtaacggtacggttaacgggttacgttaactttaaccggttccgtggttacccgtcgttaaaccttcgttaacggtttcgaccggtacccgacgttacccggactaggttccgtaggaccccggtttaggtccgggaaacgggtacgacccggtacnccgggtttaacccgaaccggttccggttaacgcggtacctggaacccgtacg

SEQ ID NO: 93884 - DNA, 609 bp, Homo sapiens
  misc_feature: GYAE6OF01BX5LU.29.85.H08.1.454.CMB.1.raw
  modified_base (234)..(234): a, c, t, g, unknown or other
  misc_feature (234)..(234): n is a, c, g, or t
  modified_base (237)..(237): a, c, t, g, unknown or other
  misc_feature (237)..(237): n is a, c, g, or t
  modified_base (275)..(275): a, c, t, g, unknown or other
  misc_feature (275)..(275): n is a, c, g, or t
  modified_base (305)..(305): a, c, t, g, unknown or other
  misc_feature (305)..(305): n is a, c, g, or t
  modified_base (478)..(478): a, c, t, g, unknown or other
  misc_feature (478)..(478): n is a, c, g, or t
tcagatagagtactcacgaccggtgctcgatttagtatcactcagtcggcggggggggtctcgaggaggcatcactctcgggacgtctccaccatggcctgggctctgctcctcctcacgcctcctcactcagggcacgagggactccgtgggcctcagttctcgccctgactcagcctcgctcagttcgtcccggtctcctggacagtcagtcacatctcctgcactcgaacngcngcgatggtcgtgttatacttgctcgtcgtaccaacacnccgagcgaccggccccatccattaacgttntgatcgtactagttacggccgtacctcgacggtcctagactcgtcttcgtctcggtctaccgaacgtcgacggtaccaaccgtcgtacgccccttcccgtagaacccttacgtccgttccgtacggtcctcccgtagggctacgacgtgtcgtacggttgtattacgttcgtntacgttcgaccttacgtagtttcggccgtacggtccaccggtctccggtaggtccgtagttcccgggtacggacgggtacgaaccgtcgaccgtccgtaaccgtacggtacgctacggctccggtaaccgg

SEQ ID NO: 93885 - DNA, 537 bp, Homo sapiens
  misc_feature: GYAE6OF01E0T7V.29.85.H08.1.454.CMB.1.raw
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (522)..(522): a, c, t, g, unknown or other
  misc_feature (522)..(522): n is a, c, g, or t
tcagatagagtactcacgaccggtgctcgatttagtatcactcagtcgcggggggggtctcaggaggcagcactctcgggacgtctccaccatggcctggctctgctcctcctcagccctcctcactcagggcacaggatcctggctcagtcctgccctgactcagcctcgctcagtcgtccggtctccgtggacagtcagtcacatctcngcacgtgaaccngcagcatgtcgtgtatacttgtctctgtacacacacngcgacgccccatcatattangntgtctatacgcgcctcgacgggtcctgactcgtcttctcgtcgcctaccaacgtcgtgaccaacgaccgtacgccctccgtacgacctacgttcctccgtcggtcctacccgacgtcgtcgaacgcgttcgacggtagtactttactcgtagtctgtctcgtagttcgacgcgaccacgctacgtgtcgtacgtcgttacggcggtaagacctgccgtaccgtaccgtacgtacggtacncgtccgtcggtaccg

SEQ ID NO: 93886 - DNA, 762 bp, Homo sapiens
  misc_feature: GYAE6OF01B9U2R.29.85.H08.1.454.CMB.1.raw
  modified_base (224)..(224): a, c, t, g, unknown or other
  misc_feature (224)..(224): n is a, c, g, or t
tcagatagagtactcacgaccggtgctcgatttagtatcactcagtcgcggggggggtctcaggaggcagcgctctggggacgtctccaccatggcctgggctctgctcctcctcacctcctcactcagggcacaggctcgttcggcccagtctcgccctgacttcgacgtccctcccgtccgtcggtcccggtctccgtaggacagtcagtcgccatcctccngcacgtacggaacctagcgacgtgtagtgttagaagtaagtttagcgtactcgtcctaccgttaggaaacccaaacaaaccaccgaacgaaccacgtaaccgtaaccaaaacgaaaacacgtaatacgtaactaactaactaacgtataaccaaacgttaccgcccggtacccgtacggtaacccggggttccctagttactttccgtttacgtaccgtacggttaccctaacggtaacgttcgaacgggtactaacggtcggacccggtaccctacgtagtaccgaacctacgtccgttacggtacgtacctacgtacggtacgtacgggtaacgacggtaacgtcgtacgttaagtttacgtacggtacgtcgttacgacgttaactaagtttaacgaaacgttaacgacgttaacggttaccgtaaacggtttaacggggttaacggggttcggtaaccggggacggtaaacggactacggtaccggttacgtacccgggttcgacgggtaaccaacggcccgtaacgtccccgg

SEQ ID NO: 93887 - DNA, 827 bp, Homo sapiens
  misc_feature: GYAE6OF01A2FSC.29.85.H08.1.454.CMB.1.raw
  modified_base (258)..(258): a, c, t, g, unknown or other
  misc_feature (258)..(258): n is a, c, g, or t
tcagatagagtactcacgaccggtgctcgatttagtatcactcagtcgcggggggggtctcaggaggcagcactctcgggacgtctccaccatggcctgggctctgctcctcctcagccctcctcactcgagggcacgaggactccgtgggcctcgagtcctgccctagacctcagtccctcgctcgacggttcgtcccgggtctccgtggactaggtcacgtccaacctagttcctccgtgcctacgtcggaacccngacgacggtcgtattcgggtacggttcggtttaacgttacgtttcgttccgttccgtacggtaacccaacctaaccgaaccccgtacgggtacccggaccggaccccccgtaccgttacctaacgttaaactttacggttacggtaacgttacggttacgtaacgtttaaacggcccgggttaccccgttaccgggtaccgggggtttacccgtacggtaccgttccggtttccgttaccgttccggttcgtaccgttacccgtaacggttccgtacgggtacctaaccgtaccgtaccgttccccgtacccgttaccggacccttaccgtttaccggtccggttacgggtcccgttccggtaccggtaccgtcgggtaaacggtacgttacgggtacgggtttacgttaacgttttaaccgtccgttacggtaccgtttcggccttacgttacggtttcgccgtaccgtccgtacgaccgtacgtcggtacgtacggttaccgtcgggacgggtaccggacgtcgtccgtaccggacggttccgacgtacgtacgtcgtacgtcccgg

SEQ ID NO: 93888 - DNA, 778 bp, Homo sapiens
  misc_feature: GYAE6OF01BEUOJ.29.85.H08.1.454.CMB.1.raw
  modified_base (709)..(709): a, c, t, g, unknown or other
  misc_feature (709)..(709): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggttttccttgttgcttaagttttaaaaggtgtccagtgtgagtgcagctggtggagtcgtgggggtagtcgtggtacgaggtccggtggggggtccctggacgtactccgtccgtgtcgcacgtccctgtaggtattacgttaaaagttttaatggtttaactttttccgaattaccgtaccggtcgggttacccgtacaacggtcccggtaccgggggaacggttcgtagggtacgggttcggttccgttactttacgtttaagttaacgtcggtaaggtccggtagtacttaaaccgtactaacgtttctacgtcggactaacgtacttcggtaggtacgggaacgggcccgttaattacccaaccgtcttaccgtacccaaaggtaacaaacccaaaacgtaactaaaccgttaccccgttacccgttaagttacccgtttacgacgtaaacgtaacgttaacgtaaacgtcggtttacgaaggtaaacgggtaacgtaacggaaccgaacgagggttcccttacgtttaacttagttttagaacgggttnaaaggaaaaggcggttaaacgcggaaaggtaccttaacggtaacggggttgttccggtagtttaccggg

SEQ ID NO: 93889 - DNA, 843 bp, Homo sapiens
  misc_feature: GYAE6OF01AGMUI.29.85.H08.1.454.CMB.1.raw
  modified_base (262)..(262): a, c, t, g, unknown or other
  misc_feature (262)..(262): n is a, c, g, or t
tcagatagagtactcacgaccggtgctcgatttagtatcactcagtcgcgggggagctctgggagaggagccccagccctgagattccccaggtgtttccattcggtgatcagcactgacacagagaacgcaccagtggagttggactgagcgttggtttccttggttgacttaagttttaaaggtgtcctagtgtgaagtgacagtcgtggtcggagtcggtaggggtgtcggtggtacgcggccggttcgggggtacccngacggtactcctcggtgcggactgtccgtcgtggtacttaacgttaagtttacgtagtttacctttttacgaacttaccgacggtttccggtaccgtaacgaaccggtccgggtaccggggtaaacgggttcgtagggtagggttcggttcctacgtttaacggtttaattaccgggacggtaaccgggtacggttacgtaccgtttaaacgttaacgtacgttttacccgtaattccggaccgttaaacggtcccttaggttacggtacggggaaacggttccctaagttaccctacgtactccccgtacggtaaagtaacccgaaacgtaaacctaaacccggtaaccttaccttaccgttaacgttactacgtaacggaactaaacgtgtaacccgtagttaccgagtaacgggttaataaccgggtacaacggttacggaccccggtttattacgttaaacgttcgttaacggtaacgtaacgggaaaaacggtcgggtaaacgggtaccgtaaaacgggttaacgggtttaacgggtaagggtttaacggttcgggtttaacggttaaccccgggg

SEQ ID NO: 93890 - DNA, 598 bp, Homo sapiens
  misc_feature: GYAE6OF01B9I3P.29.85.H08.1.454.CMB.1.raw
  modified_base (225)..(225): a, c, t, g, unknown or other
  misc_feature (225)..(225): n is a, c, g, or t
  modified_base (294)..(294): a, c, t, g, unknown or other
  misc_feature (294)..(294): n is a, c, g, or t
  modified_base (342)..(342): a, c, t, g, unknown or other
  misc_feature (342)..(342): n is a, c, g, or t
  modified_base (423)..(423): a, c, t, g, unknown or other
  misc_feature (423)..(423): n is a, c, g, or t
  modified_base (477)..(477): a, c, t, g, unknown or other
  misc_feature (477)..(477): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatctcctgcactggaaccngcagcgatgtcgtgttataacttgtctctgtaccaacaacaccaggcgacgcccccgactcaatattangatgtacattaacgccggcctacgacgggtccctgactcgtcttctcncgctccaagtctggacaacactcgccctcccgtcgacctacttcctcgtcgggtcctcgacggtctagacgatcggaggtntaatttattactgtcgtcgtcttactagtttcgcgtaacggacccaccccgtanacccgttagtacgtacgttccggttaccggggacggggtaacgggaacccgaaacggtaccgtaaccgggtacccgttacggttaacgggtaccaacggtacccgtaacgtaaacccgggg

SEQ ID NO: 93891 - DNA, 628 bp, Homo sapiens
  misc_feature: GYAE6OF01EMOS5.29.85.H08.1.454.CMB.1.raw
  modified_base (224)..(224): a, c, t, g, unknown or other
  misc_feature (224)..(224): n is a, c, g, or t
  modified_base (286)..(286): a, c, t, g, unknown or other
  misc_feature (286)..(286): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcgtgttatacttgtctctgtacacacaccagcgacgccccatcataatttangatcgtcattaacgcgtcctcgacgggtcctgactcgcttctctgctcagtcngacacnctcgcctcctgacctactcctcgtacggtccttaccgaggtcctaggaccgtacgtacggtacggttagtactttacgttacgtacgtccttcgcctttacgtagtttacgaccgttacggaccctaccccggtacctaccgttacggtacgttaccgttacccggttaccggggacccggggtaaacggggtaaccccgtaaacgggttccccggtacgggttacccccggttaccgttaacgggtacccgtaaccggtacccgttaaccggtaaacccggg

SEQ ID NO: 93892 - DNA, 761 bp, Homo sapiens
  misc_feature: GYAE6OF01DTJ1H.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggtttccttgtgtctattttaaaaggtgtccagtgtgaagtgcagctggtggagtcgtggggagtcgtggtacaggccgtgggggtccctgagctctcctgtgcagcctcgtggtatttcgtaaagttttaatgttatttttccgaatacgtacttcggggtccgtacgaaggtccggtccgggggtaaggtccgtgggtaggtcggggttctcgttacttaagttaacgtcggtaagtacggtcgtaccttaaccgtactaatttccgtaagttcggactacggtacttcgttggtacggaaacggggtcccgtaatttaccaacccgtattaccctaccgtaaggaacgtaaacccaaaaccgtaaaaccgtaaccggtttaaccccttcccgttaaggttaaaccgtcccgtttaacggaaacctaaaacgttacgggtaaaaccgtaaggtttaccgtaagggtaaacggtaaggttcggtaaaccggaaccggtacgggtccggttacctttacgtttaaagtttaccgttgggttacgaaacgtaaaacggaagtaacgggactaagggtaactacgttaagggtcgggtcgtcgttacgg

SEQ ID NO: 93893 - DNA, 877 bp, Homo sapiens
  misc_feature: GYAE6OF01C98DZ.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagacgcaccatggagtttgactgagtcttgggttttccttgttagtacttaattttaaaaggtgtccagttgtagagtgcgagtcgtgggtggagtcggtagggggagtcggtggtacgacggtccggtcgggggtccctggacgtccttctccgtgtcgactacgtccgtcgtaggtactttacgtaaaggttttaatggttactttttaccaagtaccgtacggttcgggttacccgtacgtaaggtcccggttaccggggggaacggttcggtagggtagggttcgggttacttaccgtttaagtttaacgttaaacggtcggtaaggtaaccgggttctaaccttaactaacttacgtttaccgtaaagttcggtacctaacgggtcctttacggtagggttaacgggaacccggggtaccttaacgtttacccacccgtacttaccccgtaccgaaacggtaaccaaacaaaacccgtaaaacaacccggtttacccttaacccgttaacgttaaccttacggttaactaaacccgtaaaagttaccgtaaacgtaacgttaccgttaagggaaacgttagggaccgaaaccggtaacgttaccgggtccgtttacccgtttaagttaaagttttcgttaccgggtaaaacgaaacggtaaaaagggtacggggaaaacgtacggtaaacggttaacgttaaacggggtttagggttaccgggggtctttacgggttttaaaacccggg

SEQ ID NO: 93894 - DNA, 603 bp, Homo sapiens
  misc_feature: GYAE6OF01DAZZS.29.85.H08.1.454.CMB.1.raw
  modified_base (226)..(226): a, c, t, g, unknown or other
  misc_feature (226)..(226): n is a, c, g, or t
  modified_base (295)..(295): a, c, t, g, unknown or other
  misc_feature (295)..(295): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcgagggcaacgaggatccgtgggctcagtctgccctgactcagcctcgctcagtcgtccggtctcctggacagtcagtcacatctctgcatggaaccngcagcgatcggtagtagttatacttgctctagtaccaacacaccaggcgaccgccccatcaatacttangactgtactagtacgccggtcctcggacgggtccctgacttaccgtcttacgtcgtcggtacctccgtaacgtcgtacggtaccaacgtacgtcgtccctaccgtcgaacctctcgtccgtacggcctaccgcgtactaggaacgtgtacggtacggtacgtaacggtttcttacgtcgtccttcgtaccttacgttacgtttcgacgtaccggcctacccgtcgtaacgttcggtacgtaccggttacgtccgggaacggtacggaccctggtaccgtcgaccgttcgacgtatcgccgtggacccg

SEQ ID NO: 93895 - DNA, 815 bp, Homo sapiens
  misc_feature: GYAE6OF01EYS8R.29.85.H08.1.454.CMB.1.raw
  modified_base (259)..(259): a, c, t, g, unknown or other
  misc_feature (259)..(259): n is a, c, g, or t
  modified_base (315)..(315): a, c, t, g, unknown or other
  misc_feature (315)..(315): n is a, c, g, or t
tcagatagagtactcacgaccggtgctcgatttagtatcactcagtcggcggggagctctgggagaggagccccagccctgagattcccaggtgtttccattcggtgatcagcactgaacacagagaacgcaccatggagtttggactgagtcgttcggttttccttgttgcttaattttaaaggtgtccagtgtgaagtgcagctgggtggaggtcggtgggggagtcggtggtactacggccggtcggggggtcccnggacgtacctctccgtgtcgcacggtccttccgtggtacttacgtaaagttttaangttactttttaccaattactaccggttgggtacccgtacgaacggttaccggtcccggggggttaaagggtccggtacgggtaggttccggggttactaccgtttacgtttaaacgtttaaacgtccggtaaggtccggttagtacccttacgttaactaatttaccgtacttcgacgtaacgttaccttcgtacggttacgggaaccggggtaccttaacgttaccaacccgttactaccgtaccctaaagggaaacccgtaacctaaaaaccgaactaaaacggtccccgtttaccggttaacttaattacccggtagaacccttaaaagtccgttaaacctaacggttaccgtaagggtaaacgtaaagggttccgaaacgtaaaccgtaccgggtcgtaccttttacgttagttttagttaacggttcaaaacgtaaacgggagaacggagaacggttaacgtaggtaacgggttggtcccggttgtttaaccggg

SEQ ID NO: 93896 - DNA, 742 bp, Homo sapiens
  misc_feature: GYAE6OF01EGMAF.29.85.H08.1.454.CMB.1.raw
  modified_base (241)..(241): a, c, t, g, unknown or other
  misc_feature (241)..(241): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggactccgtgggctcagtctcgccctgactcagcctcgctcagttcggtccgggtctccgtggactaggtcacgtcacctatcctccgtgactacgtacgaaccngcgagcgtagttcggttacggttagttaacttaaccgttttgttaccgtaccgttacggtaaccaaaccgaaccgacccgacgggacccggtaaccggtacccccccgtataccgttaacgtttaactttacgtaggtacttacgttacgtaacgtttaaccggcccggtaccgtacggtacgggttcccttacggtacgttccgtctttaccgtcgtacgtcctaccgtacgttcgtacggacaccgtacgtccgcccttacccgtacgtacctacgttaccgttcggtacggtaccttccgacggtacgtacggaacgtcgttacggtacgttacgttacgtttaaccgttcgtacgttcgtacgttcgttacgttacgttcggacgtacccggccgtacgtcctacgtcgtaccgtacgtccggtacgggacgggtacggaaccgtcgtcccgtacggtacccgttacggtacgaccgtcggcccgtacggtacccgg

SEQ ID NO: 93897 - DNA, 669 bp, Homo sapiens
  misc_feature: GYAE6OF01B3L9T.29.85.H08.1.454.CMB.1.raw
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcgagggcacaggactccgtgggctcagtctcgccctgactcacgcctcgctcgagtcggtccgggtcctccgtggacagtcacgtcaccatcctcncgacacgtacggaaccngcagcgtagtcggtcgtgttacttacttcgtctcgtacgtaaccaacaccgaccgacggaccgaccggccccactactaatagttatagtactacgtacaagtacgccgtaccgtcggaccggtcctgtacgtccgtctcgtcgtcgtacctacgtagtcgtacgaccgtactacgtccgtacctacccgactaccgtcgttcccgtcgggaccgtcccgtacgtacggtaccgtacggaacgttacgtacggttaacggttaaccgttaacgtttccgttaaccgtcggtccgttacgttccgtacgtttaccggttacgggaccgtccgggaacctcccggtatacggtcgtacgtcgtaccgggtacggacggtaacgacctacggcccgtaacggccgtacgtagaccctgccggtcgtacccg

SEQ ID NO: 93898 - DNA, 449 bp, Homo sapiens
  misc_feature: GYAE6OF01C25GP.29.85.H08.1.454.CMB.1.raw
  modified_base (290)..(290): a, c, t, g, unknown or other
  misc_feature (290)..(290): n is a, c, g, or t
  modified_base (410)..(410): a, c, t, g, unknown or other
  misc_feature (410)..(410): n is a, c, g, or t
  modified_base (421)..(449): a, c, t, g, unknown or other
  misc_feature (421)..(449): n is a, c, g, or t
tcagatagagtactcacgaccggtgctcgatttagtatcactcagtcagtccaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacactgccctccctgaccatctctgggctccaggctggacgatgacggtgattattactgctgctcatttgcaggcacccgnactgtgatcttcggcggaggaccaagctgaccgtctaggtcagctcaaggctgcccctggtcacttctcgttccccgccctcctcagttacctctatctgacgcgggtctggcaagggcncacgtagcgannnnnnnnnnnnnnnnnnnnnnnnnnnnn

SEQ ID NO: 93899 - DNA, 694 bp, Homo sapiens
  misc_feature: GYAE6OF01DHPW7.29.85.H08.1.454.CMB.1.raw
  modified_base (149)..(149): a, c, t, g, unknown or other
  misc_feature (149)..(149): n is a, c, g, or t
  modified_base (253)..(253): a, c, t, g, unknown or other
  misc_feature (253)..(253): n is a, c, g, or t
  modified_base (352)..(352): a, c, t, g, unknown or other
  misc_feature (352)..(352): n is a, c, g, or t
tcagatagagtactcacgaccggtgctcgatttagtatcactcagtcggcggggggggtctcaggaggcagcactctcgggacgtctccaccatggcctggctctgctcctcctcagcctcctcactcgagggcaacgaggactcccgngggctcgtacgtctcgccctagacctcgacgcctcgctcgaggttcgtccggtactccgtaggacagtcgagttccaacctatcctctagcctacgtggaaccngacagcgagttcggtacggttagttacttaacttcgtactccgtacgtaaccaacaccgaccgaggccgtacccggccccagtctaagttattagagtntcgtacgagttaacgccgtaccgtcggtaccgggtcctgtaccgttcgtacttcgtacgtccggtacctacgtaacggtccgttacggaccaaccgtcgttaccgccccttactaccggaaccttaccgtccgtacgtcggtacccgtacggtgacggtacgacgtacgggtacgttacggttagtactttcgtacgtgtacgtacgtaccgttattacggtcgacggttacccggacctaccgtcgtacgtcgtagtccgtttacggggtaccggacggtaacggtacctacggtcccggtaacggtcccgttacgtagacccgtagccgtaccggtacgg

SEQ ID NO: 93900 - DNA, 563 bp, Homo sapiens
  misc_feature: GYAE6OF01DOQJI.29.85.H08.1.454.CMB.1.raw
  modified_base (195)..(195): a, c, t, g, unknown or other
  misc_feature (195)..(195): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
  modified_base (449)..(449): a, c, t, g, unknown or other
  misc_feature (449)..(449): n is a, c, g, or t
  modified_base (517)..(517): a, c, t, g, unknown or other
  misc_feature (517)..(517): n is a, c, g, or t
  modified_base (549)..(549): a, c, t, g, unknown or other
  misc_feature (549)..(549): n is a, c, g, or t
  modified_base (551)..(560): a, c, t, g, unknown or other
  misc_feature (551)..(560): n is a, c, g, or t
  modified_base (562)..(563): a, c, t, g, unknown or other
  misc_feature (562)..(563): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaccggcccccgatcattaatttngatgtcataacgccggccctcgacggggtccctaggactcgcttctctcggcctacaagtctggacaacactcgccctcctgaccntcnccgtggcctccnggctgacgngtggacggtatatttataccgtgtctgctctagtttcgccgnggccccacccgtcacgtcggtgaacgtttccggtacgggacggggaacggaaccaggcctaccggacccgtcgttacggtcgaacgtccgaacgacggtccncccggtccccgtcgtctacccgttccgtcccgtcccccgtacctctccgaaccgtcttactcgtccgnggcgggctcgggagcggtaacgccacacgtgncnnnnnnnnnngnn

SEQ ID NO: 93901 - DNA, 769 bp, Homo sapiens
  misc_feature: GYAE6OF01ARD69.29.85.H08.1.454.CMB.1.raw
  modified_base (369)..(369): a, c, t, g, unknown or other
  misc_feature (369)..(369): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcgttgggttttccttgttgcttattttaaaaggtgtccagtgtagaagtgcagctggtggagtcgtgggggagtcggtggtacagccggtgggggtcctgagacctcgtcctgtgcacgcctcgtgtattactaagtttaatgttacttttccactactacgttcgggtaccgtcgaacgtcgtaccggggtaggtccgtgggaggttcggtctacttnttaagttaagtccggaggtacggtcgtaccgtaaccttacgtatttactagtacgactacgtaccttcgttaggtacgggaaccgggtccgttaacgttacccaccgtacttcccgtaaccgaacggaacaaacccgaaaccgtaaacctaaccgttaccccgttaccctttaagtaccctttaccgacggtaaaccaaagttacccggaaacgttacggtactaacgggtaaacggtaacggttaacgaacccgttaacggacggttaccggttactttacgtttaagttagttacggtacgtaaaaccggaaaagggtacggtaaacgggaccgtaaacgggtacgtttaacgggtaaacggggttcggggtttcccgggttacggtttaaacccggg

SEQ ID NO: 93902 - DNA, 791 bp, Homo sapiens
  misc_feature: GYAE6OF01CGHHY.29.85.H08.1.454.CMB.1.raw
tcagatagagtactcacgaccggtgctcgatttagtatcactcagtctgccctgactcagcctcgctcagtgtccggtctcctggacagtcagtcaccatctcctgcacgtggaaccagcagcgatgtcggtgttatacttgtctcctaggtaccaacaacaccgaggccgaccggcccccgactctaattaacgtttatcgtatcgtactacgttaacgcccggtccctacgacggggtccctgactccgtcttcgtcgtcgcctaccgacgtccgcggacaaccgtctccgtccccttacccgacgaacctacttaccgtcgtcggcctccgacggtctacggacgtagtacggtaggttagtaatttacgtacgtgccgttcgtaccgtagttacggttcgaccgtaccgaccgtaccgcgtacgttcgtacgtacggttccgtacggggacggtaccggacgtaccgtcggtacgtaccccccccccccgtaggtaccgtacgtaccgtaccgtaccggtaccgtacccggttcccgtccccggttacccgttacccgttacccgttaccccgttacccccgttacccccgttaccccgtttacccgttacccgttaacccgtttaccgttaccgttaccggttaccggtaccgggtacgggtaccgggtaccgggttaccgggaccgggttaaccgggtacccggtaaccggttacgtaaccgggtcgtaccgtacgacgttccgacgtacggaccggtacgtacggtactcgtaccgtcggtacg

SEQ ID NO: 93903 - DNA, 695 bp, Homo sapiens
  misc_feature: GYAE6OF01BVCOA.29.85.H08.1.454.CMB.1.raw
  modified_base (255)..(255): a, c, t, g, unknown or other
  misc_feature (255)..(255): n is a, c, g, or t
  modified_base (507)..(507): a, c, t, g, unknown or other
  misc_feature (507)..(507): n is a, c, g, or t
  modified_base (661)..(661): a, c, t, g, unknown or other
  misc_feature (661)..(661): n is a, c, g, or t
tcagatagagtactcacgaccggtgctcgatttagtatcactcagtcggcggggggggtctcaggaggcagcactcgtcgggacgtctccaccatggcctgggctctgcctcctcctcagcctcctcactcgagggcaacaggactccgtgggctcgagtcctcgccctgacctcgacgcctcgcctcgaggttcggtcccgggtctccgtggactagtcagtccacctactcctcctgcctacgtacggaaccngccaggcgtagtcggtggttagttactacgtttcgtcctcgtacgtaaccaacgtaaccaccgtacggaccgaccggtacccccgtattaccgtaattaactttacgtagtacttaggttactaacgttaacggcccgtcccgtacggacgggtccctggtactccgtacttcgcgtcgcctacgatcgacgacaaccgtcgtccgaccctccggtacaccgtgtccgttcgacgtcctaccggaggtacgnggaccgtagggtacgtagtcgttaacgttacttcggtagtccgttcgtactacgtttatccggaccgtacgcccgacccgtcgagttcggtacgtaccggttccggtacgggtaccggacgttaacccgcggtaccgttacggtaccccggttnaaccggtacccagttaccccgcggtaaccccggg

SEQ ID NO: 93904 - DNA, 787 bp, Homo sapiens
  misc_feature: GYAE6OF01BHPO0.29.85.H08.1.454.CMB.1.raw
  modified_base (209)..(209): a, c, t, g, unknown or other
  misc_feature (209)..(209): n is a, c, g, or t
  modified_base (760)..(760): a, c, t, g, unknown or other
  misc_feature (760)..(760): n is a, c, g, or t
tcagatagagtactcacgaccggtgctcgatttagtatcactcagtcgcggggggggtctcaggaggcagcactctcgggacgtctccaccatggcctgggctctgcctcctcctcagcctcctcactcgagggcacgaggatccgtgggctcgagtctcgccctgactcacgtcctcgcctcgagttcggtcccggtctccgtggacngtcagccacctatcctccgtgcctacgtacggaacccagcacgtcgtagttcgggtacggttaggtttaacttaaccgttttcgttcccgtaccgttacgtaacccaaacgtaacccgacccgaacggcccgaacccggacccccccgtataccgtaaacttaacgtttacgtaggtacttacgtactaacgtaacgggtcccgtcccgtacgtaaccggggttccctaggtccttccggtctttaccgtccggttacgccttaccgtaacggtcgtaccggaactaaacccgtcgttcccgtaccccgttcccgtaccgtaccctgttcccgtcggtccgggtcctaacccggacggtcgtaacggaccgtaggttacggtaacggtttagttaacgttttacgtcttacgttccgttacgcgtttacgttaccgttccgtaaccttcccgacccgttaaccgtgttacccgtggtacccgtgttaacccgggcggggtaacccgggtaaccgtaccggacgtcccgttacccggaacttccggggtacncccgttaaggccccgttaacggacccg

SEQ ID NO: 93905 - DNA, 813 bp, Homo sapiens
  misc_feature: GYAE6OF01B0G2V.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccagtggtagtttggactgagtcgttgggttttccttgttgtactttaagttttaaaacggtcgtacctaggtgtagtaagtgcgagtcgtgggtggtacggtcggtgggggagttcggtacggtacgacggtcccgggttacgggggtccctaggacgtaccttccgtccgtggtcgaccgacgtcccgtaggtacggtacttacgttaaagtttaattcgtttaacttttaccaactacgtaccggttacgggtacccgtacggaaccggtccggggtaccgggggtaagggtccgtgggtacggttcgggtcctttacgtttacgttaagttaacgacggtacggtacggtctaccgtaactacttacttcgtaatcggtactaagtcctacggtagggtaacggacggtacttactaccgtacctaaccgtctaccgaaacgtaacgaaaccaaaccgtaaaccgtaaccgttaccctacccgtttagtaacctacgtaaccgtaaactaacgtaacgaacttcgtaggtaacgaaggtaaccggagtaaccgacgtacggtccgttatttacgttacgtttaaggtgaaccggtaaaataacgggtaacggaaccgggtaagtaacggtaaagttaaccggtaaaggggttcgttaaccgggttcggttaaacccgg

SEQ ID NO: 93906 - DNA, 786 bp, Homo sapiens
  misc_feature: GYAE6OF01AHMWM.29.85.H08.1.454.CMB.1.raw
  modified_base (240)..(240): a, c, t, g, unknown or other
  misc_feature (240)..(240): n is a, c, g, or t
tcagatagagtactcacgaccggtgctcgatttagtatcactcagtcgcgggggagctctgggagaggagccccagccctgagattcccaggtgtttccattcggtgatcagcactgaacacagagaacgcaccatggtagtttggactgagtcttgggttttccttgttgtcttaattttaaaaggtgtccagtgtgaagtgcagctgggtggagtcggtgggggagtcggtggtacgnggtccggtcggggggtccctggacgtactctcctgtgcacgtcctcgtggtattactaaagttttagtgttactttttccaattaccgacgtttccggggtaccgtacgtaacggccgtaccggggggtaacgggtcggtgggtacggttgggtccttcgttacgtttaacttaaggtacggaacggtaccggtgtaccttaacctactactttctacgtcgacgtacgtacgtcgttaggtaccggaacgggtaccgttacgttacccacctacttccccgtacgaagaacgtaaaccaaccgtaaacctaacgttaccctaccgttagttacctcgtacgaactaacgtacgaactacgtgtaggtaaggtaacgtacggaacgacgtacggtaccggttactttacgttaaagttacgtttaacgggtcggaaaaccggtaaaaggggaacgggtaaaccgggtaacgggaacgggttaaacggtttaaccggggttaaaggggtttcccggggttaccgggtttaccggttttaaaccgggg

SEQ ID NO: 93907 - DNA, 831 bp, Homo sapiens
  misc_feature: GYAE6OF01DHLRQ.29.85.H08.1.454.CMB.1.raw
tcagatagagtactcacgaccggtgctcgatttagtatcactcagtcgcggggggggtctcaggaggcagcactctcgggacgtctccaccatggcctggctctgctcctcctcagcctcctcactcgagggcacgaggatccgtgggctcagtctgccctgactcagcctcgctcagtcggtccggtctccgtggacagtcagtcaccatcctcctgccactacggaaccaggcaaggcgtagtggtacggttaggttactaacgttttcgtccttcccgttacggttaaacccaaaccaaacccgtaaccccgaacggggacccgaaccccggggtaccccccccgaacgttacctaaacgttaaactttttaagacggtaacgttcgttactaaacgttaaaccggtcccgggtacccctaccggtaaccggggttccctacggacgttccgtccgtttcctcgttcggtaccgttaccctaacgttccgtacggtacctaaaccgccgtccgttcccctacccgtacgtaacccgtaccgttcccgttaccggtaccgggtcccgtaaccccgtaggggtacccgttaggtacccggtaagtttaccggggtaaccggtttataaacgttttaaccgttacgttagtccgttaccgtcgttacctttaacgtttcggaacccgtaccggtaccccgtacccgtacgtaccggttcggtaacgtaccgggtttccggtaacccggggtaacggggaacggtacccgtaacggtacccgtaccgtaccccggttacgtaacgggttcaccggtccttaccgaacccggg

SEQ ID NO: 93908 - DNA, 1113 bp, Homo sapiens
  misc_feature: GYAE6OF01BYPSS.29.85.H08.1.454.CMB.1.raw
  modified_base (286)..(286): a, c, t, g, unknown or other
  misc_feature (286)..(286): n is a, c, g, or t
tcagatagagtactcacgaccggtgctcgatttagtatcactcagtcggcggggggggtctcaggaggcagcactctcgggacgtctccaccatggcctgggctctgctcctcctcacgcctcctcacctcgacgggcacaggactccgtgggcttcgacgttcgtcgtcctcgtactcaccgtccgtcgtctcgtaggttcggtcccgggtctccggtacggactacgtcgtacgtaccaccttacgttcctaccgtcgaaccgtaacccggtaccggaaaaccncggtaccgacggtaaccggttacgggttacggggtttaccgggtttaacggttttaaacgtttaccgtttttccggttccccgttaccggttaacgtaaaaccccgtaaaaccgtaacccggaccccgggtaaccggggaacccccggtaccccccgggtaacccccccgtaagtttaaaccgttaaacgtttttaaacttttacgtaacgttaacggttttaccgggttaaccgttaaaccggttaacccggggtccccgttaaccggttacccggggtacccggggtttaccgttaccggttaccgttcccgtttaccgtttccggttacccggttaccggtaacctttaaccggttaccggttacggtaacccgtaaacccgtaaccccgtcccggttaacccgttaccccccgttaacggtaccccgttaacccgttacgtttacccccgggttagggtccccggttaacccgttacgggtaccgtaaccggttaccggggtaaaccgtttacgggttaaccggtttaacgggtttaacgtttaacccttttaacggtcccgttccggtttacgtttaccctttccggtttaacgtttccgggttaaccgtaacccgggtaacccccggttaccgttaaccccgtacgtttagggtaccccgggttagtttacccccggggtaccggggtttacccggggggaaacccgggtttaaaccggaccccggtttcccgggaaaccccgggtaccccgtttaaccccgggttttaaacgggcgttaacccccggggtactacccgggggttaaaccccgggtaaccc

SEQ ID NO: 93909 - DNA, 482 bp, Homo sapiens
  misc_feature: GYAE6OF01EUI7V.29.85.H08.1.454.CMB.1.raw
  modified_base (439)..(439): a, c, t, g, unknown or other
  misc_feature (439)..(439): n is a, c, g, or t
  modified_base (457)..(457): a, c, t, g, unknown or other
  misc_feature (457)..(457): n is a, c, g, or t
  modified_base (461)..(482): a, c, t, g, unknown or other
  misc_feature (461)..(482): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcaccccgcactcgtgtacgtcgtttcgggcggtaaggggacccaaaggcgtgacccggttccgtacggtcacgcgtcaacggtcctcggccccctcggtcctacgtccttcgttccccgcccttcctcctacgtacctcgtactcgtggacgcgggcnggctacgggctacgatgntgcnnnnnnnnnnnnnnnnnnnnnn

SEQ ID NO: 93910 - DNA, 739 bp, Homo sapiens
  misc_feature: GYAE6OF01D11UW.29.85.H08.1.454.CMB.1.raw
  modified_base (200)..(200): a, c, t, g, unknown or other
  misc_feature (200)..(200): n is a, c, g, or t
tcagatagagtactcacgaccggtgctcgatttagtatcactcagtcggcggggagctctgggagaggagccccagccctgagattcccaggtgtttccattcggtgatcagcactgaacacagagaacgcaccatggagtttggactgagtcttgggttttccttgttgcttagttttaaaagtgtctagtgtgaagtncgtagctggtggagtcgtgggggatcgtggtacaggccgtgggggtccctgacgactcgtcgtgtgactacgcctcgtagtacttacgtaaagttttaatggttaactttttccgaattaccgtacgttacggggttacccgtacgtaaacggtcccggtaaccggggggtaacggtcgttgggacggttcgggtccttacttacgttaattaagtaccggtaggtacgggttacgacctttaaccgttactaacgtttcctaagttcgaaccgtacggtaacccttgttacgggtaaggaaaccgggtcccggtaaactttccgaacccgttataccccgtaaccgaaggtaaacgaacctaaccgtaaaccttaacggttaccctacccgtttatactacgtacggaactaaagtcgaaactcgtactaggagtaaacggtcgtaacgaagtcgtacggtacttcttaagttagtaggtacgaagtaaaggaccggaagtcgaagtacgtagttaaggtcgggttcttaggttacgg

SEQ ID NO: 93911 - DNA, 526 bp, Homo sapiens
  misc_feature: GYAE6OF01BHJPF.29.85.H08.1.454.CMB.1.raw
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
  modified_base (263)..(263): a, c, t, g, unknown or other
  misc_feature (263)..(263): n is a, c, g, or t
  modified_base (375)..(375): a, c, t, g, unknown or other
  misc_feature (375)..(375): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccggtctcctggacngtcagtcaccntctcctgcactggaaccngcagcgagtgtggtgttatactttgtctctgtaccacaacnccagcgacgccccatccatattactgatgtactatacgccgtccgtcgacgggtcctgactcgtcttctcgtcgtctaccaagtctcggacacgctacgccctcctcgtacncgtcctcgtcggtctcgacgtcgtcgacgactcgacggtactagttcttacttgtcctagtcctctagttcgagacgccaaccgtcgactgactcgtcgttcggcgtacgggactacggacctcggaccgtctaggcctacgtgcgtacgg

SEQ ID NO: 93912 - DNA, 750 bp, Homo sapiens
  misc_feature: GYAE6OF01AHPYT.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagtcgttgggtttttccttgttgacttaattttaaaaggtgtccagtgtgaagtgcagcgtgggtggagtcggtgggggagtcggtaggtacgaggccggttggggggtcccctggacgaccgtcttccgtgtcgccgagtccctgtacggtattactaagttttaatcgttactttttaccattaccgtacgtcgggtcccgtacgaacggtccgtaccggggtaacggtcgtagggagttcgggttctctttacgttaagttaacgtcggtaacgtacgggttactaccgtaacttaacgtatttacctaatcgaccgtaagtaccttcggtaggtacggaacgggttacccgtaattcccaacctacttcctaaccgagaacgaaaccaaaccgaacgttaaacctacccgtccttaagtacgtactacggtaactaaagtacgaacgtagtaccgtaaggaaccgtaaggtacgaacccgagaccgtacggttactttacgtaacgtttagttacgtaagtaaagaaaagggtaggaaacggtaggaacggttaaacgttacggtaaagggttccgggttacgttacggtttaaccgg

SEQ ID NO: 93913 - DNA, 780 bp, Homo sapiens
  misc_feature: GYAE6OF01ET6C3.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcgttgggttttccttgttgcttaatttttaaaaggtgtccagtgtgaagtgcagcgtggtggagtcgtggggagtcgtgtacaggccgtgggggtcccagacgactctcctgtgcggtcctgtggtaatttaaggtttaggagtacagtcgcctagtcgaacgttcggggtccgccgaggtccgtccggaaggggaacggggtctggggtaacgggttgggtccgttcgggactttaagttaggtggactagggttgggtgggccgtacgtattaagttagttagtcgacgaacggacccgtcccggttagggaacggggtcccgttaccaaccgtttactttacccgaaggtaacgtaactaaacggttaccgaaagtaacccacggtccttaggtaacttccgtaagactaaaggttgggaactacggtaccctaggaaccgtaccgtaacccggaccgtaacccgtaccgggttcccgttatttaacggtttacgtttagggttaaacggttaacgggtcggaaacggtccgggttaagggtaaaacccgggttaccccgggggaccccgggggtacccccgttaacggtttcccgggaaccccggtaaccggggttacccgggggg

SEQ ID NO: 93914 - DNA, 584 bp, Homo sapiens
  misc_feature: GYAE6OF01BDB6P.29.85.H08.1.454.CMB.1.raw
  modified_base (224)..(224): a, c, t, g, unknown or other
  misc_feature (224)..(224): n is a, c, g, or t
  modified_base (295)..(295): a, c, t, g, unknown or other
  misc_feature (295)..(295): n is a, c, g, or t
  modified_base (513)..(513): a, c, t, g, unknown or other
  misc_feature (513)..(513): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataacttgtctcgtgtaccaacaccaccaggcgacgcccccgatcattaattangactgtcagttacgcgcctcgacgggtcctgactcgtcttctcgtcggcctaccgtaagtcgtacggaccaacgtactcggccccttcccgtggtaccctacgtccgttcgtacgggtcctacccgaacgggtcctacggaacggtacgtcggaacggttagtactttacttacgtgtcctgtcttactagttcgacgacggtacccaccgctacgtntcgtactccggttcggcggtacgggacctaggcctacgtaccgtcgtacggtccacgtccgtacgtaccgg

SEQ ID NO: 93915 - DNA, 706 bp, Homo sapiens
  misc_feature: GYAE6OF01BBMWC.29.85.H08.1.454.CMB.1.raw
  modified_base (181)..(181): a, c, t, g, unknown or other
  misc_feature (181)..(181): n is a, c, g, or t
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (236)..(236): a, c, t, g, unknown or other
  misc_feature (236)..(236): n is a, c, g, or t
tcagatagagtactcacgaccggtgctcgatttagtatcactcagtcggcggggggggtctcaggaggcagcactctcgggactctccaccatggcctggctctgcctcctcctcacgcctcctacactcgagggcacgaggctccgtgggctcagtctcgccctgactcacgcctcgctnacgtcgtccggtctcgtggacngtcagtccactntcctctgcacgtcggaaaccngccagcgtagttcggtacggttagttaacttacgtttcgtcctaccgtacgaacctaaaccaaccgtaccgacggacccggacccggtacccccgtagtacctaactttaacgtttacgtgtacgttcgtacgtaacgtacggcccgtaccgtcggtacggtcctgactcgtcttcgtcgtcgtacctacgacgtcgtacgacaactccgtaccgtcctaccacgtacctacgttccgtacgtcggtcctacggacgtcgtaacggacgtacgtacggtacgtattaacgttctagtcgtacgtcgtccgttatacggttccgacgttaccggtacccaccgttaccgtacgttacggtacgttaccgggtttccgggtaccgggacgggtacccgtaaccggtcgggtcccgttaacggtcccggttacggtacccgtagtaacccggtcgtttaacccggaccccggg

SEQ ID NO: 93916 - DNA, 881 bp, Homo sapiens
  misc_feature: GYAE6OF01BKLQS.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcgttgggttttccttgttgacttaattttaaaaggtgtccagtgtgaagtgcagctgggtggagtcgtggggggagtcggtagggtacgacggtcccggtcgggggggtcccctaggacggtaccttacccgttcccgtggttacgccgtaaccgtcccgttacggttcgggtaactttaccgttaaaaggtttttaacgtacggtttaacttttttacccgaacttaaccgtaccggttcggggttacccgtaccgtaaacggtcccgggttaccggggggaagggttcgttaggggtacgggttcggggttccttacgttaacgttttaagttaaacgttacgggtacgggtaaccgggttacgtacgttaaccttaaccgtaactttaccgtacgtacgtacgtaacgtaccgttcgtaggttacgggaacgggtccgtaacttaccgtaacctaccgtaccgtaccgtaacggaaccgaaccaaaccgtaaaccgtaaccgtaacccttacccgttagttaaccgtccgtacgtaactaaagtaaccgaacgtaagtaccgtaggtaaacggtaagtacggaaccgtacgacgggtaccgtactttacgtttaacgtttagttacggtaaggtaaaccggaaaaggtaacggaaacgggtaacggtaacgggtaacggttaacggttaacggggttaccgggttccgggttacggtttaacccgggg

SEQ ID NO: 93917 - DNA, 740 bp, Homo sapiens
  misc_feature: GYAE6OF01EHPO9.29.85.H08.1.454.CMB.1.raw
tcagatagagtactcacgaccggtgctcgatttagtatcactcagtcgcggggagctctgggagaggagccccagccctgagattcccaggtgtttccattcggtgatacagcactgaacacagagacgcaccagtggagtttggactgagtcgttgggttttccttgttagtacttaagtttttaaaggtgtccaggttgtagaagtgcagcgtggtggagtcggtggggtagtcgtaggtacgacgtccggttacgggggtccctggactaccgttccgtcgtgtgccgtacgtccgttctggtacttacgtaaagtttatgttactttttaccactacgtacgttcgggtaccgtacgtaacggtccgggtacccgggggtaaggttccggtagggtacggtttcgggttaccttacgtttactttaagttaactacggtaacggtacggttacgaccttactacgtacttctagtcgactaagtaccttgtaggacggtacgggaccgttactaccgaacctactcctacgaagtacaaacaactaacgtaaccgttaccgtccgttacgtactactacgaacttaacgacgtaactgttactaaggtaggaagtaacgacgaacgtacggacgttacgtttacgttattacgttaggtaaacgtaaacggaaaaaggtcggaaaggtacgtaagtacgttaacgggttaggtacgggtttcgtacggtttaacgg

SEQ ID NO: 93918 - DNA, 660 bp, Homo sapiens
  misc_feature: GYAE6OF01BSBK8.29.85.H08.1.454.CMB.1.raw
  modified_base (319)..(319): a, c, t, g, unknown or other
  misc_feature (319)..(319): n is a, c, g, or t
tcagatagagtactcacgaccggtgctcgatttagtatcactcagtcgcggggggggtctcaggaggcagcactctcgggacgtctccaccatggcctgggctctgctcctcctacagcctcctcactcagggcacaggatcctgggctcagtctgccctgactcagcctcgctcagtcggtccgggtctccgtggacagtcagtccacctatcctcctgccacgtggaaccagcagcgatcggtcggtgttaatacgtttgtctccgtaggtaccaactaacaccgaggccgaccggcccccgactcaacttaacttntacgtagtgtactaagttacgccgtcctcgacgggtcctgactcgtcttcgtcgtcgtctaccgaacgtcgtcggacctaaccgtactccggtccctacccgtacgaccctcttaccgtccggtcggtcctcccggacggtctacggaaccgtagtcggtacggttacgtacgtttacgttacgttacgtccttcgtccttacgttacgtttacgccggtaacggtcccacccgtacctaacgtttcgtacgttacgtccggttccggggacgggaaccggacgtacggccctacgggtacccgtaccgtacggtccgtaacgtcccgtaacgtacccggg

SEQ ID NO: 93919 - DNA, 711 bp, Homo sapiens
  misc_feature: GYAE6OF01A83DF.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggttttccttgttgcttaattttaaaggtgtccagtgtgaagtgcagcgtggtggaggtcggtgggggagtcgtggtacgaggccggttcggggggtccctggacgaccttcgttcccgtgtcgcacgtccctcgtaggtattacgtaaagtttaactacgttactttttaccaattaccgtacgttccggggtaccgtacggtaacgggttccgggggaaggttcgtgggtaggttcgggtcttacttattaacgttagtcggtacgtacgtcgtactaacgtactattactagtcgacagtactgtaggtaggacggtactacttcaactacgtcctacaagaacgaaaccaaacctaacgtaaacgtcccttaccgttagtactaccgtagaactaacgtacaacgtagtacgtaaggaagtaacgtgtaaaccgcggtagtaccgttacgttactaagtttcgtagtaacggtaaacggaaagtaacggacggaccgtaaaggtacgttaacggttaggggtaccggttacggttacgttaaccggtaaccgg

SEQ ID NO: 93920 - DNA, 642 bp, Homo sapiens
  misc_feature: GYAE6OF01BLG29.29.85.H08.1.454.CMB.1.raw
  modified_base (236)..(236): a, c, t, g, unknown or other
  misc_feature (236)..(236): n is a, c, g, or t
  modified_base (329)..(329): a, c, t, g, unknown or other
  misc_feature (329)..(329): n is a, c, g, or t
  modified_base (467)..(467): a, c, t, g, unknown or other
  misc_feature (467)..(467): n is a, c, g, or t
  modified_base (586)..(586): a, c, t, g, unknown or other
  misc_feature (586)..(586): n is a, c, g, or t
tcagatagagtactcacgaccggtgctcgatttagtatcactcagtcgcggggggggtctcaggaggcagcactctcgggacgtctccaccatggcctggctctgctcctcctcagcctcctcactcagggcacaggatcctgggctcagtcctgccctgactcagccctcgctcagtcggtcccggtctccgtggactagtcacgtcacctatcctcctgctaactcggaaaccngacgacggcgtaatcggttcggtagttaacttaacttcgtcctcgtacgtaccaacaccaccgaggccgaccgcccccatactaattaattanagatcgtactaagtacgcccgtccgtcgtaccgggtcctagtacgtcgtctccgtcgtcggtactaccgtacgtcgtacgacctacaccgtctacccgtctacgaccctatccgtcgtacgtcctaccgaggcgttanaccgtagtcggtaacgtcgtaaattcttacgcgtactgtcttacctgtaccgacggaccggacctccgtacctaggttcgtaacgtccgttccggttacggggaccgacggtaaacccncggtaccggttaaccctacgggttcccgaggtaccacggtaaccggacgtacccgg

SEQ ID NO: 93921 - DNA, 558 bp, Homo sapiens
  misc_feature: GYAE6OF01CG426.29.85.H08.1.454.CMB.1.raw
  modified_base (313)..(313): a, c, t, g, unknown or other
  misc_feature (313)..(313): n is a, c, g, or t
  modified_base (351)..(351): a, c, t, g, unknown or other
  misc_feature (351)..(351): n is a, c, g, or t
  modified_base (390)..(390): a, c, t, g, unknown or other
  misc_feature (390)..(390): n is a, c, g, or t
  modified_base (467)..(467): a, c, t, g, unknown or other
  misc_feature (467)..(467): n is a, c, g, or t
  modified_base (548)..(548): a, c, t, g, unknown or other
  misc_feature (548)..(548): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatccgtgggctcagtctgccctgactcagcctcgctcagtggtccgggtctcctaggacacgtcagtcaccatctcctgcacgtacggaaccagcaggtcgaattggtcggtacggttataactttgtcttcgtagtaccaacaacaccaggcgacggcccccatcattattangatgcattaagcgcctcgacgggtcctgactcgcttcncgtcgactaccgaacgtctaggaccaacactcgcctccngacctatctcgtcgggctccgaggtcagacgtgtacggtacggttataactttaacttaccgtggtcttcgaccttnttagttacgcgacggcctaccgctagtgtcgtactcggttcgggaggacggaccatccgagaacccgtcctaaggcaacgngtacgaccgg

SEQ ID NO: 93922 - DNA, 561 bp, Homo sapiens
  misc_feature: GYAE6OF01C5Q34.29.85.H08.1.454.CMB.1.raw
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
  modified_base (288)..(288): a, c, t, g, unknown or other
  misc_feature (288)..(288): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctagccctgactcagcctcgctcagtgtccgggtctcctggacagtcagtcacatctctncactggaaccngcagcgatggtcgtgttatactttgtctctgtacaacacaccagcgacgcccactcatattatgntgtacattacgcgcctcgacgggtccctgactcgtccttctcgtcggtctactaagtcgtacggctaaacacgttcgccctccctcgacctactccgtcgtcgggtcctcccgacggcgtacgacgtactcggaacggttatacgtttactttactcgtactgtccttacgtactttacgccgacggtcccaccgtctacgttgtcgtacgttccggtccggacgggacggacctagccgttcgaccgttcacgggtcacgtcgtacgaccgg

SEQ ID NO: 93923 - DNA, 690 bp, Homo sapiens
  misc_feature: GYAE6OF01B50FA.29.85.H08.1.454.CMB.1.raw
  modified_base (249)..(249): a, c, t, g, unknown or other
  misc_feature (249)..(249): n is a, c, g, or t
  modified_base (677)..(677): a, c, t, g, unknown or other
  misc_feature (677)..(677): n is a, c, g, or t
tcagatagagtactcacgaccggtgctcgatttagtatcactcaggtcgcgggggggggtctcaggaggcagcactctcgggacgtctccaccatggcctgggctctgctcctcctcagcctcctcactcgagggcacaggctccgtgggctcagttctcggccctgactcacgccctcgcctcgaggttcggtccgggtctccgtggacagtcagtccaccgtatcctctgacctacgtacggaaccngcgaggacgagttcggtcggttagttaacttaacgttttcgtaccttaccgtacggtaaccaaaccgaaccgaccgacggacccgaccggaccccctacgtactaattactttacgacgtattacggtactaaggttacgcccggtccgtcggtacgggttaccctagtacgtccgtcttacgtcgtcgccgttaccgaaggtctacggacctaacgtccgtccgacccgttaccgtacgtaccctgttacccgtcggtccggtaccgtacggacggtctacgggacgtacggtaggtaccgttagtaaccgtttcgtacgtacgttcacggtcttacgtagttcgaccgtaccgtaccgtacgtcgtagtcgtacgtacgtccgggtacgggacggtagaccgaggtctaccgtcggttcgacgtancgcgtacctacgg

SEQ ID NO: 93924 - DNA, 718 bp, Homo sapiens
  misc_feature: GYAE6OF01DVD86.29.85.H08.1.454.CMB.1.raw
  modified_base (445)..(445): a, c, t, g, unknown or other
  misc_feature (445)..(445): n is a, c, g, or t
tcagatagagtactcacgaccggtgctcgatttagtatcactcagtcgcggggggggtctcaggaggcagcactctcgggacgtctccaccatggcctgggctctgcctcctcctcagcctcctcactcgagggcacgaggactccgtgggctacgacgtcctcgccctagtactcgacgtcctcgctcgtacggttcggttccggtctccgtaggaactggtactacgtaccacctactcctccgtagacctacgtacggaaccacgacgacgacgtacgttcggtacggttacggttacttaacgtttcgtccttaccgttacgtaaccaacgaccgaccggaggaccgacccggtaccccgtactacgtaactttaacgttactagtactagtaactacggttacgacccggtaccgtcgaccggttccgcgtacgtccgtnttccggtactcgaccgtacgtaccgtcgtaccgactacgtaccgtcgtacccgtaccgtcgtaactccgtacgtaccgtcggacctcgcggtactcggacgttacggtacggttcgtacttaagtttacctacgtcggtacctggtaccttacggttagtccgggactccgacccgacgtgttaacgtcgtcgtacgttcgggccggaaccgggtacaccggtgtacccggtccgtaaccgggttcgaccgtaccaccggtcgtccggtacgg

SEQ ID NO: 93925 - DNA, 791 bp, Homo sapiens
  misc_feature: GYAE6OF01EES90.29.85.H08.1.454.CMB.1.raw
  modified_base (620)..(620): a, c, t, g, unknown or other
  misc_feature (620)..(620): n is a, c, g, or t
tcagatagagtactcacgaccggtgctcgatttagtatcactcagtcgcggggagctctgggagaggacgccccagccctgagacttcccaggttgtttccattcggtgatcagcactgaacacagagaacgcaccagtggtagtttggactggagtcgttgggttttccttgttgtacttaagttttaaaaggtgtcctaggtgtagaagtgcgagtcggtgggtggtacggttcgggtaggggggtacgtcgggtcggtacgtacgggtccgggttcggggggtccctaggacgtacctccgttaccgtggtcggctacgtcccgttacgtaggtaactttaacgttaaagttttaattcgtttaacttttaccaacttaccgtacggttcgggtaccgtacgacgggtccgggtaccgggggtaaggtcggtagggtacgggttcggttcttacttattaagttaaggtcggacggtacgtagtacctaacttactattctagtacgcgaacgtcgtgtcggtaacgggtacggtacctacgttaccaaccgttactaccacgaaacgacaaaacaaaccgtaataaccgttaccctcttacgtaactcgtaactanaaacggtacaacgttaacgtacgaaggtaacggtaagtacgaccggacgtcggttacccggttacttaacgtttagttagttaagtaaccggaaaaaggaacgggtacggaaacggtggtaaaacggtgttaaaccgggtaggggttacccggtcgttaggttaacccggg

SEQ ID NO: 93926 - DNA, 473 bp, Homo sapiens
  misc_feature: GYAE6OF01EYKFP.29.85.H08.1.454.CMB.1.raw
  modified_base (278)..(278): a, c, t, g, unknown or other
  misc_feature (278)..(278): n is a, c, g, or t
  modified_base (312)..(312): a, c, t, g, unknown or other
  misc_feature (312)..(312): n is a, c, g, or t
  modified_base (334)..(334): a, c, t, g, unknown or other
  misc_feature (334)..(334): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
  modified_base (460)..(473): a, c, t, g, unknown or other
  misc_feature (460)..(473): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatggtcggtggttataacttttgtctcctggtaccaacaacacccaggcgacggcccccccatcataatttatgatgtcattaagcggccctcgagggtccctgatcgcttctctggctccaagtctggcaacactgcctccctgaccatctcnggctccaggctgacgatgacggtgattacttacngctgctcattgcaggcacccgnactgtgatcttcggcggaggaccagctcgaccgtcgagtcagctcgaagctcgcccctcgcactctcgtcccnccctcctcngtactctactcgtagacgccggctcggacaacggcgcagtacgnnnnnnnnnnnnnn

SEQ ID NO: 93927 - DNA, 861 bp, Homo sapiens
  misc_feature: GYAE6OF01AMJBZ.29.85.H08.1.454.CMB.1.raw
  modified_base (252)..(252): a, c, t, g, unknown or other
  misc_feature (252)..(252): n is a, c, g, or t
tcagatagagtactcacgaccggtgctcgatttagtatcactcagtcgcgggggagctctgggagaggagccccagccctgagattcccaggtgtttccattcggtgatcagcactgaacacagagaacgcaccagtggagtttggactgagcgttgggtttttccttggttgactttaagttttaaaaggtcgtccaggtgtggtaagtgcgagcgtgggtggagtcggtggggggtagtcggtcggtacnggtccggttcggggggtccctggacgtcctcctccgtaggtcgacgacgtccctcgtaggtatttaccgtaagtttaagtgtttaacttttaccgacttacgtaccggtttcgggtaccgttaccgaacggtccgggtaaccgggggtaagggttccgtaggggtagggtttcggggttacctttcgtttacgtttaacttaacggtcggtaacggtaccggggttctaaccgttaactacttacgttacttagtacgaacgtaccgttacgttggttacggtacgggtaaccgggccgtttaatccccgaaccttccgttacctacggaacgtaacgtaaccaaaactaaaccttaaacggttcccctaaccttgtacgttaccgtaaagaaccgttaacgaacggttaaactcgggttaacgtaaggtaaagggttaccgggtacgaacccggtacgacggggtttaccctttacgttaacttagttttaacggttcgaaaacgggtaaaacgggtaaaaggtaacgggaacgggtcggttaaaggggttaaacgttaacgggtttaacgggggttcgtttaaccggggttccggtttaaaccgggg

SEQ ID NO: 93928 - DNA, 662 bp, Homo sapiens
  misc_feature: GYAE6OF01D9VIJ.29.85.H08.1.454.CMB.1.raw
  modified_base (233)..(233): a, c, t, g, unknown or other
  misc_feature (233)..(233): n is a, c, g, or t
  modified_base (312)..(312): a, c, t, g, unknown or other
  misc_feature (312)..(312): n is a, c, g, or t
  modified_base (382)..(382): a, c, t, g, unknown or other
  misc_feature (382)..(382): n is a, c, g, or t
  modified_base (406)..(406): a, c, t, g, unknown or other
  misc_feature (406)..(406): n is a, c, g, or t
  modified_base (434)..(434): a, c, t, g, unknown or other
  misc_feature (434)..(434): n is a, c, g, or t
tcagatagagtactcacgaccggtgctcgatttagtatcactcagtcgcggggggggtctcaggaggcagcgctctggggacgtctccaccatggcctgggctctgctcctcctcagcctcctcactcagggcacaggatcctgggctcagtctgccctgactcagcctcgctcaggtcgtccgggtctccgtggacagtcagtccaccatcctcctgaccacgtcggaaccngcagcgatgtcgtgttatacgttgtctctacgtaccaacaaccaccacggccgaccggccccccgatcaattaatttangtatgtactagttaacgccggtacctcgtacgggtccctgtactcgtcttctcgtcgcctcgtaacgtcncggacactcgtccgtcctcccgtnaccctagtcccgtcgtcggcctacccgnggtactcggacgagttcggaaccggttagttatttaacgttaccgtggtaccgttacgtccttacgtacgtttcgaccgtaccgggaccctaccccgagtaacggttcggtacgttaccggtcggttacccggggaccgggtaacccgggacgtacccgggtaccgttacccggtaccccggttaccgttaacgggacccgtacggttccgtaacccggtaaccccgg

SEQ ID NO: 93929 - DNA, 829 bp, Homo sapiens
  misc_feature: GYAE6OF01A1EHY.29.85.H08.1.454.CMB.1.raw
  modified_base (147)..(147): a, c, t, g, unknown or other
  misc_feature (147)..(147): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacagggatcccgngggacctcagttctgccctagacctcacgtcctcggcctcgaggtcgtcccgggtctaccgtcggactacgtcaagtaccaccctattcctcctaggcctaaccgtcggaaaccctggccgaacgtacggatttcgggtacgggttcggtttaactttaaccgttttggtcccttccggtacggttaaaccaaaaccgaacccgtaacccgtacggaccggaccccggtccccccgaactaccgtaagttaactttaactgtaacttcggtactaacggttaaggccgtacccgtcggttaacggggtccctggtaaccttcgtaccgtttcgtacgttcggaccgtacctacggtcccgtacgaacgtaaccctacgttaccgtaccccgttacccgtacgtaaccccgtacgtttacccgttaccggtttccggaccgtaccccgtaacgggtccttaaacgggaccggtaaggtacgggaaccggtttacggtaaccgttttacgtttaactcccggtgtttaacgtccgtttacggtacgtttccgggacccgtaaccgcccggtttaccccagtacgttcgtacgtaccggtaccgttccggggaaccggttgggaacccgcggttacgtacccgttcgtacggtacggtacgttaccgccgtttggtaaccccggg

SEQ ID NO: 93930 - DNA, 732 bp, Homo sapiens
  misc_feature: GYAE6OF01E4O21.29.85.H08.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
tcagatagagtactcacgaccggtgctcgatttagtatcactcagtcgcggggagctctgggagaggagccccagccctgagattccccaggtgtttccattcggtgatcagcactgaacacagagaacgcaccatggagtttggactgagctgggttttcctgttgctattttaaaaggtgtccagtgtgaagtgnagcgtggtggagtctgggggagtcgtggtacngccgtgggggtccctgacgtactctcctgtcgcagcctctggattctaagtttatgtacttttccattacacgttggtaccgtcgaagtcgtccggggaaggtccgtgggtacgttgggttctccgttagtttaattaacgtacggtacgtaccggttgaccttaacgtactacgtttctaacgtcgacaacgtaccgttcgtggtacggtaacgggcccgtattcccaccgtacgttcctaccgaacgtaacaaacccgaaactaaccgtaaacgttacccgtacccgtttacggtaacgttaccgtacgtaactaaaacgttacgtaaacccgtaggttacccgtaaggtaacggtaaacggttacgaaacccggtaaccgtaccgggtaccgttaccgtttactttaaagttaagttacgggttagaaaccgtaaaaggaacgggacggaaccgtaacggtaacgttaccgttaagggtccgggtcgttacgggttacgg

SEQ ID NO: 93931 - DNA, 802 bp, Homo sapiens
  misc_feature: GYAE6OF01BS5W0.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagacgcaccagtggtagttggactgagtcgttcggttttctgttgtacttaagtttaaaggtgtactagtgtagaagtgcgagtcgtgggtggaggttcggtggggtacgtcggtacggtaacgcggtcggttcgggggtccctaggacgtaccgtccgttccgtggtacgcgtacgtccgttcgtaggtaacttaccgttaagttttaacgttacggtttaactttttccgaactttaacccggtacggtttacccggggttacccgtacgtaaaccggttcccggggtaaccggggtaagggtttccgtaggggttaggttcccggggttattaccgttaccgtttaagtaaccgtcggtacggttacggtacgtacttacgttataacgttctagcgtacgtacgtacgttcgtaggtaacggacgggccttacgtaccaccgttatacccgagaaacgtacaaccaaagtaaccgtacttcccgtacggtatacggttaccactaagttaacctacgtagtccttaaggccggaaagtaccgaacggacgtaccggaaggtttccgaactttcgttaaacgtttacgttacgaccggtaaaagtaaccgggttagaacgtccggtaacggtaattttccggaaaggggttcggttaacggtttcccggtaaacgg

SEQ ID NO: 93932 - DNA, 586 bp, Homo sapiens
  misc_feature: GYAE6OF01B0FJ9.29.85.H08.1.454.CMB.1.raw
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (401)..(401): a, c, t, g, unknown or other
  misc_feature (401)..(401): n is a, c, g, or t
  modified_base (414)..(414): a, c, t, g, unknown or other
  misc_feature (414)..(414): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatcctcctgcactggaaccagcagcgatgtcgtgtatacttgtctctcgtacaacacaccagcgacgccccactcatattangtatgtanatagcgcctcgacgggtcctgactcgcttctctcgctacacgtctcggacacncgtcncctcccgtacacctcgttcctcgtcggtcctccgaggtctaggacgngtacggtacggtnttatttacttacgtgtccgtgtccttgtacgtttcgaccgtccggtaccccacccgtccgtacgttacggtcgttacggttacccgggttcgggaccggggtaccgaccccggtaggtcccgtaccggttacccggttccgtaggtacccgtacggcgttcggaaccccggg

SEQ ID NO: 93933 - DNA, 695 bp, Homo sapiens
  misc_feature: GYAE6OF01E4I2I.29.85.H08.1.454.CMB.1.raw
  modified_base (225)..(225): a, c, t, g, unknown or other
  misc_feature (225)..(225): n is a, c, g, or t
  modified_base (326)..(326): a, c, t, g, unknown or other
  misc_feature (326)..(326): n is a, c, g, or t
tcagatagagtactcacgaccggtgctcgatttagtatcactcagtcgcggggggggtctcaggaggcagcactctcgggactctccaccatggcctggctctgctcctcctcagcctcctcactcagggcacaggatcctggctcagtctgccctgactcagcctgctcagtcgtccggtctccgtggacagtcagtccaccatcctcctgctactcggaaccngcagcgtatggtcggttagtacttaacgttcgtctaccgtacggtaaccaacaacctacccgacggaccggaccggccccccgatactaacttaactttangtatacgtactaagttaacggccggtaccctacggtacggggtccctaggtacttccgtcctttccgtcgtacggtcctaccgtaacgtccgtacggacctaacctacgtccgtacccttcccgacgtacccacgttccgttccggtacgggtccttaccggacggtcctacggtaacgtcgttacggtacgttacgttaactttaccgttaacgtcgtccgtacgtcctaacgttacgttcgaccgtacgtacccgacccgtacgtccgttacgtacgtaccggttcggtaccgggaccggtacggaacccgtacgccgttaccgaccccggtttactaccggtcctacgtcccggtacgtaccccgg

SEQ ID NO: 93934 - DNA, 805 bp, Homo sapiens
  misc_feature: GYAE6OF01D8APQ.29.85.H08.1.454.CMB.1.raw
tcagatagagtactcacgaccggtgctcgatttagtatcactcagtcggcggggggggtctcaggaggcagcactctcgggacgtctccaccatggcctgggctctgctcctccctcagcctcctcacctcgagggcacaggactccgtgggctcagtctgccctgactcagcctcgctcagtcgtccggtctcctggacagtcagtcaccatctcctgctacgtggaaccagcgacgcgattcggtcggttaggtttaactaacgttttcgtcctccgtacggtaacccaaccgaaccaccccgaggccggacccggtccccccgataccgtaatttaaagtttacgtacgtactcgtacgtaagttttaaccggccgggtcccctaccgggtacgggggttccctaaggtaccgtttccggtcctttccgtacggttccggtaccctacccgtaacggttccgtacggaacctaaccgtaccgtcgtacccccttccgtaccgtaccctacgtttacccgtccgtccgggtacccttaccggacgggtcctacgggtaacggtaacgttcgggtaacggttacgttaacgtttacgtaccgttcgttcctacggttccgttacgttaacgttcgggacccgtaaccgggtccccaccccggttaccgaacggtttcgtaacgggttaccggttccggttaccgggggaaccgggtaaccggaccggtaaccggtcccggtaacgggttaacccccgggtccggttaacggttcccgaaccggtcccggtcgggtaaacccccg

SEQ ID NO: 93935 - DNA, 811 bp, Homo sapiens
  misc_feature: GYAE6OF01CGPBG.29.85.H08.1.454.CMB.1.raw
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgacgggcaccaggacttccgtgggcctcgacgttccgtcggacccctgacctccgacgtccctcgcctctacggtcgtccgggtctccgtggacacgtcagtccaccattccncgtgctacgtacggaaccngctagacgtagtcggtacggttaggttacttaccgtttgtacccttaccggtaacggttaacccaaacgtaaccgacccgtacggacccggacccggaccccccgtaactaccgtaacttaacgtttacgtacgtactacgttaacgtacgttaaccggcccggtaccccgtacgggtaccgggttacccgttagaccgttccggttccgttccgttccggtccggttaacccgttacccggtaaaggttccgttacggacgtaaacccgtccggtcccgtaccccgttccgtaccgtacccttacgtccgttacgggccgttaccctccggacggtctacgggacctacgggttccgtaagtacgtaactttacgtcgtacggtcctaacgtgtttaccgtaggttccgaacgtcgaccccgtacctacggacgttggttaccgaccggttcgggtaccggggaccaacgggtaccctcccggggtacgtttaacccggaacccgggttcgtaaccggttactacccgggtacgtaccggtaccccgggg

SEQ ID NO: 93936 - DNA, 752 bp, Homo sapiens
  misc_feature: GYAE6OF01BMM9I.29.85.H08.1.454.CMB.1.raw
  modified_base (152)..(152): a, c, t, g, unknown or other
  misc_feature (152)..(152): n is a, c, g, or t
  modified_base (200)..(200): a, c, t, g, unknown or other
  misc_feature (200)..(200): n is a, c, g, or t
  modified_base (273)..(273): a, c, t, g, unknown or other
  misc_feature (273)..(273): n is a, c, g, or t
tcagatagagtactcacgaccggtgctcgatttagtatcactcagtcgcggggggggtctcaggaggcagcgctctggggacgtctccaccatggcctgggctctgctcctcctcacctcctcactcaggcacaggctcttgggcccagtcngccctgattcagccctccctcgtgtccggtctcctggacagtcagtcncatctcctgcactgaaccagcagtgattgtgagtaattatgactgtcctccgttcgtaaccaacaaccaccanacactacgtaccaacaacaactagtagtactactaacaattcggtaactaacgttacccgtccgggtccccttacgggtaacggggtccccttaaggtctttaccggtttccgtccgttcgggaccctttccgtaaacggtttccgtacggtaacgtaacgttcccgggcccggtaccccttaccggaacgtttacccgaccccgttaaccgtttccgttacccggttaccgggtaaccccgtttcccggaacgggttccgtacgggaaccgggtacccggtaggtacccgttaaggttacgttttaacgggtaacttcgttccgttacggtacccttaagtacttaaacgttacgttaacggtctacggttacgtaccgttaacggggtttaccgggttacggtcggtaacgggtacgtaacccggtgtacccgtcggtacccgtcggttacggaccgtccggacccgtaggtccccg

SEQ ID NO: 93937 - DNA, 739 bp, Homo sapiens
  misc_feature: GYAE6OF01EE2KS.29.85.H08.1.454.CMB.1.raw
  modified_base (232)..(232): a, c, t, g, unknown or other
  misc_feature (232)..(232): n is a, c, g, or t
  modified_base (473)..(473): a, c, t, g, unknown or other
  misc_feature (473)..(473): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggactcctggctcagtctcgccctgactcagcctcgctcagtcgtccggtctccgtggacagtcacgtcaccatcctcctgctacgtacggaaccngcaggacgagttcggttcggttagtttaacgttaacttttcgtaccttccgttacgtaacccaacctaaccaccccgacggccggaaccccggccccccgtataccgtaacttaagttttacgtgtacgtcgtaccttaaggttaaaccggcccggtaccccgttacggtaccgggtcccgtagtaccgttccgtacgtttccgtacgtccggtctaccgtaacggttctacggactaacncgttccgcccttcccgtacgaccgtacttccgtacgtccggtcctaccgaccggtacgtacgtaaccggactttacgggaacgttagttaacgttacgttacgtcgtccgtactcttacgtgttaccggcttaaccggacccaccgttacgacggttgttacgttaccgtcccgggtttacgggaaccgggaacggtaccgaaccgttccgtacgggttaccccgttcggtaaacgtcccgaacgttcccgtaacgggtaacccgg

SEQ ID NO: 93938 - DNA, 150 bp, Homo sapiens
  misc_feature: GYAE6OF01CBSTQ.29.85.H08.1.454.CMB.1.raw
  modified_base (149)..(150): a, c, t, g, unknown or other
  misc_feature (149)..(150): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcgggctggcaaggcgcatgnn

SEQ ID NO: 93939 - DNA, 763 bp, Homo sapiens
  misc_feature: GYAE6OF01BDYHF.29.85.H08.1.454.CMB.1.raw
  modified_base (290)..(290): a, c, t, g, unknown or other
  misc_feature (290)..(290): n is a, c, g, or t
  modified_base (717)..(717): a, c, t, g, unknown or other
  misc_feature (717)..(717): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagtcgttcggttttccttgttgtcttaagttttaaaaggtgtcctagtgtgaagtgcagcgtggtggtagtcgtgggggtagtcggtggtaccgaggtccggtgggggtaccctggtacgtaccttccgtccgtgtcgaccncggtcccttcgtaggttaacttacgttaaagtttaacttgtttactttttaccgaacttaccgtacggttacggggttacccgtaacggtaaacggtcccgggttaccggggggtaacgggttcggtcggggtacgggtttcggggtttaccttacgtttacgttttaaacgtttaacgttacgggtaacggtaccgggttacgtaccttaaccgttacttaactttacctacgttagaccgtagtaccttcgtacggtaggaacggcgttataccgaaccgttatacccgtaccaagtaacgaaaccaaaacgtaacgtaaccgttacccgttctaagttctaccgtagaactaaacgtgaaacgtgtagaggaagtagtacgacgagtacgtgtacttattattagtgtacgaaaggtaaacggngtaaacggacttaaggtactaggtaggtacggtcgttacggtacgg

SEQ ID NO: 93940 - DNA, 712 bp, Homo sapiens
  misc_feature: GYAE6OF01DGU4O.29.85.H08.1.454.CMB.1.raw
  modified_base (117)..(117): a, c, t, g, unknown or other
  misc_feature (117)..(117): n is a, c, g, or t
  modified_base (367)..(367): a, c, t, g, unknown or other
  misc_feature (367)..(367): n is a, c, g, or t
  modified_base (694)..(694): a, c, t, g, unknown or other
  misc_feature (694)..(694): n is a, c, g, or t
  modified_base (706)..(706): a, c, t, g, unknown or other
  misc_feature (706)..(706): n is a, c, g, or t
  modified_base (708)..(708): a, c, t, g, unknown or other
  misc_feature (708)..(708): n is a, c, g, or t
tcagatagagtactcacgaccggtgctcgatttagtatcactcagtctgccctgactcagcctcgctcagtgtccgggtctcctggacagtcagtcacatctcctgcactggaaccngcagcgatgtcggtgtactacttgtctctgtaacaactacaccgaggcgaccggccccgtatacgtaacttaattactgtacttcgtacgaagttacggccgtaccgtcggtacggggtcctaggtactcgtcttcgtacgtcggtcctacgtacggtctcgggaccaaacgtccgtccggtccctaccgtacgacctacttccgtcggtcggtctaccggaggtcaacggtcggtagtacgggacgttntaacgtttacgtctacgtcgttacgtcctagtcgttacgccgtaacggcctacgtacttaggtacgtcgtacggttaccggtacgggggaaaccgaccgggtaacgtcggtaccgggttaaccgtacccgtaccggttacgacgtacgtacgtacgtaccggtcctacccggtcccgtacggtaccgtccgttaccgttcccggtaccctaccgttaccctacgttaaccgttacttcgttaccgtacgggtacggtaacccggtacggtcggtacgggtaacggtccgtacggtactaccgtaacggtcgcggtagtctacgtacncgctcgcgagcngngtcg

SEQ ID NO: 93941 - DNA, 590 bp, Homo sapiens
  misc_feature: GYAE6OF01D6ZAB.29.85.H08.1.454.CMB.1.raw
  modified_base (224)..(224): a, c, t, g, unknown or other
  misc_feature (224)..(224): n is a, c, g, or t
  modified_base (306)..(306): a, c, t, g, unknown or other
  misc_feature (306)..(306): n is a, c, g, or t
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
  modified_base (417)..(417): a, c, t, g, unknown or other
  misc_feature (417)..(417): n is a, c, g, or t
  modified_base (440)..(440): a, c, t, g, unknown or other
  misc_feature (440)..(440): n is a, c, g, or t
  modified_base (458)..(458): a, c, t, g, unknown or other
  misc_feature (458)..(458): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcatgtcggtgttataactttgtctcctaggtaccaacaaccaccgaggccgaccggccccccgatccaattaatttanagagtgtacaagttaacgccggccctcgacggggtccctgactcgcttcnctgcctcaacgtcnggaccactcgtcgtcctcctacgacctagtcctcgtcggcctaccgnggtctagacgtgtcggtacggtntaattatactcgtactcnctactagtttcgcgtacgccacccgtctaccgtgtacgtacttccggttacgggaccgggtaaggaacccgtacgacccggttacgacccggttaccggtaaccggtcaaccgttccgtacggtaacccggg

SEQ ID NO: 93942 - DNA, 771 bp, Homo sapiens
  misc_feature: GYAE6OF01EUIZQ.29.85.H08.1.454.CMB.1.raw
  modified_base (137)..(137): a, c, t, g, unknown or other
  misc_feature (137)..(137): n is a, c, g, or t
  modified_base (183)..(183): a, c, t, g, unknown or other
  misc_feature (183)..(183): n is a, c, g, or t
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcaggcacaggntcctggctcagtctgcctgactcacgcctcgctcagtcgtccggtntcctggacngcagtcacatcctctgcacgtggaaccngctagcgtattggtacggttggttaactaacgtttgtctccgttacgtaaccaactaacgtacccgaggtccgaaccgggtaccccccgacgttaccaacgtttaaacgtttacgtcggtaattcgtaccgtaacgtttaaaccggccggtaccccgttacgggtaccggggttaccccttaggtaccgttaccggtacctttcggtcctacgggtaccctaccgtaacggttctacgggtaccgtaaaccgtcgtacggttccccttaccgtacgtaccgtacttcggtccgtacgggtccttaccggcggtacgtagtaccgtagtaccggtaaccggttgtaacgttttaacggtcttacggactacggtaaccgttcgtaacgtttcgtacccggtacggttacccggtacccgaccgtacgttacggttacccggtacgttacccgggttaccgggtacggggtaaacccggtaaccggtaaacggtcccggttaacccggaccccgttaccggtaccgtacctcggtaccgttaccgtaacccgg

SEQ ID NO: 93943 - DNA, 703 bp, Homo sapiens
  misc_feature: GYAE6OF01BM4X5.29.85.H08.1.454.CMB.1.raw
  modified_base (250)..(250): a, c, t, g, unknown or other
  misc_feature (250)..(250): n is a, c, g, or t
  modified_base (350)..(350): a, c, t, g, unknown or other
  misc_feature (350)..(350): n is a, c, g, or t
tcagatagagtactcacgaccggtgctcgatttagtatcactcagtcggcgggggggggtctcaggaggcagcactctcgggacgtctccaccatggcctgggctctgctcctcctcacgcctcctcacctcgagggcacaggatccgtggctcagtctcgcctgactcacgcctcgcctcacggtcggtccggtctccgtcggactacgtcacgtccacctatcctaccgtgactaccgtcggaacccngacgagtcgagttcggtcggttaggttaacttacgttcgtcctacgtacggtaaccaacacctaccgacggccgaccgcccccgtatactattaactttnacgtatacgctaagtacgccggtacctcggacgggttacctgcgtcgtcttcgtcgtcgctacagtcgtagaccacgtactcctccgtaccgcgtaacctcgttaccgttcgtccggtacctaccgacgtcgtaacgtacggtacggtacggtaacgttacggttaactttagtaccttgtaccgttgtccgttacgtttacggtccgtaccggtaccggtaccccaaccggttcctacggtacgtccgttacggtccgggtaccgaaccggggttaccggacccggtaacggttccccgaccggtttaacccgtaccgtaccggtactacggttcccgtaaccgggtacccg

SEQ ID NO: 93944 - DNA, 837 bp, Homo sapiens
  misc_feature: GYAE6OF01DGG65.29.85.H08.1.454.CMB.1.raw
tcagatagagtactcacgaccggtgctcgatttagtatcactcagtcggcggggagctctgggagaggagccccagccctgagattcccaggtgttccattcggtgatcagcactgaacacagagaacgcaccatggagtttggactgagctgggttttccttgttgctattttaaaggtgtccagtgtgagtgcagctggtggagtcgtgggggagttcggtggtacgaggcccgtgggggggtcccctggacgacttccgtcctgttcgcgacgtccctacgtcgggtaattaccgtaaagtttttaatacgttacttttttaccccaagtttaaccgaccggttcgggttacccggtactaaacgggccgttaccggggggaacgggttccgtaggggtacggtgggtccttcgttactttacgtaaacggttcgaaacggtacggtgtacccggttaacttaaaccgtcgtttaagttaacgtcgaccgtaagaaccgtttccgtaggtacggaaacggggtccctaacttaccctaacccgacgtttacccacggtaacgaaacggaaccaaaacccgtaaaactacgttaaaccccttcccgttagttaaaccgttccgttaacggacttaaaaactccggtaaaccaaggtttaacccgtaacgggaagttaaacgggtacgaacccggaacgtaccggggtaccggttactttaccaagttttacggtttacgaacgtaaaacccggaaaaggtaaacggaacggtaccggaaaggttacggttaaccgtaaggggttacccgggttcggttccggttttaaacccggg

SEQ ID NO: 93945 - DNA, 628 bp, Homo sapiens
  misc_feature: GYAE6OF01CJ0VO.29.85.H08.1.454.CMB.1.raw
  modified_base (182)..(182): a, c, t, g, unknown or other
  misc_feature (182)..(182): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (299)..(299): a, c, t, g, unknown or other
  misc_feature (299)..(299): n is a, c, g, or t
  modified_base (390)..(390): a, c, t, g, unknown or other
  misc_feature (390)..(390): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggtagttggactgagcgtggttcgtgtagctaattaagtgtcagtgngagtgcngngtgggtgaggtcggtgggggatcggtggtaacgnggtccggttcgggggtcctgacgctctcgtgtcgacngtccgtnagtatgtaagttatnttattttccatacgngttcggcctagacgtcggtacggaggtcgtggtcggtcgtctagtcttagtaacgtcggagtacgggttcactaatctacttatagtcggnacgttacgtcgtagaggcgggtactcttaccactactacgaccgacgaacaacgaacaaacttctaccttccctagttactacgttaacaactaacgtatacgtacgtacgtagaacgtagtacgacgacgtacgtacgttacttacttagtacgtaggtaaagtaaaggaacggtaaaggacgaaaggtaggttaacggttacggttaacgggttcggttaccggttacggtacggg

SEQ ID NO: 93946 - DNA, 799 bp, Homo sapiens
  misc_feature: GYAE6OF01DQDER.29.85.H08.1.454.CMB.1.raw
tcagatagagtactcacgaccggtgctcgatttagtatcactcagtcggcggggggggtctcaggaggcagcactctcgggacgtctccaccatggcctgggctctgctcctcctcagcctcctcactcgaggcacgaggactccgtgggctcagtctcgccctgactcacgcctcgctcgagtcggtccgggtctccgtggacacgtcacgtccacctacttcctcctcgcctacgtacggaaccagacgagacgtagttcggttacggttaggttaatttacgtttcgtaccttccgtaacggtaacccaaaccgaacccgacccgacggacccggaccccggaccccccgtaactaccgtaacgtttaaatttcgtagtacgttagtactaacgtaacggcccggtacccgtacggtaccgggtccctaggtaccgttcgtccgttccgttcgtaccgtccgttaaccgtaggttcccgtacggacctaaccgtacctcccggtaccctacccgtaaccgacctttaccgtaccgttccggttccgggacccgttacccgtgggtacccgttacgggtacggtaccggttacgggtaaccggttacgttaactttaccgttacgtcgttacgttacgttccgttaacgttcgttaccggaccgtacccggttacccgacccgtacgtaccgttacgttccggtacgttccgggtaccggggtaccggaacgggtacccgtacggaccgttacccggaccgttaaccgacggtaccgtcggtcgtaaccggtcccgg

SEQ ID NO: 93947 - DNA, 767 bp, Homo sapiens
  misc_feature: GYAE6OF01DIZTI.29.85.H08.1.454.CMB.1.raw
  modified_base (275)..(275): a, c, t, g, unknown or other
  misc_feature (275)..(275): n is a, c, g, or t
tcagatagagtactcacgaccggtgctcgatttagtatcactcagtcggcgggggggggtctcaggaggcagcgctcgtgggggacgtctccaccatggcctgggctctgctcctcctccacctcctcactcagggcacgaggctcgtcggcccagtctcgccctgacttcacgtccctcccgtccgtcggtccgggtcctccgtggacagtctacgtccgacctctccgttccagccacgtacgaaccagcgtagtgattgtagaagtatttangtcttcgtccttaccgtacgaaccaaccaacacccagactacgactaccaaacgaaacactagtaagtactaactactaaggttactaacaccgttacccggtcccggtaccccggtagggacccggttctacggttacttttccggttacgttcccggacggtaccttaaccggtaacgtcggtaacgggacttaccgggtccggacccgttcctaacgtaccgtacctaaccctcgttaccgtaccgggtacgtaacccgccggttaacgggaccgtaacggggaacgggttacggacggtttagttaacgttaagttttcggtacgacgttcgtacgtctaaagttagttaaacgaggtacgttacgtaggttaccggttaaccgtttaggggtaccgggttacggtcgggtaacgggtaccgacggtacggtaccgttcggtacccgggtacggttaccggaccgaaccgttcggacccggttcccgg

SEQ ID NO: 93948 - DNA, 577 bp, Homo sapiens
  misc_feature: GYAE6OF01BQ6E0.29.85.H08.1.454.CMB.1.raw
  modified_base (230)..(230): a, c, t, g, unknown or other
  misc_feature (230)..(230): n is a, c, g, or t
  modified_base (293)..(293): a, c, t, g, unknown or other
  misc_feature (293)..(293): n is a, c, g, or t
  modified_base (324)..(324): a, c, t, g, unknown or other
  misc_feature (324)..(324): n is a, c, g, or t
tcagatagagtactcacgaccggtgctcgatttagtatcactcagtcgcgggggggtctcaggaggcagcactctcgggaccgtctccaccatggcctgggctcctgctcctcctcagcctcctcactcagggcacaggatcctggctcagtctgccctgactcagcctcgctcagtcgtccggtctcctggaccagtccagtccacctatcctcctgacactggaaccngcagcgatgtcgtgttataacttgtctctgtacaacacaccagcgacgccccatcatacttangatgtcattaacgcgtcctacgacgggtccngacgtctcttctctcggtactaccgaacgtcgtcgactaacacgtcgcctacgtacgaccatccttcgtcggtctacgacggctaggacctagtacggacggttactaacgtttacttaacgcgtaccttcgcctttacgtacgtttacgacgttaaccggcccaacccgtcaacgttcgtacgtacgttccgttacgggcggtaacggaaccacgtccttacgaccgtccgtagtacactcgtaacgtaccg

SEQ ID NO: 93949 - DNA, 561 bp, Homo sapiens
  misc_feature: GYAE6OF01EITTO.29.85.H08.1.454.CMB.1.raw
  modified_base (226)..(226): a, c, t, g, unknown or other
  misc_feature (226)..(226): n is a, c, g, or t
  modified_base (293)..(293): a, c, t, g, unknown or other
  misc_feature (293)..(293): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
tcagatagagtactcacgaccggtgctcgatttagtatcactcagtcgcggggggggtctcaggaggcagcactctcgggacgtctccaccatggcctgggctctgctcctactcagcctcctcactcgagggcacaggatccgtgggctcagtctgccctgactcagcctcgctcagtcgtccggtctccgtggacagtcagtcaccatctctgcactggaaccngcagcgatggtcgtgttatacttgtctctgtaccaacacaccgcgcgaccgccccgatacattaatntgtatgtctacgttacgccgccgtacgacgggtcctgactcgtcttctcgtcgctacagtcgtagaccacncgtcncctcgacgtcctctccgtcgtcggccttcggacgtcgtacggacgtcgtacgggtacggtattactttacgtactcgtgttccgacttacttacgttgacgaccggtccaccggctacgtgtacgtactcggttacgggcggtacggactacgtccgtaacgcccggttacgcgacgctccgtggtacccgg

SEQ ID NO: 93950 - DNA, 704 bp, Homo sapiens
  misc_feature: GYAE6OF01AYBDL.29.85.H08.1.454.CMB.1.raw
  modified_base (195)..(195): a, c, t, g, unknown or other
  misc_feature (195)..(195): n is a, c, g, or t
  modified_base (688)..(688): a, c, t, g, unknown or other
  misc_feature (688)..(688): n is a, c, g, or t
  modified_base (692)..(692): a, c, t, g, unknown or other
  misc_feature (692)..(692): n is a, c, g, or t
  modified_base (696)..(704): a, c, t, g, unknown or other
  misc_feature (696)..(704): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatggtcggtggttataactttgtctcctggtaccaacacaccaggcgaccggcccccgactcattaattangatgtctattaacgccggcctcgacggggtccctgactccgcttctcgtcgacctcgaagtctcggacaaacctaccgtccgcccttacccgtacggacctacttccgtcggtcggtccctccgacggtcctcggtaacgtactcggtaccgggtattaacgtttacgttacctgacttcgtcgttacgttacgttcgaccgtaccggaccacccgtcgtaccgttcggtagttaaccgttccggtacgggggtaacgtaaccgggtaacctacgggtccgttacccgggtaacccgtccggttaacggtacctacggtacccgtacgtaacccgggtccgttccccgtaccccggttacggtaccctaccggtttcccgttaccccgttccccgtacccctttccgtaacccttaaccgtttccgtaccttacggtaccggtcggtaccgggaccggttcgaccgggacgtcgggcctaaggctacggctangacnctcnnnnnnnnn

SEQ ID NO: 93951 - DNA, 869 bp, Homo sapiens
  misc_feature: GYAE6OF01CAVWC.29.85.H08.1.454.CMB.1.raw
  modified_base (257)..(257): a, c, t, g, unknown or other
  misc_feature (257)..(257): n is a, c, g, or t
tcagatagagtactcacgaccggtgctcgatttagtatcactcagtcgcggggagctctgggagaggagccccagccctgagattcccaggtgtttccattcggtgatcagcactgaacacagacgacgcaccagtggtagtttgactgagtcgttcgggtttttccttgttgtacgtttaagttttaaaaggtcgtaccgtagttggtagtaacgttgaccgagtcgttagggttggtaggttccgggtagggggngttacggtacggtaccgacggtccgggttcgggggtccctaggtaccgtaccgttccgttacccgtggtcgtaccgacgttccgttcgttacggttaacttttaacgttaaagtttttaacgtcgttttactttttaccgacgttaaccgtaccggtttcggggtaccccgttaagtaaaccgggtccggggttaaccggggtaaggtttcggacgggtttacgggttacggtttccgtttacgttaactttttaacggtaacgtaccgggtaacggtacgggttactacctttaaacgttctaaccgtttactacggtacctaagtacccttacggttacgttacggtaccgggaaacccggttcttacccgtacccaccgttaactccgtaaccgtaagaacccgaaactaaacgtaaccgtaccgttaccttacgttacttacgtctaagtacaaacgtacgacttacgtacgaacgagtaacgacgaacgtcgacgtcggttactttattacgttagtacggtacgaaaacggtggtaaaccggagttaaccggtagtaacggttaaccggttaccggggtcggtttaacggttcggtttaacccggg

SEQ ID NO: 93952 - DNA, 895 bp, Homo sapiens
  misc_feature: GYAE6OF01BNPUC.29.85.H08.1.454.CMB.1.raw
  modified_base (262)..(262): a, c, t, g, unknown or other
  misc_feature (262)..(262): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacgaggatccgtgggctcagtctgccctgacctcacgccctcgcctacgaggtccggttccgggtcctccgtaggacctaggtccacgtccaacctcttcctccgtagaccgtacgtacgggaaaccnggaccgtacggtcgtaacggttcgggttacggttaggttttaacttaaccgttttcgtccgttaccgttaccggtaaaccctaaaccgaacccgacccggtacgggaccccggaccccgggtacccccccgtaacgttacctaaacgttttaaacgtttaacgtacgtacgttacgttacctaaaggttaacccgggcccgttaccccggttagggtaaccccggggtttaccgtaggttaccgttaccggtttacccgtttccggtccggttacggtacccttaaacccgggttacgttccggttaaacggtaaccctaaaccgttcggttccccgttacccgttcccggttaactacccgttacgtttccgtaaccgggttccgggtacccttacgggtaccggtacgtacgggtaaccgttaacgggtccgggtttaaagggttactttaaccgtttacgttaaccggtggtttacccggtactttaacccgtttacggttacggttacgacccggtttagccttacccggtactaccggttggtaccttacgttaccggtcgggtaccggagggtaccgaacgtcgtaccggttaccggtacctacgggtaacgtctccgtcgtaccgg

SEQ ID NO: 93953 - DNA, 662 bp, Homo sapiens
  misc_feature: GYAE6OF01EQEHE.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcacatctcctgcactggaaccagcagcgatgtcggtgattataactttgtctcctggtaccacaacaccccaggccgacggcccccccgactcctagtaactttatcgatcgtcatttaagcggccctcgacggggtccctggactcgcttctctggcctcagtctagcaacactgccctcctgaccctatccttctcggggctaccgacggtcgtacggaccgtagtacgggacggttactacgtttaactttacgtcggtccttagccgttcctttaagttttcgaccgtaccggggacccctaccccgggtcctaacccgttcggttcggtaaccgtttccggttttacccgggaccggggaaccggggtaccccgtaaaacccggttcccgttaccggggtaacccccggttacccgtttaaacggggttcccctaagggtccccggttaacccggg

SEQ ID NO: 93954 - DNA, 654 bp, Homo sapiens
  misc_feature: GYAE6OF01D9DHW.29.85.H08.1.454.CMB.1.raw
  modified_base (466)..(466): a, c, t, g, unknown or other
  misc_feature (466)..(466): n is a, c, g, or t
  modified_base (553)..(553): a, c, t, g, unknown or other
  misc_feature (553)..(553): n is a, c, g, or t
tcagatagagtactcacgaccggtgctcgatttagtatcactcagtcgcggggggggtctcaggaggcagcactctcgggacgtctccaccatggcctgggctctgcctcctcctcagcctcctcactcagggcacgaggatcctgggctcagtctgccctgacctcagcctcgctcgagtcgtccgggtctccgtggacagtcagtcaccatctccagcacgtacgaaccagcagcgatggtcggttaggttataacgtttcgtctaccgtacggtaaccaaacaaccaaccgagccgacccggcccccgataccgaattaacgttagtgtagtcgtctaattaacggccgaccctacggtacggggtcctgactcgtacttcgtctcggactaccgtaagtctacggtaccaaactacctcgacccctaccctgtaaccctacttaccgtacgtcggccgtacnggtacgtagacgtacgtaggtaccgtagtaattaacttcgagtactcgtacttcgtattccgggacacgggccctaaccgcgttacncgggttaactccggtacggttaccgggaccgggaaacggtaaccgtaacgtacgtcccgttaaccgtcggtaaccggtacacggaccttacggaaacccgg

SEQ ID NO: 93955 - DNA, 727 bp, Homo sapiens
  misc_feature: GYAE6OF01CVC4G.29.85.H08.1.454.CMB.1.raw
  modified_base (719)..(719): a, c, t, g, unknown or other
  misc_feature (719)..(719): n is a, c, g, or t
tcagatagagtactcacgaccggtgctcgatttagtatcactcagtcggcgggggggggtctcaggaggcagcactctcgggacgtctccaccatggcctgggctctgctcctcctcagccctcctcactcgagggcacgaggatccgtgggctcgagtctcgccctgactcacgcctcgctcagtcggtccgggtctccgtggaccagtcagtccacatcctccgtgacacgtacggaaccagcaggcgtagttgggtcggttaggttaacttaacctttgaccgttaccgtacggtaacccaaaccaacccgaccgacgggaccggaccggtccccccgaattaccaaagtttaacttagtacggttacttacggtactaacgtttaacggccccggtaccctacggtaaccggggttccctaggtacgtccggtcttccgtacgtcggtacctacgtaacgtcgtacgggacctaacgtacgtccgtaccctaccggtacctaaccgtaacgtttcccgtaccggtccgggcccttaccgtaacgggtccgtacggtaacgaggtcggtaacggtacgttaagtttaacttcgtacgcttacgtacttagtaccgtttagccgacggtaccctaccgacctggttacgtaacgtcgttcggtaccgggagggtaaccgacgacgtcgaccgtccgtacgtacgggtaccacgtcgngtacccgg

SEQ ID NO: 93956 - DNA, 728 bp, Homo sapiens
  misc_feature: GYAE6OF01EPV6G.29.85.H08.1.454.CMB.1.raw
  modified_base (139)..(139): a, c, t, g, unknown or other
  misc_feature (139)..(139): n is a, c, g, or t
  modified_base (231)..(231): a, c, t, g, unknown or other
  misc_feature (231)..(231): n is a, c, g, or t
  modified_base (307)..(307): a, c, t, g, unknown or other
  misc_feature (307)..(307): n is a, c, g, or t
tcagatagagtactcacgaccggtgctcgatttagtatcactcagtcgcggggggggtctcaggaggcagcactctcgggacgtctccaccatggcctgggctctgctcctcctcaccctcctcactcagggcacaggntcctgggctcagtctcgccctgactcacgcctccctccgtcgtccgggtctcctggacagtcacgtccaccgtctctgcaggtcggaaaccngcgaggtacgtacggttggtacgtactttaacgtaaccgtgttccgtccgttacggttaaccaacggtccgaaccnccccgaaggacccaacgaacccgaaccccctaaaactcccgtagtttacgtttaactttttacggaccgttacgtaacggttaacctcccgggtcccgtaaccggtcgggttacccctaggtaccgtaccgtccttcgtaccgtcggtaaccgtaagtcgtacgctacgccgtaccgtacctctaggtactacgttcgcgtacgccgtacgcggctacgagaacgtggacgttagtactaacgttcgtcgtacgtcgtcctttagactttacggccgtaacgcccgtacctcgtacgtcgttactacggttaccgagggtaccggacgtaaccgtaagtcccggttaacgtcccgttaccggacggttacccgacggtaccgtaaccggaaccttcccgggttcccgtaccccggttaccg

SEQ ID NO: 93957 - DNA, 687 bp, Homo sapiens
  misc_feature: GYAE6OF01EINGR.29.85.H08.1.454.CMB.1.raw
  modified_base (650)..(650): a, c, t, g, unknown or other
  misc_feature (650)..(650): n is a, c, g, or t
  modified_base (654)..(657): a, c, t, g, unknown or other
  misc_feature (654)..(657): n is a, c, g, or t
  modified_base (659)..(661): a, c, t, g, unknown or other
  misc_feature (659)..(661): n is a, c, g, or t
  modified_base (663)..(677): a, c, t, g, unknown or other
  misc_feature (663)..(677): n is a, c, g, or t
  modified_base (679)..(681): a, c, t, g, unknown or other
  misc_feature (679)..(681): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (687)..(687): a, c, t, g, unknown or other
  misc_feature (687)..(687): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgatcattaatttatgatgtcattaagcggccctgagggtccctgatcgcttctctggctccgaagtctggacaaccactcgccctccctgaccattccgtccgtgggcctccgaggtccttaggaccgtagtcggaacggtataattttacgtaccttggacttcggtccttactactttacggcccgacggtaccccgaacccgtccgtacgtttacgggtaggttccgtttaccgggtttccggggaccggtaaacggggtaaccgttaaaccggcccgttaaccggggtaccccggtttccgtaacggggttacgacggttaaccgttacgggaacggtcccgtccccggttaccccccgttcggtaacccctttcccggttcccgtttaccccgtttacccccgtacccctttcgtaccgtttaaccggttacccttaccgtttaacgtccggtacggtacggtaccggtcgtaacgggacgacgggttaaccagttacgactacgctanccgnnnngnnnannnnnnnnnnnnnnncnnncngngn

SEQ ID NO: 93958 - DNA, 786 bp, Homo sapiens
  misc_feature: GYAE6OF01BBCTY.29.85.H08.1.454.CMB.1.raw
  modified_base (365)..(365): a, c, t, g, unknown or other
  misc_feature (365)..(365): n is a, c, g, or t
  modified_base (759)..(759): a, c, t, g, unknown or other
  misc_feature (759)..(759): n is a, c, g, or t
tcagatagagtactcacgaccggtgctcgatttagtatcactcagtcggcgggggggtctcaggaggcagcactcgtcgggacgtctccaccatggcctggctctgctcctcctcacgcctcctcactcgagggccacgaggtactccgtgggtcttagtcctcgccctgtacctcgacgtcctcgctcgagtcgtccggtctcgtaggactagtcacgtaccacctacttccgtacctgacctaacgtacggaaacctcgaccgtaaggccgtagtcggttcgggtaagtttaacttacgtttcgtacctccggttaacgtaaccaaaccgtaccgaccgtacggaccgaccccggtacccccngtacctaacgttagttacgtgtacgtcgtacgtaagtccggccgtacccgtggtaccggtacctgtaccgtccgtcttccgtccgtacgtacctcgtaacgttccgcggtaacctcgtaccggtcctccccgttacgtcgtacctacggttccttaccgggtcgtaccctacgggtacgtaccggtacggacgttacgtaggttacccgtaattacgttaccgtttagcgttaacggttcctaccgttacgtttacgaccgggtaacgtaccccgttaaccggtaccccgtcgtacgttacggtaccgtacgggtttccgggaacccgggtacggaaccgggtaacccgttgggtaccccggaccgggttcccgttaacggtccggtaaacccngggttacccctaggtaccggtccccgg

SEQ ID NO: 93959 - DNA, 938 bp, Homo sapiens
  misc_feature: GYAE6OF01BCKLO.29.85.H08.1.454.CMB.1.raw
tcagatagagtactcacgaccggtgctcgatttagtatcactcagtcgcggggagctctgggagaggagccccagccctgagattcccgaggtgtttccattcggtgatcagcactgaacacagagaacgcaccatggtagtttggactgagcgttgggttttccttgttgtcttaagttttaaaggtgtcctagtgtgaagtgcgagcgtgggtggaggtcggtgggggatcgtggtacacggtccggtgggggtccctgacgtacctcgtccgtgtcgcctacggtcctgtacggtacttacgtaaagttttaatacggttacctttttacaacgttaccgtacggtttacgggtaccccgtacggaaccggtccggttacccggggggtaagggttccgttaggggtaacggtttcgggttccttacgtttacgtttaacgttaacggtccggtaacggtaccggttcgtacctttaacgtactacgtttacgtaacgtacggtacctaacggttacgttccgtagggtacggtaaacggggtcccttaagttacccgtaacccgttacgttacccgttaaccggaaacggtaaaacccgtaaacccggtaaactaaaacccgtttaaccgggttacccctttacccggttaaggtttaacccgtacgttaacgggtaaacctaaacggtaccgttaaaccgtaacgggtttaacccggtaaggtaaagggttaaccgggttaccgaaaccggtaacccggtacggggttacccgttaccttttaaccggtttaaacggtttaaacgtttaccggggtaaacgtaaacccgggaaaaagggtacccgggtaacgggtaacccgttaaagggtaaccggtttaacgggttaaacggggtttccgggttaccggtttttaacccgggttaacccggg

SEQ ID NO: 93960 - DNA, 646 bp, Homo sapiens
  misc_feature: GYAE6OF01BXCQ9.29.85.H08.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
  modified_base (478)..(478): a, c, t, g, unknown or other
  misc_feature (478)..(478): n is a, c, g, or t
  modified_base (636)..(636): a, c, t, g, unknown or other
  misc_feature (636)..(636): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggactccgtgggctcgagtctcgccctgactcacgtccctcgctcaggttcgtcccgggtctcctggacngtcagtccacntcctcctgacactcggaccngcngcgagtggtcgttgttactactttcgtcctcgtagtaccaacaccgaccgaggaccgcccgacccccgtatcgtaattacgttagtacgtacgtcggtactaacgtacggcccgtacccgtacggtacggggtccctagcgttaccgtcttcgtccgtcgtaccttaccgtaacgttcgtaccgacgtaccgtaccgtcgcccttccgacgaccgtcttcgtcgtcggtccgtacgnggtcctacgacggtacgtacgtggttaactacgtttactccgtggtcgttacgtccttaacgttcgtacggtaccgtaccggtcccctacgtacgtcgttagggtactcggtaccgggttcggaccggacgtacgcgtaccgtcgccttacgtcgacncgtcgcgtcg

SEQ ID NO: 93961 - DNA, 845 bp, Homo sapiens
  misc_feature: GYAE6OF01BEANE.29.85.H08.1.454.CMB.1.raw
  modified_base (209)..(209): a, c, t, g, unknown or other
  misc_feature (209)..(209): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacgaggatccgtgggctcagttctcgccctgtactcacgccctcgctcagtcgtccgggtctcctggaccagtccnggtccaaccagttcctccgtgacctacgtcggaaccagtacaggcagtcggtacggtaggttaacttaacgtttcgtaccgtccgtaggtaaccctaaccaaccgacccgacggtccggaacccggccccccgtactaccgtaattaaccgtttacgtacggtaacgttcggtactaaccgttaacggtcccggaccccgtaccgtaaccggggtttcccctacggtaacttcccggtaccgtttaccgtccggtaccggttccccgtacgttaaaccggttccgtaccggtaacccggtaaccctaacggttcccggtaaccctttcccggtaaccgtaccccctaacgtttcccgttcgggttacccggggtcccttaaacggtcgggttacgttaacccgggtacgtaccgttacgggtaccgtttacggttaactttaccgtttaccgtagtccgttacgttacctaccggttagttcccggacggtaccggtacccgtccgtaactcggtacgggtcctaacgggttccggtacggtacccgggaaggtacccgtaaccggttcccggtaacggttacccgtttaaaccgggtaccggttatcccggggttaagtaccccggggtacccgg

SEQ ID NO: 93962 - DNA, 738 bp, Homo sapiens
  misc_feature: GYAE6OF01BZWEF.29.85.H08.1.454.CMB.1.raw
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggatccgtgggctcagtctcgccctgacctcacgcctcgctcgacgtcgtccgggtctccgtggacagtccagtccaaccntcctcctgcacgtacggaaccngcaggctagttgtcggtagttatacgtttgtcctcgtacggtaaccaaccgaaccacccgaggacccgacccggacccccgtactaccgtaattaactttacgtacgtatacgtacgtaattaacgccgtacccgtacgtacgggtccctgactccgtcgttctcgtcgcctacgtcgtaccgtcggaccaacgtaccgtccgtcccgttaccccgtacgtacccgtaccgtccgtccgtaccgggtcctccgtaacggtcctacgtaccgtagtaacgggttccgttaagtaacgttttacgtaccggtgttaccgtagtacccgtttacgtacggtttccggaccggacccggtacccgtaccccctaggttaaccgtggttaaccgtccgtttacccggggtaccggggtacccggacccgggttaaccgttaccgtccccggtaaagtcccccggtacgttacggtaccctccggtaccgaacggtcccccggg

SEQ ID NO: 93963 - DNA, 605 bp, Homo sapiens
  misc_feature: GYAE6OF01BRMBT.29.85.H08.1.454.CMB.1.raw
  modified_base (231)..(231): a, c, t, g, unknown or other
  misc_feature (231)..(231): n is a, c, g, or t
  modified_base (314)..(314): a, c, t, g, unknown or other
  misc_feature (314)..(314): n is a, c, g, or t
  modified_base (409)..(409): a, c, t, g, unknown or other
  misc_feature (409)..(409): n is a, c, g, or t
  modified_base (431)..(431): a, c, t, g, unknown or other
  misc_feature (431)..(431): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatccgtgggctcagtctgccctgactcagcctcgctcagtcgtccgggtctccgtggacagtcagtcacctatctcctgctacgtggaaccngcagcagtcggtcggtgttataactttgtctccgtagtaaccaacaccaccgaggccgaccggccccgatactaattaacttntgtatcgtactaagttaacggccggtccctcggaccgggttcctagactcgtcttcctcggtcgcctaccagtcgtcgacaacgctcgcccttcncgacctctctcgtcgcctccgngctacgcgtgtcggtacggtattacttacttcgtctcgttcgcttacgttacgttcgaccggtaccgtcccacccgtgtaccttggtaccgttacgtccgggttaccgggcgggtaaccggaccggtcggtcctaccggtacccgttcggacgtaccgcgtccgtacggaccgg

SEQ ID NO: 93964 - DNA, 903 bp, Homo sapiens
  misc_feature: GYAE6OF01ECH58.29.85.H08.1.454.CMB.1.raw
  modified_base (209)..(209): a, c, t, g, unknown or other
  misc_feature (209)..(209): n is a, c, g, or t
tcagatagagtactcacgaccggtgctcgatttagtatcactcagtcgcggggggggtctcaggaggcagcgctctggggacgtctccaccatggcctgggctctgctcctcctcacctcctcactcagggcacaggctcgttgggcccagtctgccctgatcacgcctccctccgtcgtccgggtctccgtggacagtcagtccgccntcctccgtgcactcggaaccagcagtgattggttagaagtaatttagtgtacgttcgttacccttcccggtttacggtaaaccccaaaccaaacccaacccgaacgaacctaaccaaccgtaaccccaaaccaaaacctaccgaatagtaataactaaactaacgtacgtaactaaactaccgttcccgggaccccgttacggtaaccggggttcccctagttaccgtttccgtttttcccgtccggttccgggttacccttacccggtaaacgtttccggtacgggtaccgtaacggttccggcccggttaccccttaccgttaacgtaccggtacccttacgttaccttacccggtaccggttacccgtacccgaacgggttacggtaacggaacgggtaaccgggtaacgggtccgtttaagggtttaacttttaaggtttaccggtagttcccgttacggtccttaacgtaaagtttaaacttaaacgtaacgttacgttaaggttcccgtttaaaccggttaacgggggtttaacgggggttttacggggttacccgggggtaacccgggggtaaaccgggttaacccggtaaacgggttcccccgggttaacgggttacccccgggttaccgggttaaccgggaccccggaaaccgggtaacccccggtcgggggttaccccccccgg

SEQ ID NO: 93965 - DNA, 767 bp, Homo sapiens
  misc_feature: GYAE6OF01EWP0S.29.85.H08.1.454.CMB.1.raw
  modified_base (246)..(246): a, c, t, g, unknown or other
  misc_feature (246)..(246): n is a, c, g, or t
  modified_base (742)..(742): a, c, t, g, unknown or other
  misc_feature (742)..(742): n is a, c, g, or t
tcagatagagtactcacgaccggtgctcgatttagtatcactcagtcgcggggggggtctcaggaggcagcactctcgggacgtctccaccatggcctgggctctgcctcctcctcagccctcctcactcgagggcacaggtactccgtgggctcagttctcgcccttgactcgacgcctcgctcaggttcgtccggtctccgtggacagtcagtccacctattcctcctgactacgtcggaaccngcagtacgtacgttcggttaccggttagtttaacttaaccgttttcggtacccttaccggttaacggtaacccaaacctaacccgacccggaccggaccgaccccggtaccccccgtaacgtacttaagtttaactttactacggtacttacgtacgtaacgtttaccggacccggttaccgtaccggtaccggggttaccctaggtaccttaccgttccgttacgtcgtccggtactaccgtaacgtccgtacgtacctactccgtcgtcccttacgtaccgactcctttcgaccgtcggtacctaccgacgtcgtacgaacgtcggtacgtaccggttatacgtttatacgttcgacttacgtcttacgtacgttacgtacgtaccgaccgtcccgtactcggttacggtaccgttaccgttaccgggtccgggtacgggaaccggtacccggtcgttacccggtaccgtacccgggttaacctccgggtaaanccccggttacgttacccggtacccg

SEQ ID NO: 93966 - DNA, 668 bp, Homo sapiens
  misc_feature: GYAE6OF01AVBER.29.85.H08.1.454.CMB.1.raw
  modified_base (225)..(225): a, c, t, g, unknown or other
  misc_feature (225)..(225): n is a, c, g, or t
  modified_base (270)..(270): a, c, t, g, unknown or other
  misc_feature (270)..(270): n is a, c, g, or t
  modified_base (304)..(304): a, c, t, g, unknown or other
  misc_feature (304)..(304): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggactcctgggctcagtctgccctgactcacgcctcgctcagtgtccggtctcctggacagtcagtcactatctctgctactggaaccngcagcgtatgtcggtgttatacttgtctcctcgtacctaacaacnccgaggccgacggccccgactacacttaacttangtatgtacaagttacgccgtcctcgtacgggtcctcgactcggtcttcgtcgtcgctacgtagtcgtacggaccaaacgtcctcggtccctccgtcgtaaccctcgttaccgtccgtacggggtccttacccggtacggtaccgttaggaaccggtacgtacgggtaacgggtacgttaacgtttaacttaccggtcgtcccgtcgttaccttacggttaacgtttccggacgttaacccggtcccgtacccgtacgttcccggtaggttaccgtagttcccgggttaaacgggccgggtaagggtaacccgtagaccgttacgtacccggtacgtaccggtagttacgcgttcgtaacccggg

SEQ ID NO: 93967 - DNA, 744 bp, Homo sapiens
  misc_feature: GYAE6OF01EDZ3F.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcgagggcacaggatccgtgggctcagtctcgccctgactcacgcctcgctcagtgtccgggtctccgtggacagtcagtccaccactcctcctgccacgtacggaaccagacagcgtagtggtcggtagttattaacgtttcgtcctccgtacgtaaccaaccaaccaccgtacggaccgaccccggtaccccccgaacgtactaaattaagtttacgacgtaacgttacgtacctaacgttaccgcccggtaccccgtacggtaccggggttcccctggtaacctttccgttacctttccgtcggtaccggtacccttacccgtaacggttccgtaccgtactaaaccgtaccgtcccgtaccctaccccgttacgaaccttacgttaccgtccgtcggtacccgttccggagtaccgtacgacgtacgttaggtaaccggttagtacttttacgtaccgttgtaccgttgtaccgttacgtacgtttccggacgtaccgacccgaccgtactacgttacggtacgtccgttaccggtcgggaaccgggtaccggaacgtccgtacggtacccgtacccggtaccgtacggtacccaacggtccgtacgtacccgg

SEQ ID NO: 93968 - DNA, 823 bp, Homo sapiens
  misc_feature: GYAE6OF01EJR9T.29.85.H08.1.454.CMB.1.raw
  modified_base (249)..(249): a, c, t, g, unknown or other
  misc_feature (249)..(249): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcacctcgagggcacgaggactccgtgggctcgagttctcgccctgactcacgcctcgctcgagtcggtccgggtcctccgtgactacgtcacgtccactactcctcctcgacctacgtcggaaccngcacgcgtagtcggttacggttagttacttaacgtttcgtcctaccgtacgtaaccaacaaccgaaccggtacggacccgaccccggtcccccgtactacgtaactttaaacgtttacgtcgtacttcgtactaacgttaccggccggttccgtaccggtacgggttcctacgtacgtccgttccgttcgtaccgtcgtaccgtacccggtaacgttcgtccgtaacctaaccgtccgtcccgttacccttacccgtacgtaaccccgttacgttcccggtaccgggtccggttaccctccgggtacggtacctaacggggtaaccgtacgttaccggggttacgttacgttttaaccgtttaacgttccggttaccgtcggttaccgttccgtttaagttacggttccggaccccgtaaccggtccccgtaacccgtacttccggtaacggtccggtttaaaccgtccgggggtacccggggtaccgggaaacggaccccgggttaagtcccccggtaaccggttacccgtaccggttacggacccgacccggttaggaccccgttacccggg

SEQ ID NO: 93969 - DNA, 765 bp, Homo sapiens
  misc_feature: GYAE6OF01E33CQ.29.85.H08.1.454.CMB.1.raw
  modified_base (694)..(694): a, c, t, g, unknown or other
  misc_feature (694)..(694): n is a, c, g, or t
  modified_base (720)..(720): a, c, t, g, unknown or other
  misc_feature (720)..(720): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcacatggagtttggactgagcgttgggttttccttgttgtcttaattttaaaaggtcgtaccagtgtgaagtcgcgagcgtggtggagtcgtgggggagtcgtggtacgacggtccggtcggggggtccctaggacgtactctccgtggtcgcacgccctcgtggtacttacgtaaagtttaattcgtttactttttaccaacttaccgtacggttcgggtacccgtacgaaacggtccggtaccgggggtaagggttcggtacggggtacggttcgggttcctttacttacgttttaaacgttaacgtccgggtaaggtccggttacgtacccgttaaactaacttacgtttactacgtacgtaccgtaaggtaccttgtacggtacgggaaccgggtccgttaacttacccgaaccccgttatccccgtaaccaacggaaacctaaaaccgaaaccctaacgtaaacccgttacccctccgtacgttactcccgtaagtaacgtaaagtacgaacgttggtaacgtaggaacgttaacgacggacgtacgacgtcgttacttnttaacgttgtagtacgaagaaacggnggtacgtacgagtacgtacgtagggtcgtaccgttgttaaccggg

SEQ ID NO: 93970 - DNA, 737 bp, Homo sapiens
  misc_feature: GYAE6OF01DCTDJ.29.85.H08.1.454.CMB.1.raw
  modified_base (254)..(254): a, c, t, g, unknown or other
  misc_feature (254)..(254): n is a, c, g, or t
  modified_base (424)..(424): a, c, t, g, unknown or other
  misc_feature (424)..(424): n is a, c, g, or t
  modified_base (629)..(629): a, c, t, g, unknown or other
  misc_feature (629)..(629): n is a, c, g, or t
  modified_base (637)..(637): a, c, t, g, unknown or other
  misc_feature (637)..(637): n is a, c, g, or t
  modified_base (643)..(643): a, c, t, g, unknown or other
  misc_feature (643)..(643): n is a, c, g, or t
  modified_base (666)..(666): a, c, t, g, unknown or other
  misc_feature (666)..(666): n is a, c, g, or t
  modified_base (721)..(721): a, c, t, g, unknown or other
  misc_feature (721)..(721): n is a, c, g, or t
tcagatagagtactcacgaccggtgctcgatttagtatcactcagtcggcggggggggtctcagggaggcagcactctcgggacgtcctccaccatggcctgggctctgcctcctcctcacgcctcctcacgtcgagggcacgaggactccgtgggctcgagtccgtcgccctagacctacgacgtcccgtacgctcgacgtcggtccggtcctccgtggaaccagtcgacgtaccaccgtactccttaccggngtaacctacgaaccgggaaacacgacgacgtacggtacgtcgggttacggttacgtttaacgttaccgtttcgtaccgttaccgttaacggtaacccaaaccgtaaaccgaccccggaaccggacccggaacccccggtaccccccagtaacgtaagtttaacgtttagngttaactcgttacgtaagttaaccggcccccggttaccgtacggtaccggggttaccctaagcgttccgtccttacgttcccggccgttacgtttaacgaaccgggtctacggaaaccacgtaccgtcccgaacccgttcgaccgaaccctctcgtcgcggtcctacggtcgacgtcggactaggacgaacgtgtacttgtacgntcgtcgtntacgtntaccgacgccgtaccacccggtnccgtgacgttccgaggtacggacggaccgacgtaacgccggactaccgcgacganaccgtcgcgtacccgg

SEQ ID NO: 93971 - DNA, 155 bp, Homo sapiens
  misc_feature: GYAE6OF01DQZ07.29.85.H08.1.454.CMB.1.raw
  modified_base (151)..(155): a, c, t, g, unknown or other
  misc_feature (151)..(155): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgaggcgggctggcaaggcgcatagnnnnn

SEQ ID NO: 93972 - DNA, 872 bp, Homo sapiens
  misc_feature: GYAE6OF01EJGYC.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagaagaacgcaccatggtagtttggactgagtcgttgggtttttccttgttgtactttaaagtttttaaaaaggttgtaccgtaaggttggtaggtaaaggttgcgtaggtcgttgggtgggtaggttcggtggggggtaggttcggttaggtaccgacggtcccgggttcggggggtacccgtggacgtaccttcgttccgtggtcgccacggtcccgtcgttggttactttaccgttaaagttttaagttagtttactttttaaccaacgttaccgtaacggtttcgggttaccgtacgtaacggtccgggtaccggggggtaacgggttcggtaggggtacggttcgggttcttacctttacgtttaaagttaacgtaccggtaacggtacggtacgttacctaaactacttaatttcgtaacgtcggactaagtcgttcgttaggacgggtaaccgggtccgtaacttacccgaacctttacgttcccgtaaccggaaacgtaaaccgtaaaaacccgtaaaactaaaaccgttaaaccccgttaccccgtttaacccgttacgtaacttaccgtaacgaaaccttaaagtaccgtaaacgtcggttaaccgaggtaaacgtaggtaccgtaagtaccgtacggtccgttactttactttagttacgtaggttaaacgaaaggaaacggtaggaacgagttacggttaacgtaacggttaagggttcgggttacgtaggttaaccgg

SEQ ID NO: 93973 - DNA, 735 bp, Homo sapiens
  misc_feature: GYAE6OF01B28B2.29.85.H08.1.454.CMB.1.raw
  modified_base (229)..(229): a, c, t, g, unknown or other
  misc_feature (229)..(229): n is a, c, g, or t
  modified_base (232)..(232): a, c, t, g, unknown or other
  misc_feature (232)..(232): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatcctgggctcagtctgccctgactcagcctgctcagtcgtccgggtctccgtggacagtcagtcaccatcctcctgcacgtcggaaccngcngacgatggtcggtggttataacgtttgtcctcctcggtaaccaacaaccaccgacggccgaccggcccccgactctaacttaatttagtagtactgtctaacgttaacgccggtcccgtcggtacggggtccctgaccgtcgtccttccgtcgtcggtctaccgtacgttcgtacggaccaacgtaccgtccgtcccgttcccgtacgtacccgtacttccgttaccgtcggggtccctacccggtcggtccgtcggtacggtacggtacggtacgggttatacgttttacgttaccgttggtaccgtcgttcctacgttacggtttccgacggtaccggtaccccgtacccgtccgttacgtccggttacgtaccgtttaccggggtaccggggtaccggggtaaaccggggtacccggtaaacggcccggttacccggtaccccgggttaaccgttacgggtacccgtaccgggttcccggttaaccgggtaaccccgggg

SEQ ID NO: 93974 - DNA, 849 bp, Homo sapiens
  misc_feature: GYAE6OF01DJGXD.29.85.H08.1.454.CMB.1.raw
  modified_base (491)..(491): a, c, t, g, unknown or other
  misc_feature (491)..(491): n is a, c, g, or t
tcagatagagtactcacgaccggtgctcgatttagtatcactcagtcggcggggagctcgtgggagaggagccccagccctgagattcccgaggttgtttccattcggtgatcagcactgaacacagagaacgcaccagtggacgtttggactgagtcgttgggttttccttgtgtacttaagtttttaaaaggtcgttccgtagttggtaggaagtgcgagtcgtgggtggtaggtcggttagggggagttcggtcggtacacggtccgggttcgggggtccctaggacgtaccgtcctccgtgtcgcgtacgccgttagtaggtatttaccgtaaagtttttaagtcgtttaatttttacccaattaccgtacggttcgggtaccgttaaccgaaggtcccggtaacgggggtacggtgtacgggtaggttcggtacttcgtatttacgtacgtggacgtacgtctacgtactactagttctgtcgacncgtacgtcgtaggacggtaacggtccgttactaccgaccgtctaccgttacgaacggtaacaaacctaaacgtaaaccgtaaccggttcctaaccggttataaccgtcgttaacgtaacgtaaacgtttccgaaacgtcggttaacggttaacggaacgggtttaaccggaaccggtaaacccgttaaccgggtggttaacccgggttttaaccctttaacggtttaaagttttaccgggtaagtttaaaccggaaaagggtaaaaacggtaaacgggaaaccggtaacggttaacgggttacgtttaaacggggttaggggtttccgggttaacggtttcccggtttaaacccgggg

SEQ ID NO: 93975 - DNA, 744 bp, Homo sapiens
  misc_feature: GYAE6OF01CNWNO.29.85.H08.1.454.CMB.1.raw
  modified_base (651)..(651): a, c, t, g, unknown or other
  misc_feature (651)..(651): n is a, c, g, or t
tcagatagagtactcacgaccggtgctcgatttagtatcactcagtcggcggggggggtctcaggaggcagcactctcgggacgtctccaccatggcctggctctgcctcctcctcacgcctcctcgactcgagggcacgaggactccgtgggctctaggttcctcgccctgtacctcgacgtcctcgcttacgtcggtcggttccgggtacctccgtaggtacctacggtaccgacgtacctacctacttccgtaccgtgacctacggtaccggaaacctcgtacgacggcgtagttcggttacggttacgtttaacgttaacgttttcgccttaccggttacggtaaccctaaaccaaccgtaccgacggcccgaccgggtacccctactacgtaactttacttacggacgtacttcgtactaacgttacgcccggtacctacgggtccggtaacctcggtacctcgtaccttcgtcgtcggtactaaccgtcgtacgttcgaaccacggttacctcgaacccttcgacgtacctcggttactcgggtcgtcctcggacgtcgtacggactacggtacgtacgttacgtactttacgtcgacgttctcgttaacgtcgttcgttacgacgtaccgttaccgacccgttntaccggcgttctaaccgggtcgttacgggacggacgttaaccgtcgttaccggtccgtacgtccggtacgtaccgtcgtacctcggggtaacc

SEQ ID NO: 93976 - DNA, 752 bp, Homo sapiens
  misc_feature: GYAE6OF01CLXBL.29.85.H08.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (655)..(655): a, c, t, g, unknown or other
  misc_feature (655)..(655): n is a, c, g, or t
tcagatagagtactcacgaccggtgctcgatttagtatcactcagtcggcggggggggtctcaggaggcagcactcgtcgggacgtctccacatggcctgggctctgctcctcctcagcctcctcactcgagggcacgaggactccgtgggctcgagtcctcggccctgacctcacgtcctacgctcgaggttcggtccggtctccgtgacngtcagtcacctatccgtccgtgctacgtacgaaccngcgagcgtagttcggtcggttaggttacttacgttcgtcctacgtacgtaaccaactaaccgaccgacggtaccgaccccggtacccccgtatacgtaactttaacgttacgtacggtacttacgtaacgttaacggttaaccggcccgggttacccgtcgggtaaccgggttcccttacggccgttccggttaccgtttccgtacggtccggtacccttaacggaaccgttccggtaaccgtaccgtaaaccgtccgtaccgtcccgttacccgtagtaccctacgtttcgtaccggtacggtcccgtaacggtcgggtctacggtaacgtggtacgtaacggtatacgttatacggtctcgtaacgtccttagtacggttccggacgtcccggacacccggttanacggttcgtacgtccgtaccgggtacgggaccggaacggtacgtacggtccgttaaacccggcctacggttacggaccgtacgtcggacgttaccgg

SEQ ID NO: 93977 - DNA, 804 bp, Homo sapiens
  misc_feature: GYAE6OF01BVV5U.29.85.H08.1.454.CMB.1.raw
  modified_base (239)..(239): a, c, t, g, unknown or other
  misc_feature (239)..(239): n is a, c, g, or t
tcagatagagtactcacgaccggtgctcgatttagtatcactcagtcgcggggggggtctcaggaggcagcactctcgggacgtctccaccatggcctgggctctgctcctcctcagcctctcactcaggcacaggatccgtggctcagtctcgccctgactcgacgtcctcgctcgagttcggtccggtctccgtggacagtcagtccactattcctcctgaccacgtacggaaaccnggcaggtcgagttcggttacggttaggtttaacttaacgttttcgtcctccgtacggtaaaccaactaaccgaccgacggccgacccggcccccgtaatacgtaattactttagtagtacgttcgtacgtaacgttacggaccggtaccccgttcggtaaccggggtcccttaggaccttccgtcgtttcccgtcgtccggtaccttaccgtaacggttccgtacgggacctaacgtacccgttccgaccccttcccgacggtaaccctcgtttccgcgggttaccggtcctccggtaacggtccgtaacggaccggttaacgttcgggtaacggttacgtttaacgtttaaccgtttaccgtcgtaccgttctcccggtttaaggtttcgtttacccgggaaccgtacccggaacccgttaccccgaacgttcggtttacgtaaccggttccgttccggggttaacccgggggacggaaccccggggttacaaacccggttccggttaacccggtaaccggttcccgttaacggtcctaacggtacgttaaccggggaccccgg

SEQ ID NO: 93978 - DNA, 778 bp, Homo sapiens
  misc_feature: GYAE6OF01AGQ6O.29.85.H08.1.454.CMB.1.raw
tcagatagagtactcacgaccggtgctcgatttagtatcactcagtcgcgggggggggtctcaggaggcagcactctcgggacgtctccaccatggcctgggctctgctcctcctcagcctcctcactcagggcacgaggatccgtgggctcagtctcgccctgactcgagcctcgctcagtcggtccgggtctccgtggacagtcagtccaccatcctccgtcgcacgtcggaaccaggcacggcgagttcgggtacgggttaggttaacttaacgtttcgtccttccgtacggtaaacccaaacctaaaccaccccgtaacgggcccggaacccggacccccccgtaacgtacctaacttaaagtttatagtacttgtaactaacgttaacgggcccggtacccgtacggtaccgggggtccctaggtaccgttccgtccgttccgtcgtcggtccctaccgtaacgttccgtcggacctaaccgtccgtccgtacccgtcccgtacgtacctacgtccgttcgtccgggtcctacgcggtcgtcggacgtacggtcggtacggtgttaacttacgttaccgtcgtcgtccttacgtacgttacgtttacggcgtaacccggtacccgtacccggtactaaccggttcgtacgttaccggttccgggtaccgggtacggggaaccggtaaccggtacccgggttacccgttaccggtaccccggttaaccccggttacggtacccggaccggtaacccggttcgggtaaccccggg

SEQ ID NO: 93979 - DNA, 736 bp, Homo sapiens
  misc_feature: GYAE6OF01BQC11.29.85.H08.1.454.CMB.1.raw
  modified_base (193)..(193): a, c, t, g, unknown or other
  misc_feature (193)..(193): n is a, c, g, or t
  modified_base (720)..(720): a, c, t, g, unknown or other
  misc_feature (720)..(720): n is a, c, g, or t
  modified_base (722)..(722): a, c, t, g, unknown or other
  misc_feature (722)..(722): n is a, c, g, or t
  modified_base (724)..(731): a, c, t, g, unknown or other
  misc_feature (724)..(731): n is a, c, g, or t
  modified_base (733)..(733): a, c, t, g, unknown or other
  misc_feature (733)..(733): n is a, c, g, or t
  modified_base (735)..(736): a, c, t, g, unknown or other
  misc_feature (735)..(736): n is a, c, g, or t
tcagatagagtactcacgaccggtgctcgatttagtatcactcagtctgccctgactcagcctcgctcagtgtccgggtctcctggacagtcagtcaccatctctgcactggaaccagcagcgatgtcggtgttatactttgtctcgtagtaccaacacaccaggccgaccgcccccatactaattaacttgngatcgtactagttaacggccgtcctacggacgggtccctagtactcgtccttcgtcgtcggccttaccgacgtcgtcgacctaacgtcgtcgtaccctccgtagaccttacttccgttacggtcggtaccctaccggtaggtccgttaggaaccgttaggtacggttacgggtactttaactttacgtacgtgtccgttcgttaccttacgtttaggtccggacgacccggtaccacccggtgttaacgtcggtcgtaccgttacgggtaccggggaagggtacccgtaaaaccgtcggtacccgtttaccggtaacccggttacgtaccgggtactaaccgggtaccgtaacccggtaccgggtccccgttacccggtaccccggtaccggttacccgtacccgttttcccgtcccctttacccccgtcctaacccggtcgtaccctttacctacggtttaccgacggtcgggtaccggtacggtaccgggtaccggacggacgtaccgtcggtaaccttgccgtnancnnnnnnnncngnn

SEQ ID NO: 93980 - DNA, 680 bp, Homo sapiens
  misc_feature: GYAE6OF01CSRVA.29.85.H08.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (564)..(564): a, c, t, g, unknown or other
  misc_feature (564)..(564): n is a, c, g, or t
  modified_base (591)..(591): a, c, t, g, unknown or other
  misc_feature (591)..(591): n is a, c, g, or t
tcagatagagtactcacgaccggtgctcgatttagtatcactcagtcgcggggggggtctcagtaggcagcactctcgggacgtctccaccatggcctggctctgctcctcctcacgcctcctcactcgagggcacgaggactccgtgggctcgagtctcgcctgactcgacgtcctcgctcgagtcgtccggtctccgtgacngtcacgtccactactccgtcgtcgctacgacggaaccngcacggacgtagttcggtcggttagttaacttacgttcgtcttaccgtacgtaaccaactaaccgaccgtacggtccggaaccccggtcccccgtaattcctaagtttaccgttagtacgtacgttacgtactacggttaaccgggcccgttaccgtacgggtccgggtacccgtgtaccgttcgttccgttacgtcgtaccgtcctacgtacggtcctacgacgaaccgtcggtacctccgtaacctcgaacctcgttccgtcggtccgtacgtcgtacggtcgtaacgtacgtgggacggttacgttcgtaacgttcgtntcgtacgttctacgtccgttgtacgtntacccggctacgtgtacgtcgtgtcccggtggttccggacggtacgtacgcggtctaccggtcgtacgtagccttcggcgtcggtcccg

SEQ ID NO: 93981 - DNA, 1056 bp, Homo sapiens
  misc_feature: GYAE6OF01A65UW.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagttggactgagtcgttgggttttccttgttgtacttaagttttaaaaggtgtccgtagtgtagtaagtgcagtcgtgggtggaggtcggtagggggtagttacggtggtacgacggtccggttcggggggtccctaggacgtaccttccgttccgtggtacgccgacgtccctacgttaggtaactttaccgttaaagtttaattgtttacttttaccataccgtacggttcgggtaccgtacgtaacggtccgggtaccgggggtaaggtccggtagggtacgggttcgggttaccttacgtttacgtttaagttaacggtaccggtaacggtaccggtcgtaccttaaccgtattacgtttacctagtacggaccgtaacgtaccgttcgttaacgggtaccgggtaaacgggtacccttaacgtttaccccaacccgttaccgttaccccgtaacccggtaaacggtaaacgtaaaaccccgaaaacccgttaaaacccgttaaacccgtttaccccgtttaaccccgggttttacgtttaaacccgtttacccggtaaacgtaaaccgtttaaaacggtaacccgttaaaccggttaaccgggtaacccggttaaaggggttaaaccgggtaaacgggttaaacccggtaacccggttaaacggggtaacccggggttacccggttttaacccgtttaacgttttaaacgtttttaaacccggggttaacggttaaaccggggtaaaaaccgggttaaaaaaacccggggtaaacggggttaaaaccccgggggttaaaacgggtttaaaccgggttaaacccggggttttaaacccggggtttaaaaccggggggttttaccccgggggttttaaccccggggttttaaacgggtttttaaaccccccggggg

SEQ ID NO: 93982 - DNA, 790 bp, Homo sapiens
  misc_feature: GYAE6OF01CJMK3.29.85.H08.1.454.CMB.1.raw
  modified_base (547)..(547): a, c, t, g, unknown or other
  misc_feature (547)..(547): n is a, c, g, or t
tcagatagagtactcacgaccggtgctcgatttagtatcactcagtcgcggggggggtctcaggaggcagcactctcgggacgtctccaccatggcctggctctgctcctcctcagcctcctcactcgagggcacgaggatccgtgggctcgagtctcgccctgtactcacgtcctcgctcagtcggtccggtctccgtaggactagtaccgacgtaccacctacttccttccgtacgcctacgtacgaacctagaccgagaccgtagttcggtcggttagttaacttaacgttcgtccttaccgtacgtaaccaacctaaccgacccgtacggaccggaccccggacccccgtactaccgtaagtttaacttacgtagtagttacgtacgtaagttaccggtcccgtacccgtcggtaccgggtcctggtaccgtccgtacttccgttacgtccgtacctaccgtaacgttcggtacgacctaaccgtccgtccgtacccttccgtacgtaccctacgttccgtccgggtacggttcctacccggnggtctaacggtaccgttcggtacggttacggttattaaccgtttactacggtccgttacgttcgtaccttacgttcggtacccgtacgggaccgttaccctacgtaccgttaacggttcgtaaccgtttaccgggttcccgggtagggttaacccgggtaggaacccggttcggtaccgttaacccgggttaacccgtacccgggttaaccgacgggttacctccggtaaaccggtaccccgg

SEQ ID NO: 93983 - DNA, 905 bp, Homo sapiens
  misc_feature: GYAE6OF01B2MOP.29.85.H08.1.454.CMB.1.raw
  modified_base (176)..(176): a, c, t, g, unknown or other
  misc_feature (176)..(176): n is a, c, g, or t
tcagatagagtactcacgaccggtgctcgatttagtatcactcagtcgcggggggggtctcaggaggcagcactctcgggacgtctccaccatggcctggctctgctcctcctcagcctctcactcagggcacaggactcctgggctcagtctcgccctgactcacgcctcgctcnggtcggtccggtctccgtcggacaggtccaagtccaacctattccgtcctgccgtaacgtacggaacccaggcaggtcctagttcggttcggttacgttacttacgtttcgtccttcgtacgtaaccaaacaacctaccgtacggcccgtaccggaccccccagtactaacgttaacgtttacgtacgtacgtacgtacgtaaccgttacgggtcccggtccggttacgtaccggggttaccttacggaccggtttaccgtccgttttactccggttccgggttacctaaccgtaccgggttacggtacggttaacccaacccgttacccggttcccgtaccccgtacccgttacccgtaacccgtacgtttacccgttaccggggtaccggtaccccgttaccccggtacgggttccccggtaaggaaccccggtttacgggtaaccgggtacgggttttacgtttaaacccgtttacgttaccgttccgggtacttacggttaccctttaggttttaaccggtttaaccggcggttaacccgtccccggtaacccgaccggtttaaccgttccgggtttaactacccggggtttcccgggtttaacccggggaccggggttaacccgggaccgtttaaccgggtacccccgtttaacggggaaccccccgttcgggttaaccggggtaaccttacccggggtaaaccttcccggggttaaaccccgg

SEQ ID NO: 93984 - DNA, 154 bp, Homo sapiens
  misc_feature: GYAE6OF01CJ5HZ.29.85.H08.1.454.CMB.1.raw
  modified_base (151)..(154): a, c, t, g, unknown or other
  misc_feature (151)..(154): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgaggccgggctggcaaggcgcatgnnnn

SEQ ID NO: 93985 - DNA, 841 bp, Homo sapiens
  misc_feature: GYAE6OF01EY52O.29.85.H08.1.454.CMB.1.raw
  modified_base (246)..(246): a, c, t, g, unknown or other
  misc_feature (246)..(246): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacgaggactccgtgggctcagttcctcggccctgacctcacgcctcgctcgagtcgtccgggtctccgtaggactagtcacgtccaccgttctccgtgcgtagtcggaaccngacgtagtcggtacggtttggactcgttaacgtaaccgtcgtaccgtccgtacggtaacctacgccgacccggtacccccgaggtaccaacccgtacccgacccccctaaacgtccgtacgttacgttacgttttaccggaaccgttacgtaacgttaccgtcccggttacccgtaccggtacccggggttccctacggtacgttccgtccgttccgtcgttccgtacctacgtaacggtccgtacggactaaccgtaccgtccgtaccctacccgttaccgtaaccttaccgttccgtaccggtccggtacccgtcggttaccggtaccgtacggtaccgtacggttcggtaaccgggttagtttaaccgttcggttaaccgttccgtacgttcggttaccctttacggttaacgtttaccgggtcccggtaacccggtaccctacccggtaccgttaaccgttcgggttaccttaaccgggttcccggggtaccgggtaccggggtaaccggtacccgggttaccggtaccgttaccgggtaccccgttaacccggtttcggaacccgttcggacccgttccgggtaccccgg

SEQ ID NO: 93986 - DNA, 807 bp, Homo sapiens
  misc_feature: GYAE6OF01DYG0R.29.85.H08.1.454.CMB.1.raw
  modified_base (222)..(222): a, c, t, g, unknown or other
  misc_feature (222)..(222): n is a, c, g, or t
  modified_base (519)..(519): a, c, t, g, unknown or other
  misc_feature (519)..(519): n is a, c, g, or t
tcagatagagtactcacgaccggtgctcgatttagtatcactcagtcgcggggagctctgggagaggagcccccagcccctgagacttcccgaggtgtttccattcggtgatcagcactgaacacagagaacgcaccagtggtagttggactgtagtcgtttgggttttcctttggttgtactttaagttttaaaaggtgtaccgtagtgtagagtgcgagngtggtggaggtcggtggggtagttcggtaggtacgacggtcccggtcgggggtccctggacgtacctccgttccgtgtcgacgacgtccgtacggttaggttaaagttttaaaggttttaacggacgttacgtacgtccgtactaaggtaccggtaaccggttccggggtaccccgaccggtacggtcccggtaaccggggaagggggacgggtcggtagggtacgggttcgggtccgtaccggtagttagttaggtacggcgtagggtgggcggtcgtataagttattagttacgngtaccgacggaccgtccggtaacggaccgggttacccgttaccaccttacgttaccgaaaggtaacgtacgtaaacgtaacggaaagtacccgtagtaccgtacgttatacccgtaagaacgtaaaggtggaagtcccgtaagtacggacgtaccgcgaacccggtcgtaccgtccttagttatttacgttagggtaaacgtaaggcgtaacggacggttaaccgggaaacccggggttaccggggaacccccggttctaacgggtaacccggccgggtaaaccgggg

SEQ ID NO: 93987 - DNA, 748 bp, Homo sapiens
  misc_feature: GYAE6OF01BJP7N.29.85.H08.1.454.CMB.1.raw
  modified_base (219)..(219): a, c, t, g, unknown or other
  misc_feature (219)..(219): n is a, c, g, or t
tcagatagagtactcacgaccggtgctcgatttagtatcactcagtcggcggggggggtctcaggaggcagcactctcgggacgtctccaccatggcctgggctctgctcctcctcacgcctcctcactcgagggcacgaggatccgtgggctcacgttctcggccctgacctcacgtcctcgctcgaggttcggtccggtcctccgtggactagtccncggtaccaaccgtacttcctcctagaccacgtacggaaccaggccacggcgtagttcggttcggttaggtttaacttacgtttcgtcctacggttaccgtacctacgtaccgaccgaccccgaggacccaaccgtaacccgaacccctaactacgtaacgttcgtttacgttttacggcctacgtacgttaccgtccggtaccgtcggtaccggtcctacgtacgtccgtcgttctccggtacggtacctacgtcgtacgaccgacgtacgtcccggtccttcgtatacgttcgttccgtcggtccgtaactcccgaagtcgtacggacggacggacgtacgttacgtaagttcgttacgtacgctacggtaacctacgtaagtaaccgtaacgaaccgttactaactacggttacttaccggtaacgttacggtaaccggtaagtaacccggttaactccggtaaaccggttccgaacggttacccgacccgttaacccgacccgaccccgtaccgtaaccgttaccg

SEQ ID NO: 93988 - DNA, 883 bp, Homo sapiens
  misc_feature: GYAE6OF01DGRCC.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagacgcacatggagtttggactgagtcgttcgggttttccttggttgtctttaagtttttaaaagggtgttccaggttggtagtaaggtgccaggtcgtgggtggacggttcggtggggggacgtcggtaggtaccgacgggtcccgggttcgggggggttcccctaggtacgtaccttccgttccgttggtcgaccgtaccgtcccgtttacgttcgggtaactttaaccgttaaaggtttttaaactcggttttaacctttttacccaagtttaccgtaccggttttcgggggtcccgttaacgaaccggggtccggggttacggggggtaacgggttccggtaagggtcggttcgggttacttcgttaacgtttaagttacgtacggtaacggtcggtacgtaccttaactacttacgtttacgtacgacgtacgtacgtaccggtttgtacggtaagggtaccgggtaaccttacgtttaccaaccttcgtacctacggaaactaacgaaaccgaaaactaaacgttaacccgtaccgttacccgttagttactacgtaacggaaactaacgtaacgtaacgtcgttacgtaaggaagtacggtacgtaaccggagtaaccggttcggttacctttaaggtacgtttacgttaacgggtaacgtaaacgaaagggttacggaaacgggttacgtaacggggttacgttaaggggttaacccgggtttcgggggtttccgttagggtttaacccggg

SEQ ID NO: 93989 - DNA, 952 bp, Homo sapiens
  misc_feature: GYAE6OF01ELZC7.29.85.H08.1.454.CMB.1.raw
tcagatagagtactcacgaccggtgctcgatttagtatcactcagtcgcgggggggggtctcaggaggcagcactctcgggacgtctccaccatggcctgggctctgctcctcctcacgcctcctcactgagggcacaggactccgtgggctcagttctcgtcctcgactcacgcctcgcctcgtacggttcggttccgggttcttccgtcggaactacggttacgacggttaccaacctacttccgttaccgtcggtacctaacggtaaccggaaccgacggtaccgaaggtaccggtacggttcgggtttacggggttacgttttaaacgtttaccggttttacgtttcccgttaccgttaacgggtaaaaccctaaaccgtaaacccgtaacccggacggggaccccggtaaccccgggtaccccccgtaaacgttaccgttaaacgtttaaacgttttaacgttaggtaccgtttacggttaccgttaaacggttaaccgtacccgggtaccgttaccgggttaacccgggttacccggttacgtaaccggttccgttaccgttccgttcccggttaaccggtcccgtacctttaaccgggttacgtaccgggttaaccgtaaccgtaaccggttcccggtcccgttaccgtaacccgtaaccgtaaccgtttccgttaaccgttccgggttaccggtaccggtcggtaccgaacggttacggtaacgtacgggttcgttaacgtttacttaacgtttcgtccgttcgttaccgttcgttactttacggtcggttaccgtaccgggacccttacccggggaacttcggttacggtacggttaccggtcggttaccggggaccggggttaaccaacccgggtcggtacccggttaccggtaacccgggttccgaaccggttcgaaaccggtcccggtacgtaacccggg

SEQ ID NO: 93990 - DNA, 187 bp, Homo sapiens
  misc_feature: GYAE6OF01BBN2X.29.85.H08.1.454.CMB.1.raw
  modified_base (116)..(116): a, c, t, g, unknown or other
  misc_feature (116)..(116): n is a, c, g, or t
  modified_base (125)..(125): a, c, t, g, unknown or other
  misc_feature (125)..(125): n is a, c, g, or t
  modified_base (148)..(187): a, c, t, g, unknown or other
  misc_feature (148)..(187): n is a, c, g, or t
tcagatagagtactcacgaccggtgctcgatttagtatcactcagtcggcgggacacgactggagattaaatgaactgtggctgcaccatctgtcttcatcttccgccatctgaanagctactcngagcgggctgcaaggctcagtannnnnnnnnnnnnnnnnnnnnnnnnnnnnnnnnnnnnnnn

SEQ ID NO: 93991 - DNA, 696 bp, Homo sapiens
  misc_feature: GYAE6OF01ATRMI.29.85.H08.1.454.CMB.1.raw
  modified_base (177)..(177): a, c, t, g, unknown or other
  misc_feature (177)..(177): n is a, c, g, or t
  modified_base (192)..(192): a, c, t, g, unknown or other
  misc_feature (192)..(192): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggtttcctgttgctatttaaaggngtcagtgtgaagtgnagctggtggagtcgtgggggagtcgtggtacagcgtcgggggtcctaggacgactcgtccgtgtcgcagtcctcgtggtattactaagtttaatcgttaactttttccattacgtacgtacgggttccgtacgtaaagcccgtaccgggggtaacggtcgtagggaggtcggggttctcgttacttaatacgtcgtacggtacggtcgtactacgtacattccgtatacggcgtaagtaccttcgtacggttcggaacgggtcccgtaattcccgacctaacttccgtacccaaggacaaccaaccgtaaactaaccgttaccctcccgtttaaggaccttacgtaacgtacaaatccggtaaactacgttcgtacggaaggttaaggaaccgtaccgacgtaacggcgtccttagttaccgttagtccgtagtaaccggtaaaggacggaaggtaccgtaggaaccttacggttaacgggtcggttccgttcgggtttaacgg

SEQ ID NO: 93992 - DNA, 806 bp, Homo sapiens
  misc_feature: GYAE6OF01BDR2Y.29.85.H08.1.454.CMB.1.raw
tcagatagagtactcacgaccggtgctcgatttagtatcactcagtcgcggggggggtctcaggaggcagcactctcgggacgtctccaccatggcctggctctgctcctcctcagcctcctcactcagggcacgaggatcctgggctcagtctcgccctgactcagcctcgctcagtcgtccggtctccgtgacagtcagtcacctatcctcctgacctacgtacggaacctagccacggtcgtagttcggtcggttagttaacttaacgtttcgtccttaccgtacggtaaccctaacctaaccgtacccgacggacccggtacccggacccccccggtactaccgtaacgtttaacgtttacgtagtacgttacgtacgttaacgttaaccgggcccggtaccccgtacggtacccggggttccctacggtaccgttccgtcccgtttaccgttccgtaccggtacctacccgtaacggtccggtacggtacccgtaaacccgtaccgttaccggtaccccttacccgtaccgggtaccctacgttcccgttaccggtaccgggtaccctacccggtacgggtcctaccgggtaccggtacgtcggggtaaccggttacgttacctttaacgttaaccgtcgtccttaacggtcccttaggttaccgtttacgcgttaaccgccctacccggtacgtacgtcgtacggttacgtcccgggtacgggaccgggtacgaccgtcggtacccgtaccggtaacccgttaccggtaccggtagtaccgtacccggttacgaccccgg

SEQ ID NO: 93993 - DNA, 843 bp, Homo sapiens
  misc_feature: GYAE6OF01COXR1.29.85.H08.1.454.CMB.1.raw
  modified_base (717)..(717): a, c, t, g, unknown or other
  misc_feature (717)..(717): n is a, c, g, or t
  modified_base (796)..(796): a, c, t, g, unknown or other
  misc_feature (796)..(796): n is a, c, g, or t
tcagatagagtactcacgaccggtgctcgatttagtatcactcagtcggcggggggggtctcaggaggcagcactctcgggacgtctccaccatggcctgggctctgcctcctcctcacgcctcctcactcgacgggcacgaggactccgtgggcctcgacgtctccggtccctagtacctccgacgtcctccggtcctcgacggtcggttccgggtctaccgtacggactacgttcacgtaccacctactcctccgtcgtaccacggtaaccggaccgacgtacgacggtacgtaggttacgggttcggttacggtttaaacttacgttttccggttcccgttaccggttaaccggttaacccaaaaccggtaccgtaaccccggtacgggacccccgggaaaccccggtacccccccggtaactaccgtttaaaaccgtttaaggtttacgttacgggtaacctttacggttaaccgttaacccgggtaaaccgggtccccgggtccccggtttaacgggggtacccccggggtttaccttaacgggttaccctttcccggtttacctttaccggtcccgttacgtacccgtttacccgtaacggttaccgtaccgtacgtaaccttccgtccgtaccctccggtacactcgttacgtccgtcgtcctcggtacgtacgacgtgtacgtacggttagtctacgttactcgtagtntcccgtgttaacgtccgtaacggtcgacccggacttccgacggttctcgacgttcgaccggccgggtacgtaccggtcnccgggttccacccgggttccctacggtccaagtcgcaaccggtcccg

SEQ ID NO: 93994 - DNA, 736 bp, Homo sapiens
  misc_feature: GYAE6OF01D8QU5.29.85.H08.1.454.CMB.1.raw
  modified_base (244)..(244): a, c, t, g, unknown or other
  misc_feature (244)..(244): n is a, c, g, or t
  modified_base (631)..(631): a, c, t, g, unknown or other
  misc_feature (631)..(631): n is a, c, g, or t
tcagatagagtactcacgaccggtgctcgatttagtatcactcagtcgcggggggggtctcaggaggcagcactctcgggacgtctccaccatggcctgggctctgcctcctcctcacgcctcctcactcgacgggcacgaggatccgtcgggctcacgtctcgccctgactcacgcctcgctcaggttcgtccggtctcctggactacgtcacgttcacactctcctgcctacgtcggaaccngtcgaggacgtagttcgggtacggttaggttaactttacgtttcgtccttaccgtaccggttaaccaaaccaaccgtacccgaggtaccccggaccggtaccccccgtattacgtaaactttaagttttacgacgttaggtttcgttaactaacggttaaccgcccggttacccgtacgggtaacggggttccctgtaaccgttcgtccggttacgttcgaccgttccgtaccgtacgttccgagtaaccctaacgttccgtacccgtccgttaacccgtataaccgtcgtttccgtacgtcggtacccgttcggacggtcggtaagtaacctacgggttcggtaacggttacgtacgtttaacgtctcgtagtaccttgtacgttntcgtacgcgtacccgtaggctactggtcgtaccggttcgacgggtacggaacggctacggacccgtggtaaccgttccggagtcctacggtaacctgtacccggg

SEQ ID NO: 93995 - DNA, 745 bp, Homo sapiens
  misc_feature: GYAE6OF01CDSDR.29.85.H08.1.454.CMB.1.raw
  modified_base (652)..(652): a, c, t, g, unknown or other
  misc_feature (652)..(652): n is a, c, g, or t
  modified_base (734)..(734): a, c, t, g, unknown or other
  misc_feature (734)..(734): n is a, c, g, or t
tcagatagagtactcacgaccggtgctcgatttagtatcactcaggtcggcggggggggtctcaggaggcagcactcgtcgggacgtctccaccatggcctgggctctcgcctcctcctcacgtccctcctcactcgagggcacgaggtactccgtgggctcgtagtccgtcgcccgtgtacctcgacgtccgtctctacgtaggtccggtccggtactaccgtaggaactacgtaccgtacgacctacgtactccgttccacggtaccgacgaccggaacaggacacggtacgtgtcgggttaacgttacggttaactttacgttacgtccgttaacgtaccgaaccgtaaccaaccgaaccggacggacccggtaaccggtcccccgtaactactaactttaacgtacgtatacgtcgtaaccgtaacggtacggcccgtcgtaccggtccggacctgtctaccgtcggtctcgggtctacgtaccgtcgttcgactcaaccgtcctaccgcccgtaccgtcgtaccgtcttacggtccgtaccgtacgtcccggtacgtacggtacgtagtaccgttaggtaacgtatttacgttacctacggtctacgggtctcgtaacttccgtaccggactacccggacgtacccngttacgtacgtaccggtcgtacgggtaccgggtaaccggacgggtaacggcctacggtccgttaacggacgttcgtagcccnggtactcccgg

SEQ ID NO: 93996 - DNA, 824 bp, Homo sapiens
  misc_feature: GYAE6OF01CY15N.29.85.H08.1.454.CMB.1.raw
  modified_base (224)..(224): a, c, t, g, unknown or other
  misc_feature (224)..(224): n is a, c, g, or t
tcagatagagtactcacgaccggtgctcgatttagtatcactcagtcggcggggggggtctcaggaggcagcactcgtcgggactctccaccatggcctggctctgctcctcctcgacgtcctccgtcactcgacgggcaacgaggtctccgtgggcctcgtacgttcgtcgccctgacctccgacgtcctcgctctaggtcggttcccggtctccgcggtacnggtaccacgtcctaccgtccttcgcgaccgtaaggtaccgaacgtacgtcggtggtaccgttaggtcggttactaccgtttaacgtaccgttcggttacctaccggttaacgaaccgccgaccgtacccgaccccgacgggtaccaaccgaccccggaaccctaaccgttaccacgtttacgtttagttaccggtaacgtacggtaacgtaccggtccggtaccgtaccggttacgggtaccccaggttcgttcccgtttacgttacgtcggttacgtacgtaccgtcgttacggacgtacgacggtacccgtccgttaccggacgttcttaacgtccgtttcgtcgtccgtacaacgggccttaggaacggtacgacccgtagttaacgtaacgtttacgtgtaacgtacgtacggtaccttaaggttaaaccgcgtttaacccggggtaaacaaggtttacctaacggttttcccgaagggtttaccgtacccggtaaagaaccggtaaccgtaaccggttacccgtacgttaaccggtaccgtacccgaccgggttaaaccccaccggttaaccctcccgttacgtcgttaaccccg

SEQ ID NO: 93997 - DNA, 751 bp, Homo sapiens
  misc_feature: GYAE6OF01EAHO5.29.85.H08.1.454.CMB.1.raw
  modified_base (114)..(114): a, c, t, g, unknown or other
  misc_feature (114)..(114): n is a, c, g, or t
  modified_base (353)..(353): a, c, t, g, unknown or other
  misc_feature (353)..(353): n is a, c, g, or t
  modified_base (729)..(729): a, c, t, g, unknown or other
  misc_feature (729)..(729): n is a, c, g, or t
tcagatagagtactcacgaccggtgctcgatttagtatcactcagtcgcggggggggtctcaggaggcagcactctcgggactctccacctatggcctggctctgctcctcctnagcctcctcactcagggcacaggatccgtgggcttctagtctcgccctagtaacctcacgcctcgctcgaggtcgtccgggttctccgtggacaggtcacgtcacctatccgtcctgacacgtacggaaccagccagcgattcggtcgttaggttacttacctttgtcctactacggtaaccaaccaaccgaccgacggaccggaccggcccccgtactaccgtaattaacgttttagnggtacgttacgtacgtaacgtttaccggccgtacccgttacggtacggggttccctgtaccgttccgtcgtttcctcgtacgtacctaccgtacgttcgacggacctaaaccgtaccgtaccggtaccccttccgtaccgtaacctaacgttcccgtaccggtaccggtacctttaccccgaaggttaccgtacggtaaccgtacggttcgggtaaccgtagtttaacgtttacgttacgtacgtcgtacgtccttagttacgttcgacgtaccggtaccgtaccctatcggttaggtaccgttacggttccggacgggtacggtacgaaccgttacggtacccgttaaccggttaccccgtacggtacccgttanaccggtccgtacggtaacccgg

SEQ ID NO: 93998 - DNA, 819 bp, Homo sapiens
  misc_feature: GYAE6OF01AYT2U.29.85.H08.1.454.CMB.1.raw
  modified_base (167)..(167): a, c, t, g, unknown or other
  misc_feature (167)..(167): n is a, c, g, or t
  modified_base (194)..(194): a, c, t, g, unknown or other
  misc_feature (194)..(194): n is a, c, g, or t
  modified_base (291)..(291): a, c, t, g, unknown or other
  misc_feature (291)..(291): n is a, c, g, or t
  modified_base (322)..(322): a, c, t, g, unknown or other
  misc_feature (322)..(322): n is a, c, g, or t
  modified_base (807)..(807): a, c, t, g, unknown or other
  misc_feature (807)..(807): n is a, c, g, or t
  modified_base (809)..(809): a, c, t, g, unknown or other
  misc_feature (809)..(809): n is a, c, g, or t
  modified_base (812)..(812): a, c, t, g, unknown or other
  misc_feature (812)..(812): n is a, c, g, or t
  modified_base (814)..(814): a, c, t, g, unknown or other
  misc_feature (814)..(814): n is a, c, g, or t
  modified_base (816)..(819): a, c, t, g, unknown or other
  misc_feature (816)..(819): n is a, c, g, or t
tcagatagagtactcacgaccggtgctcgatttagtatcactcagtctgccctgactcagcctcgctcagtgtccgggtctcctggacagtcagtcaccatctcctgcactggaccagcagcgatggtcggttggttatactttgtctcctagtaccaacacaccgnggccgaccgcccccatcaattaacttntgattcgtactaacttaacggccggccctacggacggggttccctagacgtaccgtcttccgtccgtggaccctcgaagttccgtgaccgtaaaccnccgttccgcccgttacccgtacggtaacccncgttcgttccgtacggggtaccctccgggaggtccgttacggaaaggtcgttacgggtaaccgggttttaaaccgttttaacggttccgtgtacggtttctacccgtttacgttaaccgttttacgggacccgaccggtaccccgtaaacccccggtcttaacggttacgggtacttaacccgggtttttccggggaaccgggggaaacccgggtaacggggtaacccctaaccggtacccggttaccgggttaaaccccccgggttacggttacccggtaccggttaccggtaccgtaaacccggtacggtcccccgtttaccccggtaccccgttccgtaacccgttaacccgtccgttaccccccgttacccgttaccctaccccggttagtaccctaccgtttactaccgggtcgtaccgggtccgggtaccggtaacgtcggggaaccgaccgtcgttaccgagaccgtaggcaggctancngcncnannnn

SEQ ID NO: 93999 - DNA, 441 bp, Homo sapiens
  misc_feature: GYAE6OF01DJ5N8.29.85.H08.1.454.CMB.1.raw
  modified_base (387)..(387): a, c, t, g, unknown or other
  misc_feature (387)..(387): n is a, c, g, or t
  modified_base (390)..(441): a, c, t, g, unknown or other
  misc_feature (390)..(441): n is a, c, g, or t
tcagatagagtactcacgaccggtgctcgatttagtatcactcagtcgcgggtccctgatcgcttctctggctccaagtcctggccaacatcgcctccctgaccatctctggctccaggctgacgatggacggtgattacttactgctgcttctatttcgcgtacggcccaccccgctacttggtagtcgttccgttacggggacgggaaccgggaaccgaacgtccggtacgtacccggttccgtaacggttcgacggtcctacggaacggtccgtcccggtccccccgtacggtccgtacctccgttcccgttccccgttccctccgtacgtacttctactacgtacggtgacggccgggtacgtggacgacggacagtaacgtnagnnnnnnnnnnnnnnnnnnnnnnnnnnnnnnnnnnnnnnnnnnnnnnnnnnnn

SEQ ID NO: 94000 - DNA, 146 bp, Homo sapiens
  misc_feature: GYAE6OF02GQJS8.29.85.H08.1.454.CMB.1.raw
  modified_base (145)..(146): a, c, t, g, unknown or other
  misc_feature (145)..(146): n is a, c, g, or t
tcagatagagtactcacgaccggtgctcgattagtatcactcagtcgcggacacgactggagattaacgaactgtggctgcaccatctgtcttcatcttccgccatctgaatagcgtactctgagcggctggcaaggcgcatagnn

SEQ ID NO: 94001 - DNA, 150 bp, Homo sapiens; identical to SEQ ID NO: 93401
  misc_feature: GYAE6OF02GYJZV.29.85.H08.1.454.CMB.1.raw
  modified_base (150)..(150): a, c, t, g, unknown or other
  misc_feature (150)..(150): n is a, c, g, or t

SEQ ID NO: 94002 - DNA, 151 bp, Homo sapiens; identical to SEQ ID NO: 93409
  misc_feature: GYAE6OF02F9RL9.29.85.H08.1.454.CMB.1.raw
  modified_base (150)..(151): a, c, t, g, unknown or other
  misc_feature (150)..(151): n is a, c, g, or t

SEQ ID NO: 94003 - DNA, 150 bp, Homo sapiens; identical to SEQ ID NO: 93401
  misc_feature: GYAE6OF02H2N68.29.85.H08.1.454.CMB.1.raw
  modified_base (150)..(150): a, c, t, g, unknown or other
  misc_feature (150)..(150): n is a, c, g, or t

SEQ ID NO: 94004 - DNA, 150 bp, Homo sapiens
  misc_feature: GYAE6OF02HW662.29.85.H08.1.454.CMB.1.raw
  modified_base (149)..(150): a, c, t, g, unknown or other
  misc_feature (149)..(150): n is a, c, g, or t
tcagatagagtactcacgaccggtgctcgatttagtatcactcagtcgcgggacacgactggagattaaacgaactgtggctgcaccatctgtcttcatcttccgccatctgaatagcgtactctgagcgggctggcaaggcgcatagnn

SEQ ID NO: 94005 - DNA, 150 bp, Homo sapiens
  misc_feature: GYAE6OF02H6FJ2.29.85.H08.1.454.CMB.1.raw
  modified_base (149)..(150): a, c, t, g, unknown or other
  misc_feature (149)..(150): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcggctggcaaggcgcatagnn

SEQ ID NO: 94006 - DNA, 152 bp, Homo sapiens
  misc_feature: GYAE6OF02J1JKP.29.85.H08.1.454.CMB.1.raw
  modified_base (148)..(152): a, c, t, g, unknown or other
  misc_feature (148)..(152): n is a, c, g, or t
tcagatagagtactcacgaccggtgctcgatttagtatcactcagtcgcgggacacgactggagattaacgaactgtggctgcaccatctgtcttcatcttcccgccatctgaatagcgtactctgagcggctggcaaggcgcatagnnnnn

SEQ ID NO: 94007 - DNA, 151 bp, Homo sapiens; identical to SEQ ID NO: 93409
  misc_feature: GYAE6OF02HC2O2.29.85.H08.1.454.CMB.1.raw
  modified_base (150)..(151): a, c, t, g, unknown or other
  misc_feature (150)..(151): n is a, c, g, or t

SEQ ID NO: 94008 - DNA, 465 bp, Homo sapiens
  misc_feature: GYAE6OF02HD13Y.29.85.H08.1.454.CMB.1.raw
  modified_base (450)..(450): a, c, t, g, unknown or other
  misc_feature (450)..(450): n is a, c, g, or t
  modified_base (456)..(465): a, c, t, g, unknown or other
  misc_feature (456)..(465): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcacccgcactgtgatcttcggcggagggaccaagctgaccgtctaggtcagctcaaggctcgcccctcggtcacttctcgttcccaccctctcacgtactctatctgagcgggctggcaaggcncatagnnnnnnnnnn

SEQ ID NO: 94009 - DNA, 158 bp, Homo sapiens
  misc_feature: GYAE6OF02HJY8S.29.85.H08.1.454.CMB.1.raw
  modified_base (151)..(158): a, c, t, g, unknown or other
  misc_feature (151)..(158): n is a, c, g, or t
tcagatagagtactcacgaccggtgctcgatttagtatcactcagtcgcgggacgacgactggagattaaacgaactgtggctgcaccatctgtcttcatcttcccgccatctgaatagcgtactctgagcgggctggcaaggcgcatagnnnnnnnn

SEQ ID NO: 94010 - DNA, 150 bp, Homo sapiens; identical to SEQ ID NO: 93401
  misc_feature: GYAE6OF02IOT98.29.85.H08.1.454.CMB.1.raw
  modified_base (150)..(150): a, c, t, g, unknown or other
  misc_feature (150)..(150): n is a, c, g, or t

SEQ ID NO: 94011 - DNA, 150 bp, Homo sapiens; identical to SEQ ID NO: 93401
  misc_feature: GYAE6OF02F94FO.29.85.H08.1.454.CMB.1.raw
  modified_base (150)..(150): a, c, t, g, unknown or other
  misc_feature (150)..(150): n is a, c, g, or t

SEQ ID NO: 94012 - DNA, 151 bp, Homo sapiens; identical to SEQ ID NO: 93409
  misc_feature: GYAE6OF02G5VWI.29.85.H08.1.454.CMB.1.raw
  modified_base (150)..(151): a, c, t, g, unknown or other
  misc_feature (150)..(151): n is a, c, g, or t

SEQ ID NO: 94013 - DNA, 150 bp, Homo sapiens; identical to SEQ ID NO: 93401
  misc_feature: GYAE6OF02GYJIF.29.85.H08.1.454.CMB.1.raw
  modified_base (150)..(150): a, c, t, g, unknown or other
  misc_feature (150)..(150): n is a, c, g, or t

SEQ ID NO: 94014 - DNA, 149 bp, Homo sapiens; identical to SEQ ID NO: 93464
  misc_feature: GYAE6OF02GD4ZA.29.85.H08.1.454.CMB.1.raw

SEQ ID NO: 94015 - DNA, 162 bp, Homo sapiens
  misc_feature: GYAE6OF02G43B5.29.85.H08.1.454.CMB.1.raw
  modified_base (151)..(162): a, c, t, g, unknown or other
  misc_feature (151)..(162): n is a, c, g, or t
tcagatagagtactcacgaccggtgctcgatttagtatcactcaggtcgcgggacacgactggagattaaacgaactgtggctgcaccatctgtcttcatcttcccgccatctgaatagcgtactctgagcgggctggcaaggcgcatagnnnnnnnnnnnn

SEQ ID NO: 94016 - DNA, 151 bp, Homo sapiens; identical to SEQ ID NO: 93409
  misc_feature: GYAE6OF02IRKSD.29.85.H08.1.454.CMB.1.raw
  modified_base (150)..(151): a, c, t, g, unknown or other
  misc_feature (150)..(151): n is a, c, g, or t

SEQ ID NO: 94017 - DNA, 205 bp, Homo sapiens
  misc_feature: GYAE6OF02GBJHK.29.85.H08.1.454.CMB.1.raw
  modified_base (155)..(205): a, c, t, g, unknown or other
  misc_feature (155)..(205): n is a, c, g, or t
tcagatagagtactcacgaccggtgctcgatttagtatcactcagtcgcgggacgacgactggagattaaacgaacgtgtggctgcaccatctgtcttcatcttacccgccatctgaatagcgtactctgagcgggctggccaaggcgcataggnnnnnnnnnnnnnnnnnnnnnnnnnnnnnnnnnnnnnnnnnnnnnnnnnnn

SEQ ID NO: 94018 - DNA, 149 bp, Homo sapiens; identical to SEQ ID NO: 93464
  misc_feature: GYAE6OF02IAC7H.29.85.H08.1.454.CMB.1.raw

SEQ ID NO: 94019 - DNA, 150 bp, Homo sapiens; identical to SEQ ID NO: 93401
  misc_feature: GYAE6OF02HE8VK.29.85.H08.1.454.CMB.1.raw
  modified_base (150)..(150): a, c, t, g, unknown or other
  misc_feature (150)..(150): n is a, c, g, or t

SEQ ID NO: 94020 - DNA, 147 bp, Homo sapiens; identical to SEQ ID NO: 93400
  misc_feature: GYAE6OF02HABIF.29.85.H08.1.454.CMB.1.raw
  modified_base (147)..(147): a, c, t, g, unknown or other
  misc_feature (147)..(147): n is a, c, g, or t

SEQ ID NO: 94021 - DNA, 152 bp, Homo sapiens; identical to SEQ ID NO: 93475
  misc_feature: GYAE6OF02JHZZW.29.85.H08.1.454.CMB.1.raw
  modified_base (150)..(152): a, c, t, g, unknown or other
  misc_feature (150)..(152): n is a, c, g, or t

SEQ ID NO: 94022 - DNA, 150 bp, Homo sapiens; identical to SEQ ID NO: 93401
  misc_feature: GYAE6OF02GA3RH.29.85.H08.1.454.CMB.1.raw
  modified_base (150)..(150): a, c, t, g, unknown or other
  misc_feature (150)..(150): n is a, c, g, or t

SEQ ID NO: 94023 - DNA, 150 bp, Homo sapiens; identical to SEQ ID NO: 93401
  misc_feature: GYAE6OF02GVHAX.29.85.H08.1.454.CMB.1.raw
  modified_base (150)..(150): a, c, t, g, unknown or other
  misc_feature (150)..(150): n is a, c, g, or t

SEQ ID NO: 94024 - DNA, 150 bp, Homo sapiens; identical to SEQ ID NO: 93401
  misc_feature: GYAE6OF02I3WBK.29.85.H08.1.454.CMB.1.raw
  modified_base (150)..(150): a, c, t, g, unknown or other
  misc_feature (150)..(150): n is a, c, g, or t

SEQ ID NO: 94025 - DNA, 150 bp, Homo sapiens; identical to SEQ ID NO: 93401
  misc_feature: GYAE6OF02G06DI.29.85.H08.1.454.CMB.1.raw
  modified_base (150)..(150): a, c, t, g, unknown or other
  misc_feature (150)..(150): n is a, c, g, or t

SEQ ID NO: 94026 - DNA, 490 bp, Homo sapiens
  misc_feature: GYAE6OF02GTN2C.29.85.H08.1.454.CMB.1.raw
  modified_base (392)..(392): a, c, t, g, unknown or other
  misc_feature (392)..(392): n is a, c, g, or t
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
  modified_base (485)..(485): a, c, t, g, unknown or other
  misc_feature (485)..(485): n is a, c, g, or t
tcagatagagtactcacgaccggtgctcgatttagtatcactcagtcgcgggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacactgcctcctgaccatctctggctcaggctgacgntgacgtgattattactgctgctnatttgcaggcacccgnacgtgtgattcgttcggcggaggaccaagctggacccgtcgtaggtccagtctnaacgg

SEQ ID NO: 94027 - DNA, 150 bp, Homo sapiens; identical to SEQ ID NO: 93401
  misc_feature: GYAE6OF02HUGME.29.85.H08.1.454.CMB.1.raw
  modified_base (150)..(150): a, c, t, g, unknown or other
  misc_feature (150)..(150): n is a, c, g, or t

SEQ ID NO: 94028 - DNA, 150 bp, Homo sapiens; identical to SEQ ID NO: 93401
  misc_feature: GYAE6OF02GYDFU.29.85.H08.1.454.CMB.1.raw
  modified_base (150)..(150): a, c, t, g, unknown or other
  misc_feature (150)..(150): n is a, c, g, or t

SEQ ID NO: 94029 - DNA, 197 bp, Homo sapiens
  misc_feature: GYAE6OF02G5G7B.29.85.H08.1.454.CMB.1.raw
  modified_base (149)..(149): a, c, t, g, unknown or other
  misc_feature (149)..(149): n is a, c, g, or t
  modified_base (156)..(162): a, c, t, g, unknown or other
  misc_feature (156)..(162): n is a, c, g, or t
  modified_base (164)..(197): a, c, t, g, unknown or other
  misc_feature (164)..(197): n is a, c, g, or t
tcagatagagtactcacgaccggtgctcgatttagtatcactcagttcggtcggggacacgactggagattaaacgaactgtggctgcaccatctgtcttcatcttccccgcattctgaatagcgtactctgagcgggctggcaaggcncatagcnnnnnnncnnnnnnnnnnnnnnnnnnnnnnnnnnnnnnnnnn

SEQ ID NO: 94030 - DNA, 150 bp, Homo sapiens; identical to SEQ ID NO: 93401
  misc_feature: GYAE6OF02IYU6L.29.85.H08.1.454.CMB.1.raw
  modified_base (150)..(150): a, c, t, g, unknown or other
  misc_feature (150)..(150): n is a, c, g, or t

SEQ ID NO: 94031 - DNA, 150 bp, Homo sapiens; identical to SEQ ID NO: 93401
  misc_feature: GYAE6OF02F1782.29.85.H08.1.454.CMB.1.raw
  modified_base (150)..(150): a, c, t, g, unknown or other
  misc_feature (150)..(150): n is a, c, g, or t

SEQ ID NO: 94032 - DNA, 506 bp, Homo sapiens
  misc_feature: GYAE6OF02GXY96.29.85.H08.1.454.CMB.1.raw
  modified_base (433)..(433): a, c, t, g, unknown or other
  misc_feature (433)..(433): n is a, c, g, or t
  modified_base (484)..(484): a, c, t, g, unknown or other
  misc_feature (484)..(484): n is a, c, g, or t
  modified_base (486)..(489): a, c, t, g, unknown or other
  misc_feature (486)..(489): n is a, c, g, or t
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (502)..(502): a, c, t, g, unknown or other
  misc_feature (502)..(502): n is a, c, g, or t
  modified_base (504)..(505): a, c, t, g, unknown or other
  misc_feature (504)..(505): n is a, c, g, or t
tcagatagagtactcacgaccggtgctcgatttagtatcactcagtcgtgcccgtgactcagcctcgctcagtgtccgggtctcctggacagtcagtcaccatctcctgcactggaaccagcagcgatgtcggtggttataactttgtctcctggtaccaacaacacccaggccgaggccccccgactcactaatttatgatgtctattaagcggcctcaggggtccctgatcgcttctctggctccaagtctggacaacactgccctcctcgaccatctctgggctccaggctgacgatcggaccggtgaatttattacctgctgcttcatttgcaggccaccggcactgtcgatccgttcgggcggagggaccaaggccgtacggaccgtcgtaggtcagctcaggctcgcccgtgcacttctcgttcccncctctctacgtctcgtatcgtgacggcggcgtcggcaaggcgacagtacgncnnnncntcncncnctcncnnc

SEQ ID NO: 94033 - DNA, 150 bp, Homo sapiens; identical to SEQ ID NO: 93401
  misc_feature: GYAE6OF02IP21C.29.85.H08.1.454.CMB.1.raw
  modified_base (150)..(150): a, c, t, g, unknown or other
  misc_feature (150)..(150): n is a, c, g, or t

SEQ ID NO: 94034 - DNA, 154 bp, Homo sapiens; identical to SEQ ID NO: 93449
  misc_feature: GYAE6OF02I2DRM.29.85.H08.1.454.CMB.1.raw
  modified_base (150)..(154): a, c, t, g, unknown or other
  misc_feature (150)..(154): n is a, c, g, or t

SEQ ID NO: 94035 - DNA, 149 bp, Homo sapiens; identical to SEQ ID NO: 93464
  misc_feature: GYAE6OF02F1I4U.29.85.H08.1.454.CMB.1.raw

SEQ ID NO: 94036 - DNA, 159 bp, Homo sapiens
  misc_feature: GYAE6OF02GNBFN.29.85.H08.1.454.CMB.1.raw
  modified_base (150)..(159): a, c, t, g, unknown or other
  misc_feature (150)..(159): n is a, c, g, or t
tcagatagagtactcacgaccggtgctcgatttagtatcactcagtcgcgggacacggactggagattaaacgaactgtggctgcaccatctgtcttcatcttcccgcatctgaatagcgtactctgagcgggctggcaaggcgcatagnnnnnnnnnn

SEQ ID NO: 94037 - DNA, 150 bp, Homo sapiens; identical to SEQ ID NO: 93401
  misc_feature: GYAE6OF02GRBU0.29.85.H08.1.454.CMB.1.raw
  modified_base (150)..(150): a, c, t, g, unknown or other
  misc_feature (150)..(150): n is a, c, g, or t

SEQ ID NO: 94038 - DNA, 151 bp, Homo sapiens; identical to SEQ ID NO: 93409
  misc_feature: GYAE6OF02FQCBN.29.85.H08.1.454.CMB.1.raw
  modified_base (150)..(151): a, c, t, g, unknown or other
  misc_feature (150)..(151): n is a, c, g, or t

SEQ ID NO: 94039 - DNA, 150 bp, Homo sapiens; identical to SEQ ID NO: 93401
  misc_feature: GYAE6OF02HEXTV.29.85.H08.1.454.CMB.1.raw
  modified_base (150)..(150): a, c, t, g, unknown or other
  misc_feature (150)..(150): n is a, c, g, or t

SEQ ID NO: 94040 - DNA, 149 bp, Homo sapiens; identical to SEQ ID NO: 93464
  misc_feature: GYAE6OF02H9YHD.29.85.H08.1.454.CMB.1.raw

SEQ ID NO: 94041 - DNA, 150 bp, Homo sapiens; identical to SEQ ID NO: 93401
  misc_feature: GYAE6OF02FJCMR.29.85.H08.1.454.CMB.1.raw
  modified_base (150)..(150): a, c, t, g, unknown or other
  misc_feature (150)..(150): n is a, c, g, or t

SEQ ID NO: 94042 - DNA, 200 bp, Homo sapiens
  misc_feature: GYAE6OF02HPPPE.29.85.H08.1.454.CMB.1.raw
  modified_base (159)..(200): a, c, t, g, unknown or other
  misc_feature (159)..(200): n is a, c, g, or t
tcagatagagtactcacgaccggtgctcgatttagtatcactcagtcggtcggggacacgactggagattaaacgaacctgtggctgcaccactctgtcttcattcttcccgccatctgaatagcgtactctgagccgggctgggcaaggcgcattagnnnnnnnnnnnnnnnnnnnnnnnnnnnnnnnnnnnnnnnnnn

SEQ ID NO: 94043 - DNA, 495 bp, Homo sapiens
  misc_feature: GYAE6OF02IGTFN.29.85.H08.1.454.CMB.1.raw
tcagatagagtactcacgaccggtgctcgatttagtatcactcagtcgcggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttataactttgtctcctggtaccaacaacacccaggcgacggccccccgactcataatttatgatgtcatttaagcggccctcgaggggtccctgatcgcttctctgctccagtctggcaacactgcctccctgaccatctctgggctccagctgacgatgacggtgattattactgctgcttcatttgcaggccacccgcaactgtgatcgttcgggcggaggaccaagctgaccgtccgtaggtcagtctgaacgg

SEQ ID NO: 94044 - DNA, 419 bp, Homo sapiens
  misc_feature: GYAE6OF02IDGW2.29.85.H08.1.454.CMB.1.raw
  modified_base (211)..(211): a, c, t, g, unknown or other
  misc_feature (211)..(211): n is a, c, g, or t
  modified_base (404)..(419): a, c, t, g, unknown or other
  misc_feature (404)..(419): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacnctgcctccctgaccatctctgggctccaggctgacgatgacggtgattattactgctgctcatttgcaggcaccgcactgtgatcttcggcgagggaccaagctgaccgtcaggtcagctcaaggctgcccctggtcactctcgttcccaccctctcagtactctatctgagcgggctggcaaggcacatagnnnnnnnnnnnnnnnn

SEQ ID NO: 94045 - DNA, 153 bp, Homo sapiens; identical to SEQ ID NO: 93437
  misc_feature: GYAE6OF02FS612.29.85.H08.1.454.CMB.1.raw
  modified_base (150)..(153): a, c, t, g, unknown or other
  misc_feature (150)..(153): n is a, c, g, or t

SEQ ID NO: 94046 - DNA, 484 bp, Homo sapiens
  misc_feature: GYAE6OF02HL1G6.29.85.H08.1.454.CMB.1.raw
  modified_base (438)..(438): a, c, t, g, unknown or other
  misc_feature (438)..(438): n is a, c, g, or t
tcagatagagtactcacgaccggtgctcgatttagtatcactcagtcgcgggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataattatgatgtcattaagcggcctcaggggtccctgatcgcttctctggctccaagtctggcaacactgcctccctgaccatctctgggctccaggctgacgatgacggtgattatactgctgctcatttgcaggccaccgcactgtnattcttcggcggaggaccaagctgacccgtctaggcagctcaacgg

SEQ ID NO: 94047 - DNA, 531 bp, Homo sapiens
  misc_feature: GYAE6OF02F5VW4.29.85.H08.1.454.CMB.1.raw
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagagatgtcggtggttataactttgtctcctggtaccaacaacacccaggcgaggccccccgatccataatttatgatgtcattaagcgccctcacggggtccctgatcgcttctctggctccaagtctggcaacactgccctcctgaccatctctgggctccaggctgacgatgacgtgattattactgcttgctctatttcgcacggccacccgctacgtgtcgacttccgtcgggcggaacgggtacccaaggtccgttacggacccggtttccgtaacgggtcacggtcgtaccgtaacggg

SEQ ID NO: 94048 - DNA, 506 bp, Homo sapiens
  misc_feature: GYAE6OF02G2A2D.29.85.H08.1.454.CMB.1.raw
tcagatagagtactcacgaccggtgctcgatttagtatcactcagtcgcggggggtctcaggaggcagcactctcgggacgtctccaccatggcctgggctctgctcctcctcagcctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagcccccaggcacagccccaaactcatgattttgacgtcagtaatcggccctcagggtccctgatcgcttctctggtccaagtctggcagcacggcctccctgattatctctgggctccagactgaggacgaggctgaattattattgcagctcatatacaagggacaacacttatgtcttcggactggaccaagtcaccgtctacggtcacgcccaaggcccaacccactcgtacactccg

SEQ ID NO: 94049 - DNA, 530 bp, Homo sapiens
  misc_feature: GYAE6OF02G17GD.29.85.H08.1.454.CMB.1.raw
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagccggccctcgaggggtccctgactcgcttctctggctccaagtctggcaacactcgccctccctgaccatcctctgggcctccgaggctgacgatggacggtgaatttattactgctgccttctatttgcaggccacccgcacgtgtgacttccgttcgggcgggtaagggacccaaggccgtacggacccgttccgtaggtccaggcctacaaccggg

SEQ ID NO: 94050 - DNA, 150 bp, Homo sapiens; identical to SEQ ID NO: 93401
  misc_feature: GYAE6OF02HHSCD.29.85.H08.1.454.CMB.1.raw
  modified_base (150)..(150): a, c, t, g, unknown or other
  misc_feature (150)..(150): n is a, c, g, or t

SEQ ID NO: 94051 - DNA, 186 bp, Homo sapiens
  misc_feature: GYAE6OF02H7HZD.29.85.H08.1.454.CMB.1.raw
  modified_base (155)..(186): a, c, t, g, unknown or other
  misc_feature (155)..(186): n is a, c, g, or t
tcagatagagtactcacgaccggtgctcgatttagtatcactcagtcggcgggacacgacctggagattaaacgaactgtggctgcaccatctgtcttcatcttcccgccatctgaatagcgtactcttgagcgggctggctaaggcgcatagannnnnnnnnnnnnnnnnnnnnnnnnnnnnnnn

SEQ ID NO: 94052 - DNA, 431 bp, Homo sapiens
  misc_feature: GYAE6OF02GDMYW.29.85.H08.1.454.CMB.1.raw
  modified_base (258)..(258): a, c, t, g, unknown or other
  misc_feature (258)..(258): n is a, c, g, or t
  modified_base (290)..(290): a, c, t, g, unknown or other
  misc_feature (290)..(290): n is a, c, g, or t
  modified_base (404)..(404): a, c, t, g, unknown or other
  misc_feature (404)..(404): n is a, c, g, or t
  modified_base (411)..(431): a, c, t, g, unknown or other
  misc_feature (411)..(431): n is a, c, g, or t
tcagatagagtactcacgaccggtgctcgatttagtatcactcagtcgagtcaccatctcctgcactggaaccagcagcgatgtcggtggttataactttgtctccgtggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtnattattactgctgctcatttgcaggcacccgnactgtgatcttcggcggaggaccaagctgaccgtcctaggtcagctcaaggctgccccctggtcactctcgttcccgccctctcacgtactctatctgagcggctggcaaggcncatacgnnnnnnnnnnnnnnnnnnnnn

SEQ ID NO: 94053 - DNA, 531 bp, Homo sapiens
  misc_feature: GYAE6OF02HYRV6.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcgtggtttcctgttgctatttaaaggtgtcagtgtgaagtgcagctggtggagtctgggggagtcgtggtacagcctggggggtccctgagactctcctgtgcagcctctggattaagttttaggagttcatgccatgaactgggtccgccaggctccgagggaagggctgggagtgggtctcggctagttagtggcaggtggtggcgctatatattatgcagacgccctgaacgggccgttcacctatttccagagacaattcgaagaacacgctgtatctgacaaatggagagcctgagactcgacgacacggcgtctattatgtagttaaggcgtagcgtaggaactacggggaccgggcccgacgttcgacctacgg

SEQ ID NO: 94054 - DNA, 187 bp, Homo sapiens
  misc_feature: GYAE6OF02FYKDW.29.85.H08.1.454.CMB.1.raw
  modified_base (152)..(187): a, c, t, g, unknown or other
  misc_feature (152)..(187): n is a, c, g, or t
tcagatagagtactcacgaccggtgctcgatttagtatcactcagtcgcggggacacgactggagattaaacgaactgtggctgcaccatctgtcttcatcttcccgccatctgaatagcgtactctggagcgggctggcaaggcgcatagnnnnnnnnnnnnnnnnnnnnnnnnnnnnnnnnnnnn

SEQ ID NO: 94055 - DNA, 501 bp, Homo sapiens
  misc_feature: GYAE6OF02GMQT7.29.85.H08.1.454.CMB.1.raw
  modified_base (296)..(296): a, c, t, g, unknown or other
  misc_feature (296)..(296): n is a, c, g, or t
  modified_base (404)..(404): a, c, t, g, unknown or other
  misc_feature (404)..(404): n is a, c, g, or t
  modified_base (496)..(496): a, c, t, g, unknown or other
  misc_feature (496)..(496): n is a, c, g, or t
tcagatagagtactcacgaccggtgctcgatttagtatcactcagtcgcggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctctggtaccaacaacacccaggcgaggcccccgatcataatttangatgtcattaagcggccctgaggggtccctgactcgcttctctggctccaagtctggcaacactgccctccctgaccatctctgggctccaggctgacgatgacggtnattattactgctgctctatttgctaggccacccgcaacgtgtgtacttcgttcgggcggaggaccaaggctggacccgtcgtaggccagctnaacgg

SEQ ID NO: 94056 - DNA, 539 bp, Homo sapiens
  misc_feature: GYAE6OF02JJMP1.29.85.H08.1.454.CMB.1.raw
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (228)..(228): a, c, t, g, unknown or other
  misc_feature (228)..(228): n is a, c, g, or t
  modified_base (516)..(516): a, c, t, g, unknown or other
  misc_feature (516)..(516): n is a, c, g, or t
  modified_base (533)..(534): a, c, t, g, unknown or other
  misc_feature (533)..(534): n is a, c, g, or t
  modified_base (536)..(536): a, c, t, g, unknown or other
  misc_feature (536)..(536): n is a, c, g, or t
  modified_base (538)..(539): a, c, t, g, unknown or other
  misc_feature (538)..(539): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttattaacttgtctcctgtacaacaacaccaggcgacgccccgactcataattatgatgtnatagcgcctcgacgggtccntcgatcgctnctnctgctcacgtactcgcacgacctcgcctaccctacgtacctactccgtcgtcggacgtccgacggaccgtagtacgagtacgacggtagtattatactagtctgtctcgtattgactacggcaccgcacgtacgtacgtacgtcgtacggacggaacgggaccgaacggacgtacgtaccgtaccgtacggtacgtacgacgtacgacgccgtacgtcccgtacgtacctacgtcctactcctacctacctacctactactactactcgtacgacgcggcgacgcagnacgacgacgtacgagannanann

SEQ ID NO: 94057 - DNA, 467 bp, Homo sapiens
  misc_feature: GYAE6OF02IRK62.29.85.H08.1.454.CMB.1.raw
  modified_base (334)..(334): a, c, t, g, unknown or other
  misc_feature (334)..(334): n is a, c, g, or t
  modified_base (456)..(467): a, c, t, g, unknown or other
  misc_feature (456)..(467): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcagggggtccctgatcgcttctctggctccaagtctggcaacactgcctccctgaccatctctgggctccaggctgacgatgacggtgattattactgctgctcatttgcaggcacccgnactgtgatcttcggcggagggaccaagctgaccgtcctaggtcagctcaaggctgcccctcggtcactctcgttcccacctcctcagtactctatctgagcggctggcaaggcgacagtagnnnnnnnnnnnn

SEQ ID NO: 94058 - DNA, 503 bp, Homo sapiens
  misc_feature: GYAE6OF02HPX0E.29.85.H08.1.454.CMB.1.raw
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttataactttgtctctgtaccaacaacacccaggcgacggcccccgactcataatttatgatgtcattaagcgcctcaggggtccctgatcgcttctctgctcaagtctggcaacactgcctccctgaccatctctgggctccgaggctgacgatgacggtgatttattactgctgctctatttgctaggccaacccgcaccgtgtcgtattcgttcgggcggacgggaccaagcctgtacccgtctaggtcacgctacgaacgg

SEQ ID NO: 94059 - DNA, 477 bp, Homo sapiens
  misc_feature: GYAE6OF02FXPDB.29.85.H08.1.454.CMB.1.raw
  modified_base (260)..(260): a, c, t, g, unknown or other
  misc_feature (260)..(260): n is a, c, g, or t
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
tcagatagagtactcacgaccggtgctcgatttagtatcactcagtcgcggggggtctcaggaggcagcactctcgggacgtctccaccatggcctgggctctgctcctcctcagcctcctcactcagggcacaggatcctgggctcagtctgccccgactcagcctcgctcagtgtccgggtctcctggacagtcagtcaccatctcctgcactggaaccagcagcgatgtcgtgttatacttgtctcctggtaccaanacacccaggcaggcccccgatcataattangatgtcattaagcgcctnagggtccctgatcgcttctctggctcaagtctggcaacactgccctcctgaccatctctggctccaggctgacgatgacggtgattatactgctgcttcatttgctaggcaccgcactgtgatcttcggcgagggaccaaggctgaccgtctaggtcagctcgaggtcc

SEQ ID NO: 94060 - DNA, 551 bp, Homo sapiens
  misc_feature: GYAE6OF02I9N8C.29.85.H08.1.454.CMB.1.raw
  modified_base (297)..(297): a, c, t, g, unknown or other
  misc_feature (297)..(297): n is a, c, g, or t
  modified_base (353)..(353): a, c, t, g, unknown or other
  misc_feature (353)..(353): n is a, c, g, or t
tcagatagagtactcacgaccggtgctcgatttagtatcactcagtcgcggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttataactttgtctcctggtaccaacaacaccaggcgacggcccccgactcataatttangatgtcattaagcgcctgaggggtccctgatcgcttctctgctcaagtctggcacnctgccctcctgaccatctcgtcgggctccgaggctggacgtagtcggacggttgtaatttacttactcgtcttcgtcttctacgttttgacgtacggccacccgtcacgttgtacgacgttccgttaccgggcgggacgggtaacctaacggtccgtacggtacccgttccgtagggtcccacggtcctacgaaccgg

SEQ ID NO: 94061 - DNA, 528 bp, Homo sapiens
  misc_feature: GYAE6OF02IFE7S.29.85.H08.1.454.CMB.1.raw
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagcctggggggtccctgagactctcctgtgcagcctctggattcaagtttaangtatttttccatacactgggtcctnaagctccggggaaggtctggagtgggtctctcttattaatcgagacggtgctactacattctatgcagactctgtgaagggccatcaccatctccagagacaaacaacaaagtactacctgtatctgacaaatgaacagtctgaagaagtcgaagacagcggctttctattattgtgacctaaaagagaaggcaggatactaaaggtgggtcgtcgtttacg

SEQ ID NO: 94062 - DNA, 419 bp, Homo sapiens
  misc_feature: GYAE6OF02HLPDM.29.85.H08.1.454.CMB.1.raw
  modified_base (409)..(419): a, c, t, g, unknown or other
  misc_feature (409)..(419): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcacccgcactgtgatcttcggcggagggaccaagctgaccgtctaggtcagctcaaggctcgcccctggtcactctcgttcccgccctcctcagtactctatctgagcgggctggcaaggcgcatagnnnnnnnnnnn

SEQ ID NO: 94063 - DNA, 151 bp, Homo sapiens; identical to SEQ ID NO: 93409
  misc_feature: GYAE6OF02HNBB1.29.85.H08.1.454.CMB.1.raw
  modified_base (150)..(151): a, c, t, g, unknown or other
  misc_feature (150)..(151): n is a, c, g, or t

SEQ ID NO: 94064 - DNA, 250 bp, Homo sapiens
  misc_feature: GYAE6OF02HBYSI.29.85.H08.1.454.CMB.1.raw
  modified_base (250)..(250): a, c, t, g, unknown or other
  misc_feature (250)..(250): n is a, c, g, or t
tcagatagagtactcacgaccggtgctcgatttagtatcactcagtcgcgggtgcctccctgaccatctctgggctccaggctgacgatgacggtgattattactgctgctcatttgcaggcacccgcactgtgatcttcggcggagggaccaagctgaccgtcctaggtcagctcaaggctgccccctcggtcactctgttcccgccctcctcagtactctatctgagcgggctggcaaggcgcatagn

SEQ ID NO: 94065 - DNA, 172 bp, Homo sapiens
  misc_feature: GYAE6OF02I1W8O.29.85.H08.1.454.CMB.1.raw
  modified_base (152)..(172): a, c, t, g, unknown or other
  misc_feature (152)..(172): n is a, c, g, or t
tcagatagagtactcacgaccggtgctcgatttagtatcactcagtcggcgggacacgactggagattaaacgaactgtggctgcaccatctgtcttcatcttcccgccatctgaatagcgtactctgagcgggctggcaaggtcgcatagnnnnnnnnnnnnnnnnnnnnn

SEQ ID NO: 94066 - DNA, 150 bp, Homo sapiens; identical to SEQ ID NO: 93401
  misc_feature: GYAE6OF02GI79L.29.85.H08.1.454.CMB.1.raw
  modified_base (150)..(150): a, c, t, g, unknown or other
  misc_feature (150)..(150): n is a, c, g, or t

SEQ ID NO: 94067 - DNA, 462 bp, Homo sapiens
  misc_feature: GYAE6OF02HW9JU.29.85.H08.1.454.CMB.1.raw
  modified_base (333)..(333): a, c, t, g, unknown or other
  misc_feature (333)..(333): n is a, c, g, or t
  modified_base (448)..(448): a, c, t, g, unknown or other
  misc_feature (448)..(448): n is a, c, g, or t
  modified_base (453)..(462): a, c, t, g, unknown or other
  misc_feature (453)..(462): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcacccgnactgtgatcgttcggcggaggaccagctcgaccgtctaggtcagctcagctcgcccctcggtcacttctcgttcccgcctcctcagtactctatcgtgagcggtctggcaaggcncatgnnnnnnnnnn

SEQ ID NO: 94068 - DNA, 151 bp, Homo sapiens
  misc_feature: GYAE6OF02FHORK.29.85.H08.1.454.CMB.1.raw
  modified_base (151)..(151): a, c, t, g, unknown or other
  misc_feature (151)..(151): n is a, c, g, or t
tcagatagagtactcacgaccggtgctcgatttagtatcactcagtcgcgggacgacgactggagattaaacgaactgtggctgcaccatctgtcttcatcttcccgccatctgaatagcgtactctgagcgggctggcaaggcgcatagn

SEQ ID NO: 94069 - DNA, 151 bp, Homo sapiens; identical to SEQ ID NO: 93409
  misc_feature: GYAE6OF02HQV7I.29.85.H08.1.454.CMB.1.raw
  modified_base (150)..(151): a, c, t, g, unknown or other
  misc_feature (150)..(151): n is a, c, g, or t

SEQ ID NO: 94070 - DNA, 149 bp, Homo sapiens; identical to SEQ ID NO: 93464
  misc_feature: GYAE6OF02HIGAT.29.85.H08.1.454.CMB.1.raw

SEQ ID NO: 94071 - DNA, 150 bp, Homo sapiens; identical to SEQ ID NO: 93401
  misc_feature: GYAE6OF02IXC8E.29.85.H08.1.454.CMB.1.raw
  modified_base (150)..(150): a, c, t, g, unknown or other
  misc_feature (150)..(150): n is a, c, g, or t

SEQ ID NO: 94072 - DNA, 151 bp, Homo sapiens; identical to SEQ ID NO: 93409
  misc_feature: GYAE6OF02HNTAK.29.85.H08.1.454.CMB.1.raw
  modified_base (150)..(151): a, c, t, g, unknown or other
  misc_feature (150)..(151): n is a, c, g, or t

SEQ ID NO: 94073 - DNA, 422 bp, Homo sapiens
  misc_feature: GYAE6OF02I89Z6.29.85.H08.1.454.CMB.1.raw
  modified_base (407)..(407): a, c, t, g, unknown or other
  misc_feature (407)..(407): n is a, c, g, or t
  modified_base (412)..(422): a, c, t, g, unknown or other
  misc_feature (412)..(422): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggcccccgactcataatttatgatgtcattaagcggccctcaggggtccctgatcgcttctctggctccaagtctggcaacactgcctccctgaccatctctgggctccaggctgacgatgacggtgattattactgctgctcatttgcaggccacccgcacttgtgatcttcggcggagggacccaagctgaccgtctaggtcagctcaaggctgccccctggtcacttctcgttccccacctctcagttactctatctgacgcgggctggcaaggcncatgnnnnnnnnnnn

SEQ ID NO: 94074 - DNA, 149 bp, Homo sapiens; identical to SEQ ID NO: 93464
  misc_feature: GYAE6OF02G6DGA.29.85.H08.1.454.CMB.1.raw

SEQ ID NO: 94075 - DNA, 523 bp, Homo sapiens
  misc_feature: GYAE6OF02JBBS4.29.85.H08.1.454.CMB.1.raw
  modified_base (294)..(294): a, c, t, g, unknown or other
  misc_feature (294)..(294): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttataactttgtctctggtaccaacacaccaggcgagccccccgatcataatttangatgtcattaagcggccctcgaggggtccctgatcgcttctctggctccaagtctgcacactgccctcctgaccatctctgggctccaggctgacgatcggacggtgattattactgctgtcttctatttgactacgggccaccccgtcaccgttgtcgtattccgttacgggcgggacggaaccgaagccgtacgaccgttccgtaaggtcacggtcctcgtaaccgg

SEQ ID NO: 94076 - DNA, 152 bp, Homo sapiens; identical to SEQ ID NO: 93475
  misc_feature: GYAE6OF02GLZ0C.29.85.H08.1.454.CMB.1.raw
  modified_base (150)..(152): a, c, t, g, unknown or other
  misc_feature (150)..(152): n is a, c, g, or t

SEQ ID NO: 94077 - DNA, 566 bp, Homo sapiens
  misc_feature: GYAE6OF02HDVK5.29.85.H08.1.454.CMB.1.raw
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
  modified_base (552)..(552): a, c, t, g, unknown or other
  misc_feature (552)..(552): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (563)..(564): a, c, t, g, unknown or other
  misc_feature (563)..(564): n is a, c, g, or t
tcagatagagtactcacgaccggtgctcgatttagtatcactcagtctgccctgacctcacgcctcgcctcagtgttcccgggtctcctggacagtcagtcaccatctcctgcactggaaccagcaggcgatgtcggtggtttataacttttgtctcctggtaccaacaacacccaggcgaggccccccgactcataatttatgagtgtcagttaacgccgggccctcaggggtccctgactcgcttctctcggcctaccaagtctggccaaaccactgtccctccccttgaccctagtcctctggggcctcccgagggcgtgacgatggacggtgattattactgcttgctcatttgcaggccacccgtnacgtgtnacttcgttcgggcgggacggaccaaggcctcgacccgtcctaggtcagcctcgaacggcctcgcccctcggtccaccttcctcgttccccaccctccctccacgtacctctacgtccgtgacggtccggtcgttacggacgtaacggccgacgacgtacgacgctancgcngcncgcgngntgcnncg

SEQ ID NO: 94078 - DNA, 510 bp, Homo sapiens
  misc_feature: GYAE6OF02HM26W.29.85.H08.1.454.CMB.1.raw
  modified_base (298)..(298): a, c, t, g, unknown or other
  misc_feature (298)..(298): n is a, c, g, or t
  modified_base (451)..(451): a, c, t, g, unknown or other
  misc_feature (451)..(451): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatggtcgtggttataactttgtctctggtaccaacaacacccaggcgacggcccccgatcataatttangtatgtcaattaacgcgcctcgaggggtccctgatcgcttctctggctcaagtctggcaacactcgacctcctcgaccatctcgtcgggctccgaggctgacgatcggacgtgattattactgctgcttcatttgcgaggccaccgcactgtnactcgtcggcggacggacaagcctaggacccgtcgtaacggtcaacgtctacgtaacgg

SEQ ID NO: 94079 - DNA, 507 bp, Homo sapiens
  misc_feature: GYAE6OF02JFX67.29.85.H08.1.454.CMB.1.raw
  modified_base (222)..(222): a, c, t, g, unknown or other
  misc_feature (222)..(222): n is a, c, g, or t
  modified_base (388)..(388): a, c, t, g, unknown or other
  misc_feature (388)..(388): n is a, c, g, or t
  modified_base (395)..(395): a, c, t, g, unknown or other
  misc_feature (395)..(395): n is a, c, g, or t
  modified_base (429)..(429): a, c, t, g, unknown or other
  misc_feature (429)..(429): n is a, c, g, or t
tcagatagagtactcacgaccggtgctcgatttagtatcactcagtcgcggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataacttgtctcctggtaccaacaacacccaggcacggcccccgactcactaatttatgatgtcattaagcgcctcaggggtccctgatcgcttctctcgctcaagtctgcaacactgcctcctgaccatctctggctcaggctgacgntgacgtnattacttactgctgctcatttgcgagccaaccgnaccgtgtagtactcgttcgggcgggaaggtacccaagtcctaggtacccggtcctaggtccacgtcctacgaaccggg

SEQ ID NO: 94080 - DNA, 212 bp, Homo sapiens
  misc_feature: GYAE6OF02FZGQ2.29.85.H08.1.454.CMB.1.raw
  modified_base (163)..(212): a, c, t, g, unknown or other
  misc_feature (163)..(212): n is a, c, g, or t
tcagatagagtactcacgaccggtgctcgatttagtatcactcagtcgcgggtacacgacgtggaagattaaacgaactgtggcctgcaccatctgtccttcactcttcccgcctatctgaatagcgtactctgagtccgggctggccaaaggcgactatagnnnnnnnnnnnnnnnnnnnnnnnnnnnnnnnnnnnnnnnnnnnnnnnnnn

SEQ ID NO: 94081 - DNA, 507 bp, Homo sapiens
  misc_feature: GYAE6OF02I990W.29.85.H08.1.454.CMB.1.raw
  modified_base (295)..(295): a, c, t, g, unknown or other
  misc_feature (295)..(295): n is a, c, g, or t
  modified_base (326)..(326): a, c, t, g, unknown or other
  misc_feature (326)..(326): n is a, c, g, or t
  modified_base (354)..(354): a, c, t, g, unknown or other
  misc_feature (354)..(354): n is a, c, g, or t
  modified_base (405)..(405): a, c, t, g, unknown or other
  misc_feature (405)..(405): n is a, c, g, or t
  modified_base (443)..(443): a, c, t, g, unknown or other
  misc_feature (443)..(443): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctctgtaccaacaacacccaggcgagcccccgatcataatttangatgtcattaagcggccctgacggggtcccngatcgcttctctggctcagtctgcaacnctgccctcctgacctatctcgtcggctccgaggctggacgtatggacggtntatttacttactgctgctctagtttgcaggccacccgnactgtgacttcgttcgggcggacggaccaagcgtacgtaccgtccgtaggtccagctcgaacgg

SEQ ID NO: 94082 - DNA, 148 bp, Homo sapiens
  misc_feature: GYAE6OF02IIAH5.29.85.H08.1.454.CMB.1.raw
tcagatagagtactcacgaccggtgctcgatttagtatcactcagtcgcgggacacgactggagattaaacgaactgtggctgcaccatctgtcttcatcttcccgccatctgaatagcgtactctgagcggctggcaaggcgcatag

SEQ ID NO: 94083 - DNA, 469 bp, Homo sapiens
  misc_feature: GYAE6OF02FLWVE.29.85.H08.1.454.CMB.1.raw
  modified_base (290)..(290): a, c, t, g, unknown or other
  misc_feature (290)..(290): n is a, c, g, or t
  modified_base (452)..(452): a, c, t, g, unknown or other
  misc_feature (452)..(452): n is a, c, g, or t
  modified_base (455)..(455): a, c, t, g, unknown or other
  misc_feature (455)..(455): n is a, c, g, or t
  modified_base (458)..(469): a, c, t, g, unknown or other
  misc_feature (458)..(469): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggttcngacgatgacggtgatttattactgctgctcatttgcaggcacccgcactgtgatcttcgggcggagggaccaagctgaccgtctaggtcagctcaaggctcgcccctcggtcactctcgttcccgccctcctcagtactctatctgacgcggctggcaggcncanagnnnnnnnnnnnn

SEQ ID NO: 94084 - DNA, 660 bp, Homo sapiens
  misc_feature: GYAE6OF02JJDJI.29.85.H08.1.454.CMB.1.raw
  modified_base (223)..(223): a, c, t, g, unknown or other
  misc_feature (223)..(223): n is a, c, g, or t
  modified_base (540)..(540): a, c, t, g, unknown or other
  misc_feature (540)..(540): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcatgtcgtgtatacttgtctcctgtaccaacaacacccaggccgacggcccccgactcattaactttatcgatgtacattaacgccggtccctcgacggggttccctaggactcggtcttcctcgtcggctcccgaagttcctggacctaaaccacgtcgccccttccctacggaccctattcctcgtccggggtccttaccgacgggtcctacggaaccgagttacgggtaccgggttagtaactttactttaaccgtcgtaccgttggtacctttctacgttttcgaccgtaacgggtccctaacccggtntaaccgttgggtacgttacgttccgggtttaccggggaccggggtaacgggaacccttaggaccgttaccggtaccccggtttacggttacggacccgtaacgtccgttaccgaaccggg

SEQ ID NO: 94085 - DNA, 535 bp, Homo sapiens
  misc_feature: GYAE6OF02I2VZX.29.85.H08.1.454.CMB.1.raw
  modified_base (401)..(401): a, c, t, g, unknown or other
  misc_feature (401)..(401): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcgtgttatacttgtctctgtaccaacaacaccagcgacggcccccgatcataattatgatgtcattaagcgcctcgaggggtccctgactcgcttctctcggctccaagtctgcaacactgcctcctgaccatctcgtcgggctccgaggctgacgtagtgtacggtntattatactgctgctctatttcgctacggccacccgcacgttgtacgtacgttcgttcgggacggtacgggaacctaacggtccgtacggtacccggttaccgtacgggttaccacggtccgtacgtaaccggg

SEQ ID NO: 94086 - DNA, 511 bp, Homo sapiens
  misc_feature: GYAE6OF02HE23K.29.85.H08.1.454.CMB.1.raw
  modified_base (222)..(222): a, c, t, g, unknown or other
  misc_feature (222)..(222): n is a, c, g, or t
  modified_base (297)..(297): a, c, t, g, unknown or other
  misc_feature (297)..(297): n is a, c, g, or t
  modified_base (461)..(461): a, c, t, g, unknown or other
  misc_feature (461)..(461): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctctgcactggaaccngcagcgatgtcggtggttataactttgtctctggtaccaacaacacccaggcgacggcccccgatcataacttangatgtcattaagcggccctcgacggggtccctgactcgtcttctcgtcggctaccaagtcctggacaacactgccctccctgaccactctcgtcgggcctccgaggctgaacgatgacggtgattattactgctgctcgtatttcgctagccaccgcactgtgnttcgtcggcggaggacaagctcgaccgtcctaggtcagtccgtagaccgg

SEQ ID NO: 94087 - DNA, 472 bp, Homo sapiens
  misc_feature: GYAE6OF02F9SO5.29.85.H08.1.454.CMB.1.raw
  modified_base (333)..(333): a, c, t, g, unknown or other
  misc_feature (333)..(333): n is a, c, g, or t
  modified_base (453)..(453): a, c, t, g, unknown or other
  misc_feature (453)..(453): n is a, c, g, or t
  modified_base (459)..(472): a, c, t, g, unknown or other
  misc_feature (459)..(472): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcacccgnactgtgatcttcggcggagggacccaagctgaccgtcctaggtcagctcaaggctcgccccctcggtcacttctcgttcccaccctcctcagtactctatctgagcgggctggcaaggcncatagnnnnnnnnnnnnnn

SEQ ID NO: 94088 - DNA, 524 bp, Homo sapiens
  misc_feature: GYAE6OF02GNELU.29.85.H08.1.454.CMB.1.raw
  modified_base (444)..(444): a, c, t, g, unknown or other
  misc_feature (444)..(444): n is a, c, g, or t
  modified_base (489)..(489): a, c, t, g, unknown or other
  misc_feature (489)..(489): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagcctggggggtccctgagactctcctgtgcagcctctggattcaagtttaatgatttttccatacactgggtccgtcaagctccggggaaggtctggagtgggtctctcttattaatcgagacggtgctactacattctatgcagactctgtgaagggccgattcaccatctccagagacaacaacaagtactccctgtactctgacaaatgaacngtctgaagaagtgacgacaggcgcttctattattgtgacaaaagngaaggcaggatacgtaaggtgggtcgtgtttacgg

SEQ ID NO: 94089 - DNA, 503 bp, Homo sapiens
  misc_feature: GYAE6OF02FX1N1.29.85.H08.1.454.CMB.1.raw
  modified_base (411)..(411): a, c, t, g, unknown or other
  misc_feature (411)..(411): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
tcagatagagtactcacgaccggtgctcgatttagtatcactcagtcgcggggggttctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgtataacttgtctctgtaccaacacacccaggcgacgcccccgatcataatttatgatgtcaattaacgcggccctcgacggggtccctgactcgtcttctctggctccaagtctggcaacactgccctccctgacccatctctgggcctccgaggcctgacgatcggacggtntattatactgctgctctatttgcaggccacccnactgtnatcgtcgggcgaggacccagcctacgaccgtccgtaggtcacgtctagaacgg

SEQ ID NO: 94090 - DNA, 521 bp, Homo sapiens
  misc_feature: GYAE6OF02FF54C.29.85.H08.1.454.CMB.1.raw
  modified_base (487)..(487): a, c, t, g, unknown or other
  misc_feature (487)..(487): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagcctggggggtccctgagactctcctgtgcagcctctggattcaagttttaatgatttttccatacactgggtcctcaagctccggggaaggtctggagtgggtctctcttattaatcgagacggtgctactacattcatgcagactctgtgaagggccgattcacatctcagagacaacaacaagtactccctagtactctgacaaatgaaacagtctagagaagtgaacgacagcgcttctattatgtgacaaaagngaagcaggatacgtaaggtcgggtacgtgttacg

SEQ ID NO: 94091 - DNA, 159 bp, Homo sapiens; identical to SEQ ID NO: 93448
  misc_feature: GYAE6OF02JHC2K.29.85.H08.1.454.CMB.1.raw
  modified_base (150)..(159): a, c, t, g, unknown or other
  misc_feature (150)..(159): n is a, c, g, or t

SEQ ID NO: 94092 - DNA, 469 bp, Homo sapiens
  misc_feature: GYAE6OF02IF1XS.29.85.H08.1.454.CMB.1.raw
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (331)..(331): a, c, t, g, unknown or other
  misc_feature (331)..(331): n is a, c, g, or t
  modified_base (417)..(417): a, c, t, g, unknown or other
  misc_feature (417)..(417): n is a, c, g, or t
  modified_base (428)..(428): a, c, t, g, unknown or other
  misc_feature (428)..(428): n is a, c, g, or t
  modified_base (454)..(455): a, c, t, g, unknown or other
  misc_feature (454)..(455): n is a, c, g, or t
  modified_base (458)..(469): a, c, t, g, unknown or other
  misc_feature (458)..(469): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggccctnagggtccctgatcgcttcnctggctccaagtctggcaacactgcctccctgaccatctctgggctccaggctgacgatgacggtgattattactgctgctcatttgcaggcacccgnactgtgatcttcggcgagggaccaagctgaccgtctaggcagctcaaggcctgccccctggtccacttctcgtcccaccctctccngtactctatcngacgcggctggcaaggcgcacgtagnngcnnnnnnnnnnnn

SEQ ID NO: 94093 - DNA, 528 bp, Homo sapiens
  misc_feature: GYAE6OF02H5105.29.85.H08.1.454.CMB.1.raw
  modified_base (398)..(398): a, c, t, g, unknown or other
  misc_feature (398)..(398): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcggcctcgctcagtgtccgggtctcctggacagtcagtcaccatctcctgcactggaaccagcagcgatgtcggtggttataactttgtctcctggtaccaacaacacccaggcaggccccccgatcaataatttatgatgtcattaagcgccctgagggtccctgactcgcttctctggctccaagtctggaccaacactcgccctcctgaccatctctggctccaggctgacgntgacgtgtattattactgctgctctatttcgctaggccaccgcacgtgttgacttcgttccgggacggacgggaacccaaggccttacggacccgttccgagggtccacggtcgttaccgaaggtccccg

SEQ ID NO: 94094 - DNA, 512 bp, Homo sapiens
  misc_feature: GYAE6OF02I85GK.29.85.H08.1.454.CMB.1.raw
  modified_base (360)..(360): a, c, t, g, unknown or other
  misc_feature (360)..(360): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (444)..(444): a, c, t, g, unknown or other
  misc_feature (444)..(444): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggcgacggcccccgactcataatttatgatgtcattaagcgccctcgaggggtccctgatcgcttctctggctccaatctggcaacnctgcctccctgaccatctctgggctccgaggctgacgntgacggtnattatactgctgcttcatttgcagccaccggcactgtnacttcgttcgggcggtacggaccaagccgtagacccgttccgtaggttccaacggtctacgtaaccgg

SEQ ID NO: 94095 - DNA, 535 bp, Homo sapiens
  misc_feature: GYAE6OF02ILEWE.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagcctggggggtccctgagactctcctgtgcagcctctggattcaagtttaatgtatttttccatacactgggtccgtcaagcgtccggggaaggtctggagtgggtctctcttattaatcgagacggtgctactacattctatgcagactctgtgaagggccattcaccatctccagagacaacaacaagtacctaccctgtaactcgtagaccaaatcgaaactagtctagagaagtgacgacagcggtcttctattattgtagacaaaagagaaggcaggatcctaaggtggtcgtagtttacgg

SEQ ID NO: 94096 - DNA, 567 bp, Homo sapiens
  misc_feature: GYAE6OF02HT7KY.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctatttaaaaggtgtccagtgtgaagtgcagctggtggagtctgggggagtcgtggtacagcctggggggtccctgagactctcctgtgcagcctctggattcaagtttaatgtatttttccatacactgggtcctcaaggccgtccgggggaagggtctgggagtgggtctctcttattaatcgagacggtgctactacattctatgcagtactctggtgaagggccgtattcacctatcctccagacgaacaaacaacaagtacctccctagtactctagacaaatgaaactagtactagaagaagtgaacgacagcggtcttctattattaggtcgaacaaaaggtaggaaaggcgaagggtactacgttaaagggtcggggtaccgtggtttacgg

SEQ ID NO: 94097 - DNA, 472 bp, Homo sapiens
  misc_feature: GYAE6OF02FXOGM.29.85.H08.1.454.CMB.1.raw
  modified_base (457)..(457): a, c, t, g, unknown or other
  misc_feature (457)..(457): n is a, c, g, or t
  modified_base (459)..(472): a, c, t, g, unknown or other
  misc_feature (459)..(472): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataacttttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattatactgctgctcatttgcaggcacccgcactgtgatcttcggcggaggaccaagctgaccgtctaggtcagctcgaaggctcgcccctcggtccactctcgttcccaccctcctcacgtctctatcgtgagcgggctggcaaggcgcatagngnnnnnnnnnnnnnn

SEQ ID NO: 94098 - DNA, 528 bp, Homo sapiens
  misc_feature: GYAE6OF02HKGOX.29.85.H08.1.454.CMB.1.raw
  modified_base (490)..(490): a, c, t, g, unknown or other
  misc_feature (490)..(490): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggtttccttgttgctatttaaaaggtgtccagtgtgaagtgcagctggtggagtctgggggagtcgtggtacagcctggggggtccctgagactctcctgtgcagcctctggattcaagtttaatgtatttttccatacactgggtccgtcaagctccggggaaggtctggagtgggtctctcttattaatcgagacggtgctactacattctatgcagactctgtgaagggccgattcaccatctccagagacaaacaacaagtacctccctagtatctgacaaatgaacagtctgagaagtgacgacagcgcttctatttattgtgacaaaaggngaaaggcagggatacgtaaggtgggtcgtcgtttacgg

SEQ ID NO: 94099 - DNA, 542 bp, Homo sapiens
  misc_feature: GYAE6OF02GYRGM.29.85.H08.1.454.CMB.1.raw
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttataactttgtctctggtaccaacaacacccaggcgacggccccccgactcaataatttatgatgtcattaagcggccctcgacggggtccctgactcgcttctctgctccaagtctggcaacactcgcctccctgaccatcctctgggcctccgaggtctgacgatggacggtgtattattactgctgctctatttcgcacggccaacccgctaacgttgtcgtacgttccgttacgggccgggtaacgggacccgaagtccgtacggacccgttccgtaggtccaggtcctacgaaccggg

SEQ ID NO: 94100 - DNA, 510 bp, Homo sapiens
  misc_feature: GYAE6OF02IR8BV.29.85.H08.1.454.CMB.1.raw
  modified_base (297)..(297): a, c, t, g, unknown or other
  misc_feature (297)..(297): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccagcgaggcccccgatcataatttangatgtcattaagcggcctcaggggtccctgatcgcttctctggctccaagtctggcaacactgccctcctcgaccactcctctgggctccaggctgacgatggacggtgattattactgctgcttcatttgctaggccacccgcacgtgtgatcgttcgggcggtaacgggacccaaggcctggacccgttccgtaggcacggcctcgaacgg

SEQ ID NO: 94101 - DNA, 516 bp, Homo sapiens
  misc_feature: GYAE6OF02F2957.29.85.H08.1.454.CMB.1.raw
  modified_base (410)..(410): a, c, t, g, unknown or other
  misc_feature (410)..(410): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccagcgagcccccgactcataatttatgatgtcattaagcggccctcaggggtccctgatcgcttctctggctcaagtctggcaacactgccctccctgacccatcctcgtcgggctccaggctggaccgatgacggtntattacttactgcttgctctatttgcaggccacccgcactgtcgtatccgttcgggcggtaggaccgaagctcgacccgtcgtacggtcgacgtcctacgtaacgg

SEQ ID NO: 94102 - DNA, 416 bp, Homo sapiens
  misc_feature: GYAE6OF02IL7G1.29.85.H08.1.454.CMB.1.raw
  modified_base (404)..(416): a, c, t, g, unknown or other
  misc_feature (404)..(416): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcacccgcactgtgatcttcggcggagggaccaagctgaccgtctaggtcagctcaaggctgcccctggcactctgtccccacctcctcagtactctatctgagcggctggcaaggcgcatagnnnnnnnnnnnnn

SEQ ID NO: 94103 - DNA, 527 bp, Homo sapiens
  misc_feature: GYAE6OF02HNL3Q.29.85.H08.1.454.CMB.1.raw
  modified_base (410)..(410): a, c, t, g, unknown or other
  misc_feature (410)..(410): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggcgacggcccccgatcataatttatgatgtcattaagcggcctcgaggggtccctgatcgcttctctggctcagtctggcaacactcgcctccctgaccatcctcgtgggcctccgaggctgacgtatcgacggtnatttatactgctgactctatttgcgtacgcacccgcacgtgtgacttcgttccgggcgggtaaggaccaaggccgtacggacccggttccgtaaggtccaggcccttacgaaccggg

SEQ ID NO: 94104 - DNA, 525 bp, Homo sapiens
  misc_feature: GYAE6OF02HMMWW.29.85.H08.1.454.CMB.1.raw
  modified_base (404)..(404): a, c, t, g, unknown or other
  misc_feature (404)..(404): n is a, c, g, or t
  modified_base (421)..(421): a, c, t, g, unknown or other
  misc_feature (421)..(421): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataacttgtctctgtaccaacaacaccaggcgacggcccccgactcataatttatgatgtcattaagcggcctcgacggggtcctgatcgcttctctgctcaagtctgcaacactgcctcctgaccatcctcgtgggcctccgaggctggacgatcgacggtnattatactgactgcctntatttcgacacggccacccggcacgttgtcgtattccggttcgggcgggtaacgggaccaaggtccgtaggacccgttcgtaggtaccacggtcctacgaacgg

SEQ ID NO: 94105 - DNA, 184 bp, Homo sapiens
  misc_feature: GYAE6OF02HROXP.29.85.H08.1.454.CMB.1.raw
  modified_base (156)..(184): a, c, t, g, unknown or other
  misc_feature (156)..(184): n is a, c, g, or t
tcagatagagtactcacgaccggtgctcgatttagtatcactcagtcggcgggacacggactggagattaaacgaactgtggctggcaccatctgtcttcatccttcccgccatcctcgaatagcgtactctgagcgggctggcaaggcgcatagnnnnnnnnnnnnnnnnnnnnnnnnnnnnn

SEQ ID NO: 94106 - DNA, 530 bp, Homo sapiens
  misc_feature: GYAE6OF02GRLNE.29.85.H08.1.454.CMB.1.raw
  modified_base (418)..(418): a, c, t, g, unknown or other
  misc_feature (418)..(418): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcctccgtgtccgggtctcctggacagtcagtcaccgtctcctgcagtggaaccagcagtgacgttggtgcttataaccgtgtctcctggtaccagcacgcccccaggcacacgcccccaaactcatgtatttttgacgtcagtaatcggccctcaggggtccctgatcgcttctctggtccaagtctggcagcacggcctcctgattactctctggctccagactgagacgagctagaatattattgcanctcatatacaagggacaactacttatgttcgttacgtaacgtgggacctaagtccgtaccgtacctaggtacgacgacccaacggacccaaccccacgtacgtacactaccg

SEQ ID NO: 94107 - DNA, 153 bp, Homo sapiens; identical to SEQ ID NO: 93437
  misc_feature: GYAE6OF02G55ZS.29.85.H08.1.454.CMB.1.raw
  modified_base (150)..(153): a, c, t, g, unknown or other
  misc_feature (150)..(153): n is a, c, g, or t

SEQ ID NO: 94108 - DNA, 163 bp, Homo sapiens
  misc_feature: GYAE6OF02HPQ44.29.85.H08.1.454.CMB.1.raw
  modified_base (149)..(163): a, c, t, g, unknown or other
  misc_feature (149)..(163): n is a, c, g, or t
tcagatagagtactcacgaccggtgctcgatttagtatcactcagtcgcgggacacgactggagattaaacgaactgtggctgcaccatctgtcttcatcttcccgcatctgaatagcgtactctgagcgggctggcaaggcgcatagnnnnnnnnnnnnnnn

SEQ ID NO: 94109 - DNA, 532 bp, Homo sapiens
  misc_feature: GYAE6OF02HK9GD.29.85.H08.1.454.CMB.1.raw
  modified_base (297)..(297): a, c, t, g, unknown or other
  misc_feature (297)..(297): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcgtgttataactttgtctctgtaccaacaacacccaggcgacggcccccgatcaataatttangatgtcattaagccgccctcgacggggtccctgactcgtcttctctggctccaagtctggacaacactcgccctccctgaccactctcgtcgggctccgagctgacgatgacggtgtatttatactgtctcgctctatttgcacggccacccgactacgtgtacgtacgttcgttcgggacggacgggacctaacggccgtacggacccgtccgtaggtcacgtcctcgaaccgg

SEQ ID NO: 94110 - DNA, 525 bp, Homo sapiens
  misc_feature: GYAE6OF02HLSJ3.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagcctggggggtccctgagactctcctgtgcagcctctggattcaagtttaatgatttttccatacactgggtccgtcaagctccggggaaggtctggagtgggtctctcttattaatcgagacggtgctactacattctatgcagactctgtgaagggccgattcaccatctcagagacaacaacaagtactccctgtactctgacaaatgaacagtctagagaagtgacgacagcggcttctattattgtgacaaaaggagaaggcaggatacgtaaggtgggtcgtggtttacgg

SEQ ID NO: 94111 - DNA, 470 bp, Homo sapiens
  misc_feature: GYAE6OF02G3CC8.29.85.H08.1.454.CMB.1.raw
  modified_base (216)..(216): a, c, t, g, unknown or other
  misc_feature (216)..(216): n is a, c, g, or t
  modified_base (301)..(301): a, c, t, g, unknown or other
  misc_feature (301)..(301): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
  modified_base (413)..(413): a, c, t, g, unknown or other
  misc_feature (413)..(413): n is a, c, g, or t
  modified_base (450)..(450): a, c, t, g, unknown or other
  misc_feature (450)..(450): n is a, c, g, or t
  modified_base (456)..(470): a, c, t, g, unknown or other
  misc_feature (456)..(470): n is a, c, g, or t
tcagatagagtactcacgaccggtgctcgatttagtatcactcagtctgccctgactcagcctcgctcagtgtccgggtctcctggacagtcagtcgaccatctcctgcactggaaccagcagcgatgtcggtggttataactttgtctcctggtaccaacaacacccaggcgaggcccccccgatcataatttatgatgtcattaagcggccctnaggggtccctgatcgcttctctggctccaagtctggcaacactgcctcctgaccatctctgggctccaggctgacgatgacggtnattatactgctgctcatttgcaggccacccgnactgtnatcgtcgggcgagggaccaagctgaccgtcgtaggtcagctacgaggctcgccccgtcgtcactctcgttcccnccttctctagtctctatcgtgagcggtctggcgagcncatagnnnnnnnnnnnnnnn

SEQ ID NO: 94112 - DNA, 554 bp, Homo sapiens
  misc_feature: GYAE6OF02HDS71.29.85.H08.1.454.CMB.1.raw
  modified_base (235)..(235): a, c, t, g, unknown or other
  misc_feature (235)..(235): n is a, c, g, or t
  modified_base (540)..(541): a, c, t, g, unknown or other
  misc_feature (540)..(541): n is a, c, g, or t
  modified_base (543)..(554): a, c, t, g, unknown or other
  misc_feature (543)..(554): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttcnctggctccaagtctggcaacactgccctccctgaccatctctgggctccaggctgacgatggacggtgattattactgctgctctatttcgctacgggcccacccggcaccttggtacgtacttccgttcggggaccgggaacggggaacccaaaggcctttacgggaccccgttacccgttaacgggtaccaacggtcctaccgaaacgggcctccggcccccgttcggtccaccttccgtcgttccccgccctcctcaccgttctcttactcgtgacggcgggcgtggacaacggcgcagtgnncnnnnnnnnnnnn

SEQ ID NO: 94113 - DNA, 576 bp, Homo sapiens
  misc_feature: GYAE6OF02HO61P.29.85.H08.1.454.CMB.1.raw
  modified_base (303)..(303): a, c, t, g, unknown or other
  misc_feature (303)..(303): n is a, c, g, or t
  modified_base (434)..(434): a, c, t, g, unknown or other
  misc_feature (434)..(434): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatcctcctgcactggaaccagcagcatggtcggtgttataactttgtctcctggtaccaacaacacccaggcgacggccccccgatcattaattangatgtcattaacgcggccctcgacggggtccctgactccgcttctctggcctaccgaagtctggacaacactcgccctccctagaccctactcctcgtcgggcctccgaggtcctcgacgatcggacggtnaatttattactgctgcttactatttcgacgtacggccacccgcacgttgtcgtacgttcgttaccgggcgggaacgggaccaacggtccgtaccggtacccggttaccgtaacgggtccgaacggtccgtacggtaaccggg

SEQ ID NO: 94114 - DNA, 532 bp, Homo sapiens
  misc_feature: GYAE6OF02F3WMX.29.85.H08.1.454.CMB.1.raw
  modified_base (464)..(464): a, c, t, g, unknown or other
  misc_feature (464)..(464): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagcctggggggtccctgagactctcctgtgcagcctctggattcaagtttaatgtatttttccatacactgggtccgtcaagctccggggaaggtctgggagtgggtctctcttattaatcgagacggtgctactacattctatgcagctctgtgaagggccattcacatctccagagacaacaacaagtacctccctagtactctgacaaatcgaactgtctagagaagtgacganagcggtcttctattagttgtgactaaaaggagaaggcaaggtatcgtaaaggtgggtcgtcgtttacg

SEQ ID NO: 94115 - DNA, 538 bp, Homo sapiens
  misc_feature: GYAE6OF02GM4DF.29.85.H08.1.454.CMB.1.raw
  modified_base (223)..(223): a, c, t, g, unknown or other
  misc_feature (223)..(223): n is a, c, g, or t
  modified_base (349)..(349): a, c, t, g, unknown or other
  misc_feature (349)..(349): n is a, c, g, or t
  modified_base (401)..(401): a, c, t, g, unknown or other
  misc_feature (401)..(401): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttataactttgtctctggtaccaacaacaccaggcgacgcccccgatcatattatgatgtcattagcgcctcgagggtccctgatcgcttctctgctccagtctggcacnctcgcctccctgaccatctcgtgggcctccgaggctgacgtatcggacggtntattattcgtgcttgcttactagttttcgctacggcccacccgtcacgttgtacgtacttccgttacgggcggaacgggacccaacggtccgtacgtacccggtccgttacgggtaccacggtacctacgtaaccgg

SEQ ID NO: 94116 - DNA, 474 bp, Homo sapiens
  misc_feature: GYAE6OF02HQIW6.29.85.H08.1.454.CMB.1.raw
  modified_base (214)..(214): a, c, t, g, unknown or other
  misc_feature (214)..(214): n is a, c, g, or t
  modified_base (333)..(333): a, c, t, g, unknown or other
  misc_feature (333)..(333): n is a, c, g, or t
  modified_base (460)..(460): a, c, t, g, unknown or other
  misc_feature (460)..(460): n is a, c, g, or t
  modified_base (462)..(474): a, c, t, g, unknown or other
  misc_feature (462)..(474): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggccctnaggggtccctgatcgcttctctggctccaagtctggcaacactgcctccctgaccatctctgggctccaggctgacgatggacggtgattattactgctgctcatttgcaggcacccgnactgtgatcttcggcggaggaccaagctgaccgtctacggtcagctcaagctcgcccctcggtcacttctcgttcccgtccctcctcacgtctctatctgacggcggctcggcaacggcgcagtagngnnnnnnnnnnnnn

SEQ ID NO: 94117 - DNA, 523 bp, Homo sapiens
  misc_feature: GYAE6OF02H8B6K.29.85.H08.1.454.CMB.1.raw
  modified_base (294)..(294): a, c, t, g, unknown or other
  misc_feature (294)..(294): n is a, c, g, or t
  modified_base (379)..(379): a, c, t, g, unknown or other
  misc_feature (379)..(379): n is a, c, g, or t
  modified_base (432)..(432): a, c, t, g, unknown or other
  misc_feature (432)..(432): n is a, c, g, or t
  modified_base (450)..(450): a, c, t, g, unknown or other
  misc_feature (450)..(450): n is a, c, g, or t
tcagatagagtactcacgaccggtgctcgatttagtatcactcagtcgcggggggggtctcaggaggcagcactctcgggacgtctccaccatgcctgggctctgctcctcctcagcctcctcactcagggcacaggatcctgggctcagtctgccctgactcagcctcgctcagtgtccgggtctcctggacagtcagtcaccatctcctgccactggaaccagcagcgatgtcggtgttataactttgtctctgtaccaacaacaccagcgacgccccgactcataatttangatgtcattaacgcggccctcgacggggtccctgtatcgcttctcgtggtctcctaagtctggacaacactcgcctccctgaccntctctcggcctcgagcctgagatcgacggtgtattacttagtgctgtctactnttcgcacggccacccgtnacttgtagtacgtcgttcggcggtaacgggaccaacgctacgaccgttccgaggttccagtccacgtaaccgg

SEQ ID NO: 94118 - DNA, 149 bp, Homo sapiens; identical to SEQ ID NO: 93464
  misc_feature: GYAE6OF02F80LX.29.85.H08.1.454.CMB.1.raw

SEQ ID NO: 94119 - DNA, 524 bp, Homo sapiens
  misc_feature: GYAE6OF02HYUDR.29.85.H08.1.454.CMB.1.raw
  modified_base (296)..(296): a, c, t, g, unknown or other
  misc_feature (296)..(296): n is a, c, g, or t
  modified_base (360)..(360): a, c, t, g, unknown or other
  misc_feature (360)..(360): n is a, c, g, or t
  modified_base (407)..(407): a, c, t, g, unknown or other
  misc_feature (407)..(407): n is a, c, g, or t
  modified_base (422)..(422): a, c, t, g, unknown or other
  misc_feature (422)..(422): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttatactttgtctctggtaccaacaacacccaggcgacggcccccgatcataatttangatgtcattaagcgcctcgaggggtccctagactccgtcttctctggctccaagtctggcaacnctcgcctccctgaccatctcgtggcctcgaggctgacgatcgacgtnattattatgctgctntatttgctacggcacccgtcacgtgtcgcttacgttcgggacggtacggacccaagtccgtcggtacccgtcgtacggttaccaggtaccgtacgtaacggg

SEQ ID NO: 94120 - DNA, 180 bp, Homo sapiens
  misc_feature: GYAE6OF02H58IB.29.85.H08.1.454.CMB.1.raw
  modified_base (154)..(180): a, c, t, g, unknown or other
  misc_feature (154)..(180): n is a, c, g, or t
tcagatagagtactcacgaccggtgctcgatttagtatcactcagtcggcggaacacgacctggagattaaacgaacctgtggctgcaccatctgtcttcatcttcccgcatctgaattagcgtactctgagcgggctgggcaaggcgcatagnnnnnnnnnnnnnnnnnnnnnnnnnnn

SEQ ID NO: 94121 - DNA, 473 bp, Homo sapiens
  misc_feature: GYAE6OF02GI6YR.29.85.H08.1.454.CMB.1.raw
  modified_base (331)..(331): a, c, t, g, unknown or other
  misc_feature (331)..(331): n is a, c, g, or t
  modified_base (459)..(473): a, c, t, g, unknown or other
  misc_feature (459)..(473): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctcctgaccatctctgggctccaggctgacgatgacggtgattatactgctgctcatttgcaggcacccgnactgtgatcgttcggcggagggaccaaggctggaccgtcctaggtcagctcaaggctcgcccctcgtcacttctcgttcccaccctcctcacgtactctactctgacgcggctggccaaggcgcatgnnnnnnnnnnnnnnn

SEQ ID NO: 94122 - DNA, 566 bp, Homo sapiens
  misc_feature: GYAE6OF02GJH5L.29.85.H08.1.454.CMB.1.raw
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
  modified_base (413)..(413): a, c, t, g, unknown or other
  misc_feature (413)..(413): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatggtcggtggttataactttgtctcctggtaccaacaacacccaggcgacggcccccgatcataatttangatgtcattaagcggcctcgacggggtcccngatcgcttctctggctcaagtctggcaacactgccctcctgaccatctctcgggcctccgagctgaccgagtcggacggtntaatttattacgtgcttgcttatactttcgactacgggcccacccgctacgttgtacgtacgttacggttcggggaacgggtaacggggaaccctaacggtccgttacggacccggttccgtaacgggtccacggtaccgtacggtaaccggg

SEQ ID NO: 94123 - DNA, 516 bp, Homo sapiens
  misc_feature: GYAE6OF02FO54L.29.85.H08.1.454.CMB.1.raw
  modified_base (457)..(457): a, c, t, g, unknown or other
  misc_feature (457)..(457): n is a, c, g, or t
  modified_base (474)..(474): a, c, t, g, unknown or other
  misc_feature (474)..(474): n is a, c, g, or t
  modified_base (484)..(484): a, c, t, g, unknown or other
  misc_feature (484)..(484): n is a, c, g, or t
  modified_base (509)..(509): a, c, t, g, unknown or other
  misc_feature (509)..(509): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagcctggggggtccctgagactctcctgtgcagcctctggattcaagtttaatgatttttccatacactgggtccgtcaagctccggggaaggtctggagtgggtctctcttattaatcgagacggtgctactacattctatgcagactctgtgaagggccattcaccatctcagagacaacaacaagtactccctgtatctgcaaatgaacagtctagagagtgacganagcgcttctattatgtnaccaaaaggngaaggcaggatcgtaagtgggtcgngtttacg

SEQ ID NO: 94124 - DNA, 526 bp, Homo sapiens
  misc_feature: GYAE6OF02GKH4Q.29.85.H08.1.454.CMB.1.raw
  modified_base (401)..(401): a, c, t, g, unknown or other
  misc_feature (401)..(401): n is a, c, g, or t
  modified_base (449)..(449): a, c, t, g, unknown or other
  misc_feature (449)..(449): n is a, c, g, or t
  modified_base (518)..(518): a, c, t, g, unknown or other
  misc_feature (518)..(518): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagcctgggggtccctgagactctcctgtgcaggcctctggattcaagttttaatgtatttttccatacactgggtcctcaagctccggggaaggtctggagtgggtctctcttattaatcgagacggtgctactacattctatgcagactctgtgaagggccagttcacatccnccagacgacaacaacaagtacctcccttagtactctagcaaatgaacngtctgagaagtcgacgacagcgctttctattattgtgacaaagagaggacaggatcgtaagtgggtcgngtttacgg

SEQ ID NO: 94125 - DNA, 550 bp, Homo sapiens
  misc_feature: GYAE6OF02GE6LL.29.85.H08.1.454.CMB.1.raw
  modified_base (222)..(222): a, c, t, g, unknown or other
  misc_feature (222)..(222): n is a, c, g, or t
  modified_base (293)..(293): a, c, t, g, unknown or other
  misc_feature (293)..(293): n is a, c, g, or t
  modified_base (360)..(360): a, c, t, g, unknown or other
  misc_feature (360)..(360): n is a, c, g, or t
  modified_base (416)..(416): a, c, t, g, unknown or other
  misc_feature (416)..(416): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccngcagcgatgtcggtgttataactttgtctctggtaccaacaacaccaggcgacggcccccatcataattangatgtcattaagccgccctcgacggggtccctgactcgcttctctggcctaccaagtctggccaacnctcgccctcctgaccctatcctcgtcgggcctccgaggctaggacgatggacggtntaatttattactgctgctctatttgctacggcctacccgctaacgttgtacgtactccggttaccggggcggtaacgggaacccaaggtcctacggaccccgttccgtaacggtccacggtacctcgtaaccgg

SEQ ID NO: 94126 - DNA, 147 bp, Homo sapiens
  misc_feature: GYAE6OF02HUGUQ.29.85.H08.1.454.CMB.1.raw
  modified_base (147)..(147): a, c, t, g, unknown or other
  misc_feature (147)..(147): n is a, c, g, or t
tcagatagagtactcacgaccggtgctcgatttagtatcactcagtcgcgggacacgactggagattaaacgaactgtggctgcaccatctgtcttcatcttcccgcatctgaatagcgtactctgagcggctggcaaggcgcatgn

SEQ ID NO: 94127 - DNA, 588 bp, Homo sapiens
  misc_feature: GYAE6OF02HCFH6.29.85.H08.1.454.CMB.1.raw
  modified_base (341)..(341): a, c, t, g, unknown or other
  misc_feature (341)..(341): n is a, c, g, or t
  modified_base (365)..(365): a, c, t, g, unknown or other
  misc_feature (365)..(365): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagccgtggggggtccctgagactctcctgtgcagcctctggattcaagtttaatgtatttttccatacactgggtcccgtcaagcgtccggggaaggtctggagtgggtctctnttataatcgagacggtgctactanattctatgcagtactctgtggaagggcattcaccatctccagagacaaacaacaacgtacctccctagtactcgtgactaaatagaactagtactagaagaagttggaaccgaacgacggacgggtcctttacttagtttatttcggtagtaacgaaaaaggaggaaagggtaccaagggtacttaacggttaagggtcggggttaccgtacgggttttacgg

SEQ ID NO: 94128 - DNA, 619 bp, Homo sapiens
  misc_feature: GYAE6OF02GZDEM.29.85.H08.1.454.CMB.1.raw
  modified_base (223)..(223): a, c, t, g, unknown or other
  misc_feature (223)..(223): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttatacttgctctgtaccaacaacaccaggcgacggcccccgactcaataatttatgatgtacattaagccggccctcgacggggtcctgactcgtcttctctgctcaagtcngcaacnctcgcctccctgaccactctccgtcgggcctaccgaggctaggaccgtagtcggacggtagtaatttaacgttactgtccttcggtccttcttacgttttcgaccgtacggtcccaaccccggtctaaccgttcgttacgtacgtttccggttaccggggtacccggggtaacgggtaacccgtaaacgggtacccgttacgggtaacccccggttccggttaacgggttacccgtaacggtacccgttaccgtaaccgggg

SEQ ID NO: 94129 - DNA, 150 bp, Homo sapiens; identical to SEQ ID NO: 93401
  misc_feature: GYAE6OF02GL0G1.29.85.H08.1.454.CMB.1.raw
  modified_base (150)..(150): a, c, t, g, unknown or other
  misc_feature (150)..(150): n is a, c, g, or t

SEQ ID NO: 94130 - DNA, 492 bp, Homo sapiens
  misc_feature: GYAE6OF02IJM6D.29.85.H08.1.454.CMB.1.raw
  modified_base (318)..(318): a, c, t, g, unknown or other
  misc_feature (318)..(318): n is a, c, g, or t
  modified_base (328)..(328): a, c, t, g, unknown or other
  misc_feature (328)..(328): n is a, c, g, or t
  modified_base (358)..(358): a, c, t, g, unknown or other
  misc_feature (358)..(358): n is a, c, g, or t
  modified_base (410)..(410): a, c, t, g, unknown or other
  misc_feature (410)..(410): n is a, c, g, or t
  modified_base (435)..(435): a, c, t, g, unknown or other
  misc_feature (435)..(435): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataacttgtctctggtaccaacaacacccagcgaacggcccccgatcataatttactgatgtcattaagcgaccctnacggggtccngatcgctctctgctccaagtctggacaacnctgccctctgacctatctctggcctcaggtctgacatgacgtgattactacngcctgctacattgcacgcacccganctgtcactcgttcgggcgtaacggcaacgctcgaccgtcgtagtcgactctgtaacg

SEQ ID NO: 94131 - DNA, 494 bp, Homo sapiens
  misc_feature: GYAE6OF02IGUJY.29.85.H08.1.454.CMB.1.raw
  modified_base (298)..(298): a, c, t, g, unknown or other
  misc_feature (298)..(298): n is a, c, g, or t
  modified_base (432)..(432): a, c, t, g, unknown or other
  misc_feature (432)..(432): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggcacggcccccgatcataatttangatgtcattaagcgcctcaggggtcctgatcgcttctctggctccaagtctggcaacactgcctccctgaccatctctggctcaggctgacgatgacggtgattatactgcttgctctatttgcaggcacccgnactgtgatcttcgggcggtacgggaccaagcgtacgaccgttccgtaggtcagctcaacggg

SEQ ID NO: 94132 - DNA, 434 bp, Homo sapiens
  misc_feature: GYAE6OF02FTACH.29.85.H08.1.454.CMB.1.raw
  modified_base (416)..(416): a, c, t, g, unknown or other
  misc_feature (416)..(416): n is a, c, g, or t
  modified_base (421)..(434): a, c, t, g, unknown or other
  misc_feature (421)..(434): n is a, c, g, or t
tcagatagagtactcacgaccggtgctcgatttagtatcactcagtcagtcaccatctcctgcactggaaccagcagtgatgttgagaattatgactgtctcccttggtaccaacaacacccagacacagtccacaaacacatgatatacaatgtcaatactcggccctcaggggtccctgatcgtttctctggctccaagtctggcaatgcggcctccatgaccatctctggactccaggctgaggacgaggctgattattagtgctgctcatatataagcagtgtcactttaaagggggtgtttcgggcgggagggaccaaggctgaccgtcctgggtcagcccaaggctgccccctggtccactctcgttcccaccctcctcacgtactctatctgagcgggctggcaaggcncatgnnnnnnnnnnnnnn

SEQ ID NO: 94133 - DNA, 610 bp, Homo sapiens
  misc_feature: GYAE6OF02H8TGE.29.85.H08.1.454.CMB.1.raw
  modified_base (345)..(345): a, c, t, g, unknown or other
  misc_feature (345)..(345): n is a, c, g, or t
tcagatagagtactcacgaccggtgctcgatttagtatcactcagtcgcgggggagctctgggagaggagccccagccctgagattcccaggtgtttccattcggtgatcagcactgaacacagagaacgcaccatggagttttggactgagctgggttttccttgttgctattttaaaaggtgtccagtgtgaagtgcagctggtggagtcgtgggggagtcgtggtacaggcctggggggtccctgagactctcctgtgcagcctctggattcaagtttaatgtatttttccatacactggtccgtcaagcgtccggggaaggtctggaggttcgggtctctnttatatcgagtacggtgctactacattctatgcagtactctggtaggacggcgtattaccacctatcctccgaggaacacaaacaacgtaacgtacttaccctagtactctagtacaaaagtacgaactaagtaccgtagaacgtaaggtacgaaccgacgaggccggtactttcgttaatttatttaggtagaacgtaaaaggtaggaaacggtacgaagggtaacttaccggtaaagggttcgggttaccgtcggttttacgg

SEQ ID NO: 94134 - DNA, 548 bp, Homo sapiens
  misc_feature: GYAE6OF02H5CPU.29.85.H08.1.454.CMB.1.raw
  modified_base (267)..(267): a, c, t, g, unknown or other
  misc_feature (267)..(267): n is a, c, g, or t
  modified_base (302)..(302): a, c, t, g, unknown or other
  misc_feature (302)..(302): n is a, c, g, or t
  modified_base (370)..(370): a, c, t, g, unknown or other
  misc_feature (370)..(370): n is a, c, g, or t
  modified_base (436)..(436): a, c, t, g, unknown or other
  misc_feature (436)..(436): n is a, c, g, or t
  modified_base (465)..(465): a, c, t, g, unknown or other
  misc_feature (465)..(465): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgctctggtaccaacaacncccaggcgacggcccccgactccaattaatttacngtatgtcaatttaacgcggccctcgacggggtccctgatccgcttctctggcctcaagtctggcaacncttgacctccctgacctatcctcgtcgggcctcgacggtctcgacgatcgcggttgatttattacngcttgctcatttcgctaacggccacccgnaaccgttgtcgattccgttcgggacggtacggaccaaggtccgtacggcccgttacgtacggtccaagtcccgttagaaccgg

SEQ ID NO: 94135 - DNA, 625 bp, Homo sapiens
  misc_feature: GYAE6OF02J2NFC.29.85.H08.1.454.CMB.1.raw
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccntctcctgcactggaaccngcagcgtatgtcggtgttatacttgtctctcgtaccaacacaccgacgcgaccgccccgactctactaattatgtatgtactaagtacgccgtcctcgtacgggtcctcgtactcgtccttccgtcgtcggtcctaccgtaacgtcgtacggacctaacctaccgtccgtccctcccgtacgaccctactccgttcgtaccggtcctccggacggtacgtacgaccgtagttacggtacggttactaacgtttacttacgtgtcttacgtccttacgtacgtttacgacgtacgtacccgccgtacgtacgttcgtacgtacgttccggtacgggaccgggtaacggaccgtacgtccgtacgtacccggttcgtaccgtcgacggtaccgtaccgtacgg

SEQ ID NO: 94136 - DNA, 472 bp, Homo sapiens
  misc_feature: GYAE6OF02GVJWI.29.85.H08.1.454.CMB.1.raw
  modified_base (317)..(317): a, c, t, g, unknown or other
  misc_feature (317)..(317): n is a, c, g, or t
  modified_base (333)..(333): a, c, t, g, unknown or other
  misc_feature (333)..(333): n is a, c, g, or t
  modified_base (413)..(413): a, c, t, g, unknown or other
  misc_feature (413)..(413): n is a, c, g, or t
  modified_base (458)..(458): a, c, t, g, unknown or other
  misc_feature (458)..(458): n is a, c, g, or t
  modified_base (460)..(472): a, c, t, g, unknown or other
  misc_feature (460)..(472): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacactgcctccctgaccatctctgggctccaggctgacgatggacggtgattattactgctgctnatttgcaggcacccgnactgtgatcgttcgggcgagggaccaagctgaccgtcgtaggtcagctcgaaggctcgcccctcggcactctcgttcccncctcctcagtctctatctgacgcggtcgtggacaaggcacatagncnnnnnnnnnnnnn

SEQ ID NO: 94137 - DNA, 304 bp, Homo sapiens
  misc_feature: GYAE6OF02G4ZNE.29.85.H08.1.454.CMB.1.raw
  modified_base (292)..(304): a, c, t, g, unknown or other
  misc_feature (292)..(304): n is a, c, g, or t
tcagatagagtactcacgaccggtgctcgatttagtatcactcagtcgcgggtccctgatcgcttctctggctccaagtctggcaacactgcctccctgaccatctctgggctccaggctgacgatgacggtgattattactgctgctcatttgcaggcacccgcactgtgatcttcggcggagggaccaagctgaccgtcctaggtcagctcaaggctcgccccctcggtcactctcgttccccgcccctcctcacgtactctatctgagcgggctggcaaggcgcatagnnnnnnnnnnnnn

SEQ ID NO: 94138 - DNA, 658 bp, Homo sapiens
  misc_feature: GYAE6OF02H692G.29.85.H08.1.454.CMB.1.raw
  modified_base (245)..(245): a, c, t, g, unknown or other
  misc_feature (245)..(245): n is a, c, g, or t
tcagatagagtactcacgaccggtgctcgatttagtatcactcagtcgcgggggggtctcaggaggcagcgctcgtggggacgtctccaccatggcctgggctctgctcctcctcacctcctcactcagggcacaggctcttgggcccagtctgccctgattcagccctccctccgtgtcccgggtctcctggacagtcagtcgccatctcctgcactggaaccagcagtgatgttgagaattangactgtctcccttggtaccaacaacacccagacacagtaccaacaaacacatgatatacaatgttacaatactcgccctcgacggggtccctgactcgttttctcgtcggtctaccgtaaagtccgttcgggactaaacgtcgccggtcctacccgaattacgaacctaacttccgttccgtacgggtacctaccgacggtccttagggaacgggaaccggaagggtctaggtaactttaagttaggtgtcgttagaccttacaagttaactaacgttaaagtccgtaagtacgttaccgtaacggtttaacgggggttcggttaccgggcggggtaaccgggtacctaacggtaccgtacggtaccccggttaccggtcggggttaccacggtacccccgtaaggtccccgg

SEQ ID NO: 94139 - DNA, 569 bp, Homo sapiens
  misc_feature: GYAE6OF02HYVGT.29.85.H08.1.454.CMB.1.raw
  modified_base (354)..(354): a, c, t, g, unknown or other
  misc_feature (354)..(354): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaggtgtccagtgtgaagtgcagctggtggagtcgtgggggagtcgtggtacagcctggggggtccctgagactctcctgtgcagcctctggattcaagtttaatgtatttttccatacactgggtcctcaagcgtccggggaggtctggagtgggtctctcttattatcgagacggtnctactacattctatgcagactctgtgaagggccattccaccatcctccagagacaaacaacaagtacctccctgtactctgacaaatgaacagttactagaagtaagtgaaccgacgaggccggtcttcgttatttagtggtagaacgtaaaaggaggaaagggccgaagggtacttaccggttaaagggttcgggttaccggtcgttttacggg

SEQ ID NO: 94140 - DNA, 504 bp, Homo sapiens
  misc_feature: GYAE6OF02F73ZJ.29.85.H08.1.454.CMB.1.raw
  modified_base (237)..(237): a, c, t, g, unknown or other
  misc_feature (237)..(237): n is a, c, g, or t
  modified_base (437)..(437): a, c, t, g, unknown or other
  misc_feature (437)..(437): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctccctccgtgtccgggtctcctggacagtcagtcaccgtctcctgcagtggaaccagcagtgacgttggngcttataaccgtgtctcctggtaccagcagcccccaggcacacgcccccaaactcatgattttgacgtcagtaatcggcctcagggtccctgatcgcttctctggtccaagtctggcagcacggcctcctgattatctctgggcctcagactgaggacgaggctgaattattattgcagctcatatacaaggacaacganatatgtctacgaacgtggaaccaagtcaccgtctacgtcacgccaacggcccaacccactgctaccg

SEQ ID NO: 94141 - DNA, 180 bp, Homo sapiens
  misc_feature: GYAE6OF02GI1M9.29.85.H08.1.454.CMB.1.raw
  modified_base (153)..(180): a, c, t, g, unknown or other
  misc_feature (153)..(180): n is a, c, g, or t
tcagatagagtactcacgaccggtgctcgatttagtatcactcagtcgcggggacacgactggagattaaacgaactgtggctgcaccactctgtcttcatcttcccgccatctgaatagcgtactctgagcgggctggcaaaggcgcatagnnnnnnnnnnnnnnnnnnnnnnnnnnnn

SEQ ID NO: 94142 - DNA, 658 bp, Homo sapiens
  misc_feature: GYAE6OF02F1XMR.29.85.H08.1.454.CMB.1.raw
tcagatagagtactcacgaccggtgctcgatttagtatcactcagtcggcggggggggtctcaggaggcagcactcgtcgggacgtctccaccatggcctgggctctgctcctcctcagcctcctcactcagggcacaggatcctgggctcagtctgccctgactcagcctcgctcagtcgtccgggtctccgtggacagtcagtccaccattcctcctgccacgtacgggaaccagcaggccgattcggtcggttaggttaattaacgttttcgtccttccgtacggtaaccaacaaccgacccaggccgaccggcccccgtatacctaattaactttagtgtattcgtactaagttaacggccgcccgtcggtacggggtcctggactcgtcttctcgtcggacctcgagtcgtacggacaactacgtcgaccccttcgtacgaccctactccgtcgtccgggtccttccgacggtcgtaggaccgagttcggacggttagtactttacgttactcggtctacgtcttacgttagtttcgacgtaccgtccgacccgtcgtaacgttcgtacgtacttcggttaccgggacgggtaacggaccgtaggtccgtacggtacccgtacgttacggacctacggtcgtacgtaacccgg

SEQ ID NO: 94143 - DNA, 511 bp, Homo sapiens
  misc_feature: GYAE6OF02IL58C.29.85.H08.1.454.CMB.1.raw
  modified_base (223)..(223): a, c, t, g, unknown or other
  misc_feature (223)..(223): n is a, c, g, or t
  modified_base (355)..(355): a, c, t, g, unknown or other
  misc_feature (355)..(355): n is a, c, g, or t
  modified_base (391)..(391): a, c, t, g, unknown or other
  misc_feature (391)..(391): n is a, c, g, or t
  modified_base (502)..(502): a, c, t, g, unknown or other
  misc_feature (502)..(502): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctctgcactggaaccngcagcgatgtcggtggttataactttgctcctggtaccaacaacacccaggcgacggcccccgatcatatttatgatgtcattaagccgcctcagggtccctgactcgcttctctggctcaagtctgcaacnctgccctcctgaccatctctgggctcaggctgacgntgacgtgattatactgctgctactatttgcacggccacccgctactgtcgtattcgtcgggcgggacggaaccaaggtccgtacggtaccgtccgtaacggtcacgtaccncgtaaccgg

SEQ ID NO: 94144 - DNA, 628 bp, Homo sapiens
  misc_feature: GYAE6OF02G6YUY.29.85.H08.1.454.CMB.1.raw
  modified_base (224)..(224): a, c, t, g, unknown or other
  misc_feature (224)..(224): n is a, c, g, or t
  modified_base (300)..(300): a, c, t, g, unknown or other
  misc_feature (300)..(300): n is a, c, g, or t
tcagatagagtactcacgaccggtgctcgatttagtatcactcagtcgcggggggggtctcaggaggcagcactctctggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataactttgtctcctggtaccaacaacacccaggcgacggccccccgatcataatttangatgtcattaacgcggccctcgacggggtcctgactcgtcttctctggctcaagtctggcacactcgcctccctgaccatcctcgtcgggccttccgacggtcctcggaccgtagtcggtacggttagtaactttacgtttacctggtcttggtaccttcgtaacgttttcggaccgtacgggtccctaccccggaccgtaacgttggtacgttacgttccggtttaccggggaccggggtaagggtaaccccgtaaacgggttcccgtaccgggttaaccccggttccggttaaccggggttccgtaaccggtcccgttaacccggg

SEQ ID NO: 94145 - DNA, 474 bp, Homo sapiens
  misc_feature: GYAE6OF02I5RMB.29.85.H08.1.454.CMB.1.raw
  modified_base (233)..(233): a, c, t, g, unknown or other
  misc_feature (233)..(233): n is a, c, g, or t
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
  modified_base (462)..(474): a, c, t, g, unknown or other
  misc_feature (462)..(474): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggcctcaggggtccctgatcgcttcnctgctcaagtctggcaacactgcctcctgaccatctctgggctccaggctgacgatgacggtnattattactgctgctctatttgcaggcacccgnactgtgatcgttcgggcgacgggaccaagctcgaccgtcctaggtcagctcgaaggctcgcccctcggtcacctctcgtcccaccctcctcacgtctctactcgtgagcggcgtcgcgaacggcgtcatagcnnnnnnnnnnnnn

SEQ ID NO: 94146 - DNA, 521 bp, Homo sapiens
  misc_feature: GYAE6OF02FVGUF.29.85.H08.1.454.CMB.1.raw
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttangatgtcattaagcgccctnaggggtccctgatcgcttctctggctccaagtctggcaacactgccctccctgacccatcctctcgggctccgaggctgacgatgacggtnattnttactgctgctcatttgcaggccacccgcactgtgtatccgttcgggcgggaacgggacccaaggtcctaggacccgttccgtagggttccaggtcctacgaaccggg

SEQ ID NO: 94147 - DNA, 469 bp, Homo sapiens
  misc_feature: GYAE6OF02FM60M.29.85.H08.1.454.CMB.1.raw
  modified_base (318)..(318): a, c, t, g, unknown or other
  misc_feature (318)..(318): n is a, c, g, or t
  modified_base (402)..(402): a, c, t, g, unknown or other
  misc_feature (402)..(402): n is a, c, g, or t
  modified_base (458)..(469): a, c, t, g, unknown or other
  misc_feature (458)..(469): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataacttttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctnatttgcaggcacccgcactgtgattcgttcggcggagggaccaagctgaccgtctaggtcagctcaggctcgcccctcggtccncttctcgttccccaccctcctcacgtactctatctgagcggctggcaggcgcatgnnnnnnnnnnnn

SEQ ID NO: 94148 - DNA, 525 bp, Homo sapiens
  misc_feature: GYAE6OF02GXHSZ.29.85.H08.1.454.CMB.1.raw
  modified_base (341)..(341): a, c, t, g, unknown or other
  misc_feature (341)..(341): n is a, c, g, or t
  modified_base (493)..(493): a, c, t, g, unknown or other
  misc_feature (493)..(493): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagccgtggggggtccctgagactctcctgtgcagcctctggattcaagtttaatgtatttttccatacactgggtccgtcaagcgtccggggaagggtctggagtgggtctctnttattaatcgagacggtgctactacattctatgcagactctgtgaagggccatcacatctcagacgacaacaacaacgtacctcctagtactctgactaaatgaacagtacagagaagtgacgacgagcgcttatattatgtgacaaaaggngaaggcaggatcgtaaggtgggtctcgttacg

SEQ ID NO: 94149 - DNA, 606 bp, Homo sapiens
  misc_feature: GYAE6OF02JRSSC.29.85.H08.1.454.CMB.1.raw
  modified_base (300)..(300): a, c, t, g, unknown or other
  misc_feature (300)..(300): n is a, c, g, or t
  modified_base (412)..(412): a, c, t, g, unknown or other
  misc_feature (412)..(412): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcgtggtttctgtagctatttaaaggtgtccagtgtgaagtgcagctggtggagtctgggggagtcgtggtacagccgtggggggtccctgagctctcctgtgcagcctctggattcaagtttaatgtattttccatacactgggtccgtnaagtcgtccggggaaggtcgtggagtgggtctcgtcttagttaatcgagtacggtgtactactactattcgtactgacagtactcgtgtagaagggctagttcacatctcanagaacaacaacaacgtactcctagtactacctagaccgaaatacgaaacacgtactcgaaagtaagtacgaacgtaacgaaggtccgggtacttacgttatttagtttaggtacgttaaacaaaagggtaacggaaaggtccgaaagggtattaaccggtaagggttacgggttaccggttacggtttaaccgg

SEQ ID NO: 94150 - DNA, 547 bp, Homo sapiens
  misc_feature: GYAE6OF02HA1QE.29.85.H08.1.454.CMB.1.raw
  modified_base (301)..(301): a, c, t, g, unknown or other
  misc_feature (301)..(301): n is a, c, g, or t
  modified_base (353)..(353): a, c, t, g, unknown or other
  misc_feature (353)..(353): n is a, c, g, or t
  modified_base (500)..(500): a, c, t, g, unknown or other
  misc_feature (500)..(500): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaggtgtccagtgtgaagtgcagctggtggagtctgggggagtcgtggtacagcctggggggtccctgagactctcctgtgcagcctctggattcaagtttaatgattttccatacactggtcctnaagctccggggaaggtcctggagtgggtctcgtcttattaatcgagacggtnctactacattctatgcagactctgtgaagggcgattcacatctcagagaacaacaacaagtacctccctgtaatctgacaaatgaaaccagtctagaagtaacgtgaacgtacagcggtactttactattattggtgacaaaaaggngaaaggtacagggtaacttcgtaaaggtcgggttacgtcgtttacgg

SEQ ID NO: 94151 - DNA, 549 bp, Homo sapiens
  misc_feature: GYAE6OF02H2DQQ.29.85.H08.1.454.CMB.1.raw
  modified_base (301)..(301): a, c, t, g, unknown or other
  misc_feature (301)..(301): n is a, c, g, or t
  modified_base (400)..(400): a, c, t, g, unknown or other
  misc_feature (400)..(400): n is a, c, g, or t
  modified_base (464)..(464): a, c, t, g, unknown or other
  misc_feature (464)..(464): n is a, c, g, or t
  modified_base (474)..(474): a, c, t, g, unknown or other
  misc_feature (474)..(474): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccagcagcgatgtcggtggttataactttgtctcctgtaccaacaacacccaggcgacggccccccgatcaataactttangatgtcatttaagccggccctgacggggtccctgatcgcttctctggctccaagtctggacaacactgccctccctgaccatctcgtcgggccttaccnggctcgacgtatgacggttgatttattactgcctgccttacagttttcgactacggccacccgnaccgttcgtnacgttcgtcggggacggacgggaccaacggcgtcggtaccccgtcgttacggtcctacgtccgtacgtaaccggg

SEQ ID NO: 94152 - DNA, 428 bp, Homo sapiens
  misc_feature: GYAE6OF02GLMXP.29.85.H08.1.454.CMB.1.raw
  modified_base (412)..(412): a, c, t, g, unknown or other
  misc_feature (412)..(412): n is a, c, g, or t
  modified_base (418)..(428): a, c, t, g, unknown or other
  misc_feature (418)..(428): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgccctccctgaccatctctgggctccaggctgacgatgacggtgatttattactgctgctcatttgcaggccacccgcactgtgatcgttcgggcggagggaccaaggctggaccgtcctaggtcagctcaaggctcgcccctggtcactctcgttcccaccctctcacgtactctactctgacgcgggctggcaggcncatagnnnnnnnnnnn

SEQ ID NO: 94153 - DNA, 575 bp, Homo sapiens
  misc_feature: GYAE6OF02HRGRA.29.85.H08.1.454.CMB.1.raw
  modified_base (302)..(302): a, c, t, g, unknown or other
  misc_feature (302)..(302): n is a, c, g, or t
  modified_base (484)..(484): a, c, t, g, unknown or other
  misc_feature (484)..(484): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccagcagcgatggtcggtggttataactttgtctcctggtaccaacaacacccaggcgacggccccccgactcataatttangatgtcaattaacgcgccctcgacggggtccctgactcgtcttctctggctccgaagtctcggacaacactcgccctccctgaccatcctacgtcggcctccgaggtctcggacgattcggacggttgtatttacgttaactgtaccttagccttacttagttcgcgaacggccaccccganaccgtatgtacttcggttccgggcggtaacgggacctaacgtcgtaaccggacccgttaccggtaggtcccgagcccgtacgtaacccggg

SEQ ID NO: 94154 - DNA, 521 bp, Homo sapiens
  misc_feature: GYAE6OF02FTUXD.29.85.H08.1.454.CMB.1.raw
  modified_base (223)..(223): a, c, t, g, unknown or other
  misc_feature (223)..(223): n is a, c, g, or t
  modified_base (350)..(350): a, c, t, g, unknown or other
  misc_feature (350)..(350): n is a, c, g, or t
  modified_base (439)..(439): a, c, t, g, unknown or other
  misc_feature (439)..(439): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccngcagcgatgtcgtgtatacttgtctctgtaccaacacaccaggcgacggcccccatcataatttatgatgtcattaacgcgccctgacggggtccctgactcgcttctctggctcagtctggcaacnctgccctcctcgacctatctcgtggctccgaggctgacagtcgacgtgatttatactgtctcgtctcttatttcgctacgccaccccgnacgtgtagtcttccgtacgggcggaacggaccaacgccgttaccggaccgttaccgtacggtccacggtcctaggtaaccgg

SEQ ID NO: 94155 - DNA, 471 bp, Homo sapiens
  misc_feature: GYAE6OF02JFGSV.29.85.H08.1.454.CMB.1.raw
  modified_base (333)..(333): a, c, t, g, unknown or other
  misc_feature (333)..(333): n is a, c, g, or t
  modified_base (456)..(456): a, c, t, g, unknown or other
  misc_feature (456)..(456): n is a, c, g, or t
  modified_base (458)..(471): a, c, t, g, unknown or other
  misc_feature (458)..(471): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcacccgnactgtgatcttcggcgagggaccaagctgaccgtcctaggtcagctcaggctcgcccctcggtcactctgttcccaccctcctcacgtactctactctgagcgggctggcaaggcgcagtagngnnnnnnnnnnnnnn

SEQ ID NO: 94156 - DNA, 706 bp, Homo sapiens
  misc_feature: GYAE6OF02IJTJU.29.85.H08.1.454.CMB.1.raw
  modified_base (337)..(337): a, c, t, g, unknown or other
  misc_feature (337)..(337): n is a, c, g, or t
tcagatagagtactcacgaccggtgctcgatttagtatcactcagtcgcggggagcgtctgggagaggagccccagccctgagattcccaggtgtttccattcggtgatcagcactgaacacagagaacgcaccatggagtttggactgagctgggtttcctgttgctatttaaaggtgtccagtgtgaagtgcagctggtgagtctgggggagtcgtggtacagccgtgggggtccctgaggactctcctgtgcagcctctggattcaagtttaatgtatttttccattacacgttggtcctacaagtcgtccggggaaggtctggagtgggtctntcttataagtcgagtacggtgctactactattctatgacacgtacttctaggttgaaacggggcctaagtttcaacccgtattcccgtaccgaaggtaacgtaaccgtaaaacgtaaaccaaacggttaaacccttaccccgttaaggttaactttaccgttacgaacctaaaagtcgaaacctacggttaccttaggaaacggtaacgttacggaaccgtaaccagggtacccgggtaacgttttaccgttaagttttacgtttacggtaacggtaaacgaaaaacgggtaacggaaagggttaccgaagggtaaaccgtttccggtaaaacggggtttcggggtaccggtttacggttttaacgggg

SEQ ID NO: 94157 - DNA, 542 bp, Homo sapiens
  misc_feature: GYAE6OF02IQ4RW.29.85.H08.1.454.CMB.1.raw
  modified_base (300)..(300): a, c, t, g, unknown or other
  misc_feature (300)..(300): n is a, c, g, or t
  modified_base (372)..(372): a, c, t, g, unknown or other
  misc_feature (372)..(372): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccagcagcgatgtcggtggttataactttgtctcctggtaccaacaacacccaggccgacggcccccgactcataatttangatgtcattaacgcgtcctcgacggggtccctgatcgcttctctggctcaagtctgcaacactcgcctcctnaccatctcgtggcctcgagctgacgatgacgtagtattattactgtctgtcttactagtttcgacgacggtccacccgctacgtgtacgtacttccggttcgggacggtaaccgggaccaacggtccttacggtacccgttacgttacggtcctacggtcctacgaacgg

SEQ ID NO: 94158 - DNA, 618 bp, Homo sapiens
  misc_feature: GYAE6OF02IMLDU.29.85.H08.1.454.CMB.1.raw
  modified_base (292)..(292): a, c, t, g, unknown or other
  misc_feature (292)..(292): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcacatctcctgcactggaaccagcagcgatgtcggtgttataactttgtctctgtaccaacaacaccagcgacgccccgactcataattangatgtcattaacgcggcctcgacgggtccctgatcgtctctctggctccgagtctgcaacactcgccctcctcgacctactcctcgtcggcctaccgacggtctgaccgagtcgacgggtatacgttaattactcggtctcgtcttacgttacttttacgacgtaacggcccgaaccccgtctaaccgttcggttacggtacgtttccggtttacccgggggacgggtaaccggggtaaccctaacgggtcccgttaaccgggttacccccggttaacccgtttacgggggacccgttaacggtcccgttaccggtaaacccgggg

SEQ ID NO: 94159 - DNA, 503 bp, Homo sapiens
  misc_feature: GYAE6OF02IO0LL.29.85.H08.1.454.CMB.1.raw
  modified_base (357)..(357): a, c, t, g, unknown or other
  misc_feature (357)..(357): n is a, c, g, or t
  modified_base (393)..(393): a, c, t, g, unknown or other
  misc_feature (393)..(393): n is a, c, g, or t
  modified_base (400)..(400): a, c, t, g, unknown or other
  misc_feature (400)..(400): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggccgaggccccccgatcataatttatgatgtcattaagcggccctcgaggggtcctgatcgcttctctgctcagtctgcacnctgcctcctgaccatctcgtggctccaggctgacgntgacgtnattatctgctgctactatttgctacgccacccgnactgtncttccgttcggcggaggaccaaggtccgtcgacccgtcgtaggtccgagtcctagtaaccggg

SEQ ID NO: 94160 - DNA, 558 bp, Homo sapiens
  misc_feature: GYAE6OF02JEN32.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagccgtggggggtccctgagactctcctgtgcagcctctggattcaagtttaatgtatttttccatacactgggtccgtcagcgtccggggaaggtctgggagtgggtctctcttattatcgagacggtgctactactattctatgcagtactctggtagaacgggccgtattcaccatcctaccagacgacaacaacaacgtacctccttagtactctgactaaatgaactagtctagaagtaagtgacgacagcggtcttactattattggtagaacaaaaggagaaggacgaggtactacgttaaggtcgggttacgtcgtttacgg

SEQ ID NO: 94161 - DNA, 497 bp, Homo sapiens
  misc_feature: GYAE6OF02GL5FH.29.85.H08.1.454.CMB.1.raw
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (398)..(398): a, c, t, g, unknown or other
  misc_feature (398)..(398): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatccataatttacngatgtcattaagcgccctcgaggggtccctgatcgcttctctggctcaagtctggcaacnctgcctccngaccatctctgggctccgagctgacgntgacgtgattatactgctgctnatttcgcngccacccgnactgtgatcgtcgggcggacggacaaggcctaggacccgtctaggtcacggtctcaacgg

SEQ ID NO: 94162 - DNA, 164 bp, Homo sapiens
  misc_feature: GYAE6OF02JZPNJ.29.85.H08.1.454.CMB.1.raw
  modified_base (150)..(164): a, c, t, g, unknown or other
  misc_feature (150)..(164): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcgggctggcaaggcgcatagnnnnnnnnnnnnnnn

SEQ ID NO: 94163 - DNA, 503 bp, Homo sapiens
  misc_feature: GYAE6OF02FNK0H.29.85.H08.1.454.CMB.1.raw
  modified_base (224)..(224): a, c, t, g, unknown or other
  misc_feature (224)..(224): n is a, c, g, or t
  modified_base (295)..(295): a, c, t, g, unknown or other
  misc_feature (295)..(295): n is a, c, g, or t
  modified_base (356)..(356): a, c, t, g, unknown or other
  misc_feature (356)..(356): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataactttgtctctgtaccaacaacacccaggcgacgcccccgatcataattangatgtcattaagcggccctcgaggggtccctgactcgcttctctggctcaagtctgcaacnctgcctccctgacctatctctcgggctccgagctgacgatggacgtgtattattacgtgctgctctatttgctacggccacccgcactgtgactcgtcgggcggagggaccaaggcctagacccgtccgtaggtcacgcctagacgg

SEQ ID NO: 94164 - DNA, 585 bp, Homo sapiens
  misc_feature: GYAE6OF02I4CGP.29.85.H08.1.454.CMB.1.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
tcagatagagtactcacgaccggtgctcgatttagtatcactcagtcgcgggggggtcgtcgaggaggcgagcactctcgggacgtctccaccatggcctgggctctgctcctcctcagcctcctcacctcagggcacaggatcctgggctcagtctgccctgactcagcctcgctcagtgtccgggtctcctaggacngttccagtcaccatcctcctgcacgtggaaccngcagcatgtcgtgtatacttgtctctgtaccacacaccagcgagcccccgancataacttacngatcgctattaacgcgcctgacgggtccctagacncgtctctcngctcagtctgacacactgcctctcgaccntctcgtcggctcccgaggtcctgacgtatcggtaacgtcgttattattaccgacgtctgtcttcgtagttttcgcggtaacgggtccctaacccggtcaacgtttcgtaaccgtacgttccgtttcgggggaaccgggtaacggtaacctaagggcccgtttaccggtaccccggtaccgttttaagggcccctaagggtcccgttaggaacccggg

SEQ ID NO: 94165 - DNA, 647 bp, Homo sapiens
  misc_feature: GYAE6OF02HLBME.29.85.H08.1.454.CMB.1.raw
  modified_base (299)..(299): a, c, t, g, unknown or other
  misc_feature (299)..(299): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttataactttgtctcctggtaccaacaacacccaggcgacggccccccgatcaataattangatgtcattaacgcgtccctcgacggggtccctgatccgcttctcgtggcctaccaagtctggaccaacgactcgccctccctcgacctattcctcgtcgggcccttccgaggcttacgaaccgtagtacggacggttataactttaacttaccgtggaccctttggaccctttacgttaagttttccgggaccgtaaccgggtcccaacccccggtctaacccgttggttaccgtactttacccggtttccgggggaccgggtaaccgggaaccctaaacgggtcccgttaccggaaccccgggtttccgtaacgggtcccgtaacggtcccgtacggtaacccggg

SEQ ID NO: 94166 - DNA, 492 bp, Homo sapiens
  misc_feature: GYAE6OF02I099Y.29.85.H08.1.454.CMB.1.raw
  modified_base (169)..(169): a, c, t, g, unknown or other
  misc_feature (169)..(169): n is a, c, g, or t
  modified_base (269)..(269): a, c, t, g, unknown or other
  misc_feature (269)..(269): n is a, c, g, or t
  modified_base (459)..(459): a, c, t, g, unknown or other
  misc_feature (459)..(459): n is a, c, g, or t
  modified_base (461)..(492): a, c, t, g, unknown or other
  misc_feature (461)..(492): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgatcataatttatgatgtcattaagcggccctnaggggtccctgatcgcttctctggctccaagtctggcaacactgcctccctgaccatctctgggctccgaggctgacgatgacggtgattatactgctgnttcatttgcgaggccacccgcactgtgatcgttcggcggaggaccaagctcgaccgtctaggtcagctacgaacggctcgacccccgtggtcctacgttcctccgttcccccacccttccgtactacgtaccttctacgttccgtaggtacggccgggtacgtcgggacgaacggtcgacgtacgtacgncnnnnnnnnnnnnnnnnnnnnnnnnnnnnnnnn

SEQ ID NO: 94167 - DNA, 652 bp, Homo sapiens
  misc_feature: GYAE6OF02HT0TF.29.85.H08.1.454.CMB.1.raw
  modified_base (222)..(222): a, c, t, g, unknown or other
  misc_feature (222)..(222): n is a, c, g, or t
  modified_base (293)..(293): a, c, t, g, unknown or other
  misc_feature (293)..(293): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccngcagcatgtcggtgttatactttgtctctgtaccaacaacacccaggcgacggcccccgatcataatttangatgtacattaacgcgccctcgacggggtcctgactccgtcttcctctcggcctaccgaagttctacggaccaaacaccttccggtacccttccccgtacgaaccctacgttcccgttccgttacgggcccttacccggacgggtccttacggaaccggtacgttacgggtaaccgggtttagtaacttttacgtttaaccgtggtaccttgtccttacgttacgttttcgaccgtaacggtcccaccccggtctaccgttgtacgtacttccggttaccggggacgggtacgggtaaccgaacggtccgttacggtacccggttaccgtacggtaccgacggtccgtacgtaaccggg

SEQ ID NO: 94168 - DNA, 490 bp, Homo sapiens
  misc_feature: GYAE6OF02F6Q4Z.29.85.H08.1.454.CMB.1.raw
  modified_base (223)..(223): a, c, t, g, unknown or other
  misc_feature (223)..(223): n is a, c, g, or t
  modified_base (299)..(299): a, c, t, g, unknown or other
  misc_feature (299)..(299): n is a, c, g, or t
  modified_base (359)..(359): a, c, t, g, unknown or other
  misc_feature (359)..(359): n is a, c, g, or t
  modified_base (419)..(419): a, c, t, g, unknown or other
  misc_feature (419)..(419): n is a, c, g, or t
  modified_base (436)..(436): a, c, t, g, unknown or other
  misc_feature (436)..(436): n is a, c, g, or t
  modified_base (443)..(443): a, c, t, g, unknown or other
  misc_feature (443)..(443): n is a, c, g, or t
  modified_base (484)..(484): a, c, t, g, unknown or other
  misc_feature (484)..(484): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttataactttgtctcctggtaccaacaacacccaggcgaggccccccgatcataatttangatgtcattaagcgccctcaggggtccctgatcgcttctctggctccaagtctggcaacnctgccctcctgaccatctctgggctccaggctgacgatgacgtgattattactgctgctntatttgcaggcacccgnacgtgtnactcgttcggcggaggaccagctgaccgtctaggtcagtcncgacgg

SEQ ID NO: 94169 - DNA, 584 bp, Homo sapiens
  misc_feature: GYAE6OF02F2506.29.85.H08.1.454.CMB.1.raw
  modified_base (224)..(224): a, c, t, g, unknown or other
  misc_feature (224)..(224): n is a, c, g, or t
  modified_base (479)..(479): a, c, t, g, unknown or other
  misc_feature (479)..(479): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatggtcgtggttataactttgtctctgtaccaacaacacccaggcgacgcccccgatcataattatgatgtacattaagccggccctcgacggggtccctgactcgcttctctcgccttcaagtctggacaactactcgccctcccagaccctatctcgtcggcctccgaggctaggacgagtcggtaacggtgtaatttacttacgtcgtcgtcgtcttactacgttttcgcctacggccctacccgntaccgtgtacgtacgttccgttacgggccgggtaacgggaacctaacggtcccgtacggtaaccccgttccgttacggtaccgaccggtacgtccggtaaccggg

SEQ ID NO: 94170 - DNA, 562 bp, Homo sapiens
  misc_feature: GYAE6OF02G8QHF.29.85.H08.1.454.CMB.1.raw
  modified_base (291)..(291): a, c, t, g, unknown or other
  misc_feature (291)..(291): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtccaccatctcctgcactggaaccagcagcgatggtcgtgttataacttgtctctgtacaacacaccagcgacgcccccgatcataattangatgtacattaagcgcctcgacggggtccctgactcgcttctctcggctcaagtctgacaacactcgccctccctgaccctatcctcgtcgggcctccgaggctgacgagtggacggtgtaatttattactgtctgtccttacttagtttcgacgaggcccacccgctaacgttgtcgtacgttcggttccggggacgggtacgggaaccgtaacggtccgtacggtaccccgttccgttaagggtcctaacggtcgtaccggtaaccggg

SEQ ID NO: 94171 - DNA, 617 bp, Homo sapiens
  misc_feature: GYAE6OF02IDOS1.29.85.H08.1.454.CMB.1.raw
  modified_base (267)..(267): a, c, t, g, unknown or other
  misc_feature (267)..(267): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgcttattttaaaggtgtccagtgtgaagtgcagctggtggagtcgtgggggagtcgtggtacaggccgtggggggtccctgagactctcctgtgcagcctntggattctaagtttatgtatttttccatactacgtgggtcccgtcaacggccgtaccgggggaagggtctgggaggttgggttctctctttattaagtcggagtacggtgactactactattctatcgcagtactcgtgtcggaagggtccgtattaccacctattcctaccaagacgaaccaaacaactaacgttacctacccttagttactcgtacgactaaatacgaacagtactagaacgtaagtacgacgacgacggcggtacttacttattagttgtaggaacaaaggtaacggtaaggacgtaaggacttacggttaagggtcgggttacggtacgtttacgg

SEQ ID NO: 94172 - DNA, 192 bp, Homo sapiens
  misc_feature: GYAE6OF02GEC3W.29.85.H08.1.454.CMB.1.raw
  modified_base (152)..(192): a, c, t, g, unknown or other
  misc_feature (152)..(192): n is a, c, g, or t
tcagatagagtactcacgaccggtgctcgatttagtatcactcagtcggcgggacacgactggagattaaacgaactgtggctgcaccatctgtcttcatcttcccgccatctgaatagcgtactctgagccggctggcaaaggcgcatagnnnnnnnnnnnnnnnnnnnnnnnnnnnnnnnnnnnnnnnnn

SEQ ID NO: 94173 - DNA, 543 bp, Homo sapiens
  misc_feature: GYAE6OF02G35K6.29.85.H08.1.454.CMB.1.raw
tcagatagagtactcacgaccggtgctcgatttagtatcactcagtcgcgggaagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctggggggagtcgtggtacagccgtggggggtccctgagactctcctgtgcagcctctggattctaagtttaatgtatttttccatacactgggtcctcaagcgtccggggaaggtctggagtgggtctctcttattatcgagacggtgctactacattctatgcagactctgtgaacgggcgatcaccatcctccagacgacaacaacaacgtactccctgtactctcgactaaatgaacagtctgagaagtgacgacagcgtacttctattacgttgtcgaactaaagaggaaggtacgaaggtactacgtaaggtcggggtcgtgttacgg

SEQ ID NO: 94174 - DNA, 151 bp, Homo sapiens; identical to SEQ ID NO: 93409
  misc_feature: GYAE6OF02FN4Z2.29.85.H08.1.454.CMB.1.raw
  modified_base (150)..(151): a, c, t, g, unknown or other
  misc_feature (150)..(151): n is a, c, g, or t

SEQ ID NO: 94175 - DNA, 415 bp, Homo sapiens
  misc_feature: GYAE6OF02HZWBP.29.85.H08.1.454.CMB.1.raw
  modified_base (405)..(405): a, c, t, g, unknown or other
  misc_feature (405)..(405): n is a, c, g, or t
  modified_base (407)..(415): a, c, t, g, unknown or other
  misc_feature (407)..(415): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacactgcctcctgaccatctctgggctccaggctgacgatgacggtgattatactgctgctcatttgcaggccacccgcactgtgatctcgggcggaggaccaagctgaccgtcctaggtcagctcgaaggctcgcccctgtcactctcgttcccgcccttcctcagtctctactctgaggcggctggcaaggcgcangnnnnnnnnn

SEQ ID NO: 94176 - DNA, 489 bp, Homo sapiens
  misc_feature: GYAE6OF02JEMU4.29.85.H08.1.454.CMB.1.raw
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
  modified_base (282)..(282): a, c, t, g, unknown or other
  misc_feature (282)..(282): n is a, c, g, or t
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccngcagcgatgtcgtgttatacttgctctgtaccaanacaccagcacgccccatcatattangatgctataagcggcctcgacggggtccctgatccgtcttctcgtcggctccaagtctggcaacactcgcctcctgaccatctctggcctcgagctgacgntcgacgtgattatactnctgcttntattgctagtccaccgtntaacgtgtnacgttcgcgggtacggaggacctagcgtcgaccgtcgagtccacgtctacgacgg

SEQ ID NO: 94177 - DNA, 677 bp, Homo sapiens
  misc_feature: GYAE6OF02IE60E.29.85.H08.1.454.CMB.1.raw
  modified_base (297)..(297): a, c, t, g, unknown or other
  misc_feature (297)..(297): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctctgcactggaaccagcagcgatgtcggtgttatactttgtctcctgtaccaacaacaccaggcgacggcccccgactcaattaatttangtatgtcaattaagccgccctcgacggggtccctgactcgtcttctcgtggcctaccgtaagtctaggaccaaccgtacctcgccccttcccgtacgaaccctacttcccgtcgtcgggcctccggacggtccttacggaaccggttagtacgggtaaccgggttagtaacttttacgttaacctcggtaccgttcggtaccctttacgtacgttttcgaccgtaaccggggtccctaacccccggtactaacgttcgttacggtaccgtttcccggttaccggggaccggggtaaacgggtaccccgtaaagggtcccttaccgggtacccgttaccggttacgggtacccgtaacggtcccgttaaccggtaaccggg

SEQ ID NO: 94178 - DNA, 602 bp, Homo sapiens
  misc_feature: GYAE6OF02H98XD.29.85.H08.1.454.CMB.1.raw
  modified_base (295)..(295): a, c, t, g, unknown or other
  misc_feature (295)..(295): n is a, c, g, or t
  modified_base (328)..(328): a, c, t, g, unknown or other
  misc_feature (328)..(328): n is a, c, g, or t
  modified_base (485)..(485): a, c, t, g, unknown or other
  misc_feature (485)..(485): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccagcagcgatgtcgtgtataacttgtctctgtaccaacaacaccaggcgaccggacccccgatacaataacttanacgatcgtcaattaagccgcctcgacgggtccngatcgcttctcgtcgtcctacaacgtctcggacaacgactcgccttccgacgtaccactcgtcgtcgggtcctcgacggtcctaggacgtactcggaccggttagtacttttaacgttactcggtcttgtcccttagttaacttggaccacggaccnccccggtataccgttgtacgtacgttcggttaccgggacgggtaaccggacctaaacggtccgttacggtaccccgttaccggttacggtacgtaccgtccgttacggtaacccggg

SEQ ID NO: 94179 - DNA, 647 bp, Homo sapiens
  misc_feature: GYAE6OF02F844G.29.85.H08.1.454.CMB.1.raw
tcagatagagtactcacgaccggtgctcgatttagtatcactcagtcgcggggagctctgggagaggagccccagccctgagattccccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagccgtggggggtccctggagactctcctgtgcagcctctggattcaagtttaatgtattttccatacactgggtccgtcaagcgtccggggaaggtcgtggagtgggtctctcttatatcgagacggtgactactacattctatgacagtactctggtagaacgggccgtattaccacctatcctaccgagacgaacaaaccaactaaacgtacctacccttaggtacttccgtacgaacctaaaattcgaaacctaggttactaaggaagtaacggttcgaaccgtaaccgaggtaccgggttacctttacgttatttacgtttcggtaaggtaaccgtaaaaagggtacggaaacgggtcgtaagggtacttacccggttaagggttccgggggttaccgttggttttaaccggg

SEQ ID NO: 94180 - DNA, 505 bp, Homo sapiens
  misc_feature: GYAE6OF02H0F7I.29.85.H08.1.454.CMB.1.raw
  modified_base (290)..(290): a, c, t, g, unknown or other
  misc_feature (290)..(290): n is a, c, g, or t
  modified_base (350)..(350): a, c, t, g, unknown or other
  misc_feature (350)..(350): n is a, c, g, or t
  modified_base (388)..(388): a, c, t, g, unknown or other
  misc_feature (388)..(388): n is a, c, g, or t
  modified_base (428)..(428): a, c, t, g, unknown or other
  misc_feature (428)..(428): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccagcagcgatgtcggtgttatacttgtctctgtaccaacacaccaggcgacggccccgatcataattangatgtcattaagcgcctcgacgggtcctgactcgcttctctggctcaagtctcgacaacnctcgcctcctgaccatctcgtcggctccgagctgacgntcgacgtgattattactgctgctctatttgcagcacccgnactgtgtacgtcgtcggcggacggtaccaacgtcgtacggtaccgttccgtacggtacgtacgtccgtacgtaacgg

SEQ ID NO: 94181 - DNA, 478 bp, Homo sapiens
  misc_feature: GYAE6OF02FR8OD.29.85.H08.1.454.CMB.1.raw
  modified_base (334)..(334): a, c, t, g, unknown or other
  misc_feature (334)..(334): n is a, c, g, or t
  modified_base (465)..(478): a, c, t, g, unknown or other
  misc_feature (465)..(478): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggccacccgnactgtgattcgtcgggcggagacgaccaagctcgaccgtcctaggtcagctcaaggctccgccccctcggtcacctctcgttccccaccctcctcacgttctctatctgcgcgggctggcaggcgcatagnnnnnnnnnnnnnn

SEQ ID NO: 94182 - DNA, 678 bp, Homo sapiens
  misc_feature: GYAE6OF02HFVIV.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcgagggcacaggatccgtgggctcagtctgccctgactcagcctcgctcagtgtccggtctccgtggacagtcagtcacatctcctgcacgtggaacccagccagcgatggtcggtgttatactttgtctcgtgtaccaacacaccaggcgaccggcccccgactcattaatttatgatgtcattaacgccgcctcgacgggtcctgtactcgtcttccgtcgtcggtcctaccgaacgttcgtacggacctaaacctaccgtccgacccctttcccgtacggtaccctactttcccgttccggttcgggtcccttacccgaacggtccgtacggacggtacgtagggtaccggttagtaacttttaacgttaccgtggtaccttcggtaccttccgttaagttttccgaccgtaaccgggtccccaaccccggtaccgaccgtttggtacgtacgtttcccggttcgggggaacggtaacccgggaacctaacggtccgtaaccgggtacccgttccggtaacggccgtacggtccgtagtaaccccggg

SEQ ID NO: 94183 - DNA, 751 bp, Homo sapiens
  misc_feature: GYAE6OF02IV3S2.29.85.H08.1.454.CMB.1.raw
  modified_base (226)..(226): a, c, t, g, unknown or other
  misc_feature (226)..(226): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatctcctgacactggaaaccngcgagcgtagtcggtcggtagttaattactttcgtcttccgtacgtaaccaaacaacacccgacggaccggacccggacccccgactacctaacttaactttacgtagtagtacgtactaacgttaacggacccggtacccgtaccggtacggggttaccctacgtacgtccgtccttccgtcgtcgtaccgttaccgtaacgttcgtacgacctaactaccgtccgtaccctaccgtaccgacctacgttccgtccggtcggtaccgtacccgtacggtaccgtacggtaacggtacgtacggtaaccggtttacgttaactttaaccgttaccgttacgtaccgttcgttacctttacgttacggtttaccgaccggtaaccggtacccgtaacccggtacgtaacgttcgttacgttaccgtttacccggtaccggggtaaccgggtaacggaacccggtaacggtccggttaccgtaccggttaccgttacggtacccgtacggtaccgtaccggtaccgg

SEQ ID NO: 94184 - DNA, 588 bp, Homo sapiens
  misc_feature: GYAE6OF02GIGB4.29.85.H08.1.454.CMB.1.raw
  modified_base (224)..(224): a, c, t, g, unknown or other
  misc_feature (224)..(224): n is a, c, g, or t
  modified_base (295)..(295): a, c, t, g, unknown or other
  misc_feature (295)..(295): n is a, c, g, or t
  modified_base (359)..(359): a, c, t, g, unknown or other
  misc_feature (359)..(359): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttatacttgtctctggtaccaacaacaccaggcgacggcccccgatcataattangatgtacattaagcgccctcgacggggtccctgactcgcttctctggctccaagtctggcaacnctcgccctccctgaccctatcctcgtcgggcctccgaggtctgacgatggacggtgtaatttattacgtgtactcgtcttctagtttcgcgtacggccaacccgtcaacgttggtacgtacgttccggtttaccgggccggggtaacgggacccgtaaacggtcccgttaccggtaaccccggttcccggttaaccgggtaccgtacggtacccgtacggtaacccggg

SEQ ID NO: 94185 - DNA, 584 bp, Homo sapiens
  misc_feature: GYAE6OF02I3OHW.29.85.H08.1.454.CMB.1.raw
  modified_base (429)..(429): a, c, t, g, unknown or other
  misc_feature (429)..(429): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctgtaccaacaacaccaggcgacggcccccgactcataatttatgatgtcattaacgccggccctcgacggggtccctgactcgcttctcgtcggctccaagtctggacaactactcgccctcctcgacctacttctcgtgggcctaccgaggctggacgtagtcggacggttntaactttacttacgtgtcttgccttacgtagtttcgcgtacggccacccgtctacgtgtacgtacttcggttaccgggacgggtaaccggaaccgaacggtccgtacgggtaccccgttccgttaacggtccgtaacggtcctacggtaaccggg

SEQ ID NO: 94186 - DNA, 149 bp, Homo sapiens; identical to SEQ ID NO: 93464
  misc_feature: GYAE6OF02HG8EC.29.85.H08.1.454.CMB.1.raw

SEQ ID NO: 94187 - DNA, 527 bp, Homo sapiens
  misc_feature: GYAE6OF02JJKVZ.29.85.H08.1.454.CMB.1.raw
  modified_base (224)..(224): a, c, t, g, unknown or other
  misc_feature (224)..(224): n is a, c, g, or t
  modified_base (325)..(325): a, c, t, g, unknown or other
  misc_feature (325)..(325): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (401)..(401): a, c, t, g, unknown or other
  misc_feature (401)..(401): n is a, c, g, or t
  modified_base (440)..(440): a, c, t, g, unknown or other
  misc_feature (440)..(440): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcatgtcgtggttataacttgtctctgtacacaacaccaggcgacggcccccgatcataatttactgatgtcattaagcggccctcgacgggtcctgntcgcttctctcgctcaagtctgcacnctcgcctcctnaccactctcgtcggcctcgagtctgacgtatggacggtntactttatacgtgtctgcgtctagtttcgactacggccncccgactacgtgttcgagttccgtcgggacggtaacggaccgaagtccgtaggacccgttacgacgtccgacgtcgtacgtaaccgg

SEQ ID NO: 94188 - DNA, 535 bp, Homo sapiens
  misc_feature: GYAE6OF02F6RSI.29.85.H08.1.454.CMB.1.raw
  modified_base (223)..(223): a, c, t, g, unknown or other
  misc_feature (223)..(223): n is a, c, g, or t
  modified_base (356)..(356): a, c, t, g, unknown or other
  misc_feature (356)..(356): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataacttgtctctgtaccaacaacaccaggcgacggccccgactcataattatgatgtcattaagccggccctcgacgggtcctgactcgcttctctcgaaactcagtctgcaacnctcgcctcctcgacctactcctcgtcgggtcctccgacggtctcggacgagtcggtacggtgtattattactgtctgtctctatttgcgacggccacccgcacgtcgtgtacgtcgttcgggcgggtacggaccgaacgtcgtacggacccgtccgtacggtcgacgtcgtacgtacgg

SEQ ID NO: 94189 - DNA, 628 bp, Homo sapiens
  misc_feature: GYAE6OF02G9VD4.29.85.H08.1.454.CMB.1.raw
  modified_base (224)..(224): a, c, t, g, unknown or other
  misc_feature (224)..(224): n is a, c, g, or t
  modified_base (296)..(296): a, c, t, g, unknown or other
  misc_feature (296)..(296): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataactttgtctcctgtaccaacaacaccaggcgacggcccccgatcataattangatgtcattaacgcggcctcgacggggtcctgactcgtcttctctggctcaagtcngacaacnctcgccctccctgacctatcctcgtcgggcctaccgaggtcctacggacgtagtacggtacggttgttaactttagttaccgtcggtccttaggtcctttacgtaacgttttcggaccgtaacgggtccctaaccccggtctaaccgttggttacgtacgttccggtttccgggggacggggaaccggggtaaccctaacgggtcccgttacgggtaaccccggttaccgttaacggggtccctaacggtcccgttacggaaacccggg

SEQ ID NO: 94190 - DNA, 660 bp, Homo sapiens
  misc_feature: GYAE6OF02FU118.29.85.H08.1.454.CMB.1.raw
  modified_base (121)..(121): a, c, t, g, unknown or other
  misc_feature (121)..(121): n is a, c, g, or t
  modified_base (557)..(557): a, c, t, g, unknown or other
  misc_feature (557)..(557): n is a, c, g, or t
  modified_base (619)..(619): a, c, t, g, unknown or other
  misc_feature (619)..(619): n is a, c, g, or t
  modified_base (646)..(660): a, c, t, g, unknown or other
  misc_feature (646)..(660): n is a, c, g, or t
tcagatagagtactcacgaccggtgctcgatttagtatcactcagtctgccctgactcagcctcgctcagtgtccgggtctcctggacagtcagtcaccatctcctgcactgggaacccgnacgacgacgtagtcggtcgggttagttaaactttaacgttttcgtccttcggtacgtaaccaaaccaacccaaccggacggacggaccccccgggaccccctactactaaatttaatttagagtagttcgtaacttaaagttacggccccgtccctacggggtacccgggtccagtaccgtccgttccttcctcggtcgtccctaacgtacgttcggtcgaaccaaactcgtcctacccccttccgaccgaacctacttcccttgggtccggtccctacggacggtctacggaacgtgtacgggtacggagttaattttaacttacgtcgtgtccgtcctaacgtttagttccgacggtaccgaccccgtccgacttacgtggtactacgttcggtcggggacgggaaccgacacgtcgaccgtccgtacgtgacncgtcagacgtctccccgccgtcgactcgttcgtcccgtccctccctcacgtactctactacncgtagcgggctagcgacgcgcagagcnnnnnnnnnnnnnnn

SEQ ID NO: 94191 - DNA, 185 bp, Homo sapiens
  misc_feature: GYAE6OF02IFQFO.29.85.H08.1.454.CMB.1.raw
  modified_base (151)..(185): a, c, t, g, unknown or other
  misc_feature (151)..(185): n is a, c, g, or t
tcagatagagtactcacgaccggtgctcgatttagtatcactcagtcgcgggacgacgactggagattaaacgaactgtggctgcaccatctgtcttcatcttcccgccatctgaatagcgtactctgagcgggctggcaaggcgcatagnnnnnnnnnnnnnnnnnnnnnnnnnnnnnnnnnnn

SEQ ID NO: 94192 - DNA, 525 bp, Homo sapiens
  misc_feature: GYAE6OF02I47WM.29.85.H08.1.454.CMB.1.raw
  modified_base (362)..(362): a, c, t, g, unknown or other
  misc_feature (362)..(362): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggcgaggcccccgactcataatttatgatgtcattaaagcggaccctcaggggtccctgatcgcttctctggctccaagtctggcaacnctgcctcctgaccatctctgggctccaggctgacgatggacggtgacttattactgctagctcattttgcaggtccaacccggcaacctgtgacttcgttcggcgggaagggaccaaacggtctacggtacccggtcctagggtccaaggtcctacgtaacgg

SEQ ID NO: 94193 - DNA, 594 bp, Homo sapiens
  misc_feature: GYAE6OF02GOO3Q.29.85.H08.1.454.CMB.1.raw
  modified_base (224)..(224): a, c, t, g, unknown or other
  misc_feature (224)..(224): n is a, c, g, or t
  modified_base (352)..(352): a, c, t, g, unknown or other
  misc_feature (352)..(352): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttatacttgtctctgtaccaacacaccaggcgacggcccccgactcataatttatgatgtcattaagcggcctcgacggggtccctgactcgcttctctgctcagtctgcacnctcgcctcctgaccactctcgtcgggcctccgaggtcctaggaccgagttcggaaccggtgtaacttttagttaaccgtgtccttcgtccttacgtagttttcggacgtacggtacccaccccggctaaccgttggttacgtacctttcgggtccgggaaccggggtaacgggacccgtaaacggccgttacgggaccccgttaccggttaccgggtacctacggtcctaccggtaaccggg

SEQ ID NO: 94194 - DNA, 568 bp, Homo sapiens
  misc_feature: GYAE6OF02I0Q82.29.85.H08.1.454.CMB.1.raw
  modified_base (265)..(265): a, c, t, g, unknown or other
  misc_feature (265)..(265): n is a, c, g, or t
  modified_base (365)..(365): a, c, t, g, unknown or other
  misc_feature (365)..(365): n is a, c, g, or t
  modified_base (412)..(412): a, c, t, g, unknown or other
  misc_feature (412)..(412): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
  modified_base (473)..(473): a, c, t, g, unknown or other
  misc_feature (473)..(473): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcattctgccctgactcagcctcgctcagtgtccgggtctcctggacagtcagtcaccatctcctgcactggaaccagcagcgatgtcggtagtataacttgtctctgtaccaacaacnccgaggcgacggcccccgatctaataattatgatgtacagttaacgccgtcccgtcgacgggtccagactcgtcttctcgtgcctactagtcagacaacnctcgcctacctgacctatcgtcgtcggcctacgagtcgtagaacgtntaggacgttatactttactacgtnacgttncgtagtcgttacgaccgtacgccctaccgtntacgttacggtctacggttcggtaccgggaacgggaaccgacgtaacggtccgtacggtaccgtacgtacggtccaccggtacgaccggtcccgg

SEQ ID NO: 94195 - DNA, 550 bp, Homo sapiens
  misc_feature: GYAE6OF02GB731.29.85.H08.1.454.CMB.1.raw
  modified_base (295)..(295): a, c, t, g, unknown or other
  misc_feature (295)..(295): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttataactttgtctcctgtaccaacacaccaggcgacggcccccgatcataattangatgtcattaacgcgccctcgacggggtccctgactcgtcttctctcggctccgaagtctacggcaactctcgccctccctcgacctactctcgtcggtcctccgaggctcggacgagtcggacggtgtattattacgtgtctgtctctagtttcgcgacgccaccgcacgtgtcgtactccggtcgggcgggaacgggacccgtaaggtccgtacgtacccgttaccgtacggtacacggtccgtacgtaccgg

SEQ ID NO: 94196 - DNA, 554 bp, Homo sapiens
  misc_feature: GYAE6OF02GS65B.29.85.H08.1.454.CMB.1.raw
  modified_base (300)..(300): a, c, t, g, unknown or other
  misc_feature (300)..(300): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggcgacggcccccgatcattaattangatgtcattaagccggccctcgacggggtccctgactcgcttctctggctccaagtctggacaacactcgccctccctgacccatcctcgtcgggcctccgaggtctacggacgactggacggttgtaatttacttacgtgtctgtcttctatttcgcgtacggccacccgctacgtgtagacgttccgttacgggcggtaacggacctaaggcctacggacccgttcgtacggtccacgtccgtacgtaacgg

SEQ ID NO: 94197 - DNA, 438 bp, Homo sapiens
  misc_feature: GYAE6OF02IFJFH.29.85.H08.1.454.CMB.1.raw
  modified_base (228)..(228): a, c, t, g, unknown or other
  misc_feature (228)..(228): n is a, c, g, or t
  modified_base (291)..(291): a, c, t, g, unknown or other
  misc_feature (291)..(291): n is a, c, g, or t
  modified_base (427)..(438): a, c, t, g, unknown or other
  misc_feature (427)..(438): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacactgcctcctgaccatctntgggctccaggctgacgatgacggtgattattactgctgctcatttgcaggcacccgcactgngatcttcggcggagggaccaagctgaccgtctaggtcagctcgaaggctacggccccctcggtcctacctctccgttccccaccccttcccgtctacgtactcctatcgtgaggcgggctggcaaggcgacatagnnnnnnnnnnnn

SEQ ID NO: 94198 - DNA, 561 bp, Homo sapiens
  misc_feature: GYAE6OF02IEVNX.29.85.H08.1.454.CMB.1.raw
  modified_base (224)..(224): a, c, t, g, unknown or other
  misc_feature (224)..(224): n is a, c, g, or t
  modified_base (364)..(364): a, c, t, g, unknown or other
  misc_feature (364)..(364): n is a, c, g, or t
tcagatagagtactcacgaccggtgctcgatttagtatcactcagtcgcggggggggtctcaggagtcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttataactttgtctcctggtaccaacaacaccaggcgacggcccccgactcattaatttatgatgtctattaacgccggcctcgacggggtccctgactcgcttctctgctcagtctggcaacnctcgcctcctgacctatctcgtggcctccgagctgacgatggacgtgtacttattacgtgctgctacgttattcgcgtacggccaacccgctacgttcgtacgtagttccggttcgggaccgggtaacgggtaccgaacggtccgtaccgggtaccccgttaccgtagggtaccgaacggtccgtacgtaacccggg

SEQ ID NO: 94199 - DNA, 468 bp, Homo sapiens
  misc_feature: GYAE6OF02HTILI.29.85.H08.1.454.CMB.1.raw
  modified_base (213)..(213): a, c, t, g, unknown or other
  misc_feature (213)..(213): n is a, c, g, or t
  modified_base (317)..(317): a, c, t, g, unknown or other
  misc_feature (317)..(317): n is a, c, g, or t
  modified_base (332)..(332): a, c, t, g, unknown or other
  misc_feature (332)..(332): n is a, c, g, or t
  modified_base (396)..(396): a, c, t, g, unknown or other
  misc_feature (396)..(396): n is a, c, g, or t
  modified_base (454)..(468): a, c, t, g, unknown or other
  misc_feature (454)..(468): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggcctnaggggtccctgatcgcttctctggctccaagtctggcaacactgcctcctgaccatctcgtgggcctccaggctgacgatggacggtgattattactgctgctnattgcaggccaccgnactgtgatcgtcggcggaggaccaggctcgaccgtctaggtcagtctcaggctcgcccctgtcnctctcgtcccacctcctcacgtactctactcgtgacgcggctcggacaggcacagtgnnnnnnnnnnnnnnn

SEQ ID NO: 94200 - DNA, 554 bp, Homo sapiens
  misc_feature: GYAE6OF02I5CYI.29.85.H08.1.454.CMB.1.raw
  modified_base (224)..(224): a, c, t, g, unknown or other
  misc_feature (224)..(224): n is a, c, g, or t
  modified_base (302)..(302): a, c, t, g, unknown or other
  misc_feature (302)..(302): n is a, c, g, or t
  modified_base (394)..(394): a, c, t, g, unknown or other
  misc_feature (394)..(394): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttataactttgtctcctggtaccaacaacacccaggccgacggccccccgatcataatttangatgtcattaagccggccctcgaggggtccctgactcgcttctctggctcaagtctggcaacactgccctcctgaccatctcgtgggctccngctgacgatcggacggtgtattattacgtgtctgcttctagtttcgacgtacggcccacccgctacctgtacgtacgttccgttcggggcggtaacgggaccgaacggtccgtacggtacccggttaccgttacgggtcctacggtccttacggaaccgg

SEQ ID NO: 94201 - DNA, 149 bp, Homo sapiens; identical to SEQ ID NO: 93464
  misc_feature: GYAE6OF02FP0Q0.29.85.H08.1.454.CMB.1.raw

SEQ ID NO: 94202 - DNA, 504 bp, Homo sapiens
  misc_feature: GYAE6OF02ITTA8.29.85.H08.1.454.CMB.1.raw
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (388)..(388): a, c, t, g, unknown or other
  misc_feature (388)..(388): n is a, c, g, or t
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagccagcgatgtcggtggttataactttgtctcctggtaccaacaacacccaggcgaggcccctcgactcataatttatgatgtcattaagtggccctcaggggtcccngatcgcttcnctggctccaagtctggcaacactgctccctgaccatctctggctccnggctgacgatgacggtgattattctgctgctnatttgctagccacccgnacctgtgtatcgttcgggcggacgggtaccaagctagcccggttacctaggtcctacgcttaaccgg

SEQ ID NO: 94203 - DNA, 342 bp, Homo sapiens
  misc_feature: GYAE6OF02G23Z6.29.85.H08.1.454.CMB.1.raw
  modified_base (171)..(171): a, c, t, g, unknown or other
  misc_feature (171)..(171): n is a, c, g, or t
  modified_base (288)..(288): a, c, t, g, unknown or other
  misc_feature (288)..(288): n is a, c, g, or t
  modified_base (294)..(295): a, c, t, g, unknown or other
  misc_feature (294)..(295): n is a, c, g, or t
  modified_base (297)..(298): a, c, t, g, unknown or other
  misc_feature (297)..(298): n is a, c, g, or t
  modified_base (300)..(309): a, c, t, g, unknown or other
  misc_feature (300)..(309): n is a, c, g, or t
  modified_base (312)..(342): a, c, t, g, unknown or other
  misc_feature (312)..(342): n is a, c, g, or t
tcagatagagtactcacgaccggtgctcgatttagtatcactcagtcggcgggtccctgatccgcttctactggctccaagtctggcaacacctgcctccctcgaccatctcctgggctccaggctgacgatgacggtgattattactgctgctcatttgcaggcacccgnactgtgatcttcggcgagggaccaagctgaccgtctaggtccagctcaaggcctcgccccctcggtcactctgttcccacctcctcagtactctatctgagcgggctggcaaggccncatagnnanngnnnnnnnnnncannnnnnnnnnnnnnnnnnnnnnnnnnnnnnn

SEQ ID NO: 94204 - DNA, 545 bp, Homo sapiens
  misc_feature: GYAE6OF02I2KBW.29.85.H08.1.454.CMB.1.raw
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
  modified_base (449)..(449): a, c, t, g, unknown or other
  misc_feature (449)..(449): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaggtgtccagtgtgaagtgcagctggtggagtctgggggagtcgtggtacagcctggggggtccctgagactctcctgtgcagcctctggattcaagtttaatgtatttttccatacactgggtccgtcaagctccggggaaggtctggagtgggtctctcttataatcgagacggtgctactacattctatgcagactctgtgaagggccgattccaactntctccaganacaaacaacaacgtacctcccttgtactctgacaaatgaacngtacgtagaagaagtgacgacaggcgtcttctatttattagtgaacgaaaaggagaagcgaaggtactacgtaaggtcgggttacgtggtttacgg

SEQ ID NO: 94205 - DNA, 176 bp, Homo sapiens
  misc_feature: GYAE6OF02FGJZ6.29.85.H08.1.454.CMB.1.raw
  modified_base (153)..(176): a, c, t, g, unknown or other
  misc_feature (153)..(176): n is a, c, g, or t
tcagatagagtactcacgaccggtgctcgatttagtatcactcagtcgcgggacacgacgtggagattaaaccgaactgtggctgcaccatctgtcttcatcttcccgccatctgaatagcgtactctgagcgggctggcaaggcgcattagnnnnnnnnnnnnnnnnnnnnnnnn

SEQ ID NO: 94206 - DNA, 532 bp, Homo sapiens
  misc_feature: GYAE6OF02I7D6I.29.85.H08.1.454.CMB.1.raw
  modified_base (252)..(252): a, c, t, g, unknown or other
  misc_feature (252)..(252): n is a, c, g, or t
  modified_base (313)..(313): a, c, t, g, unknown or other
  misc_feature (313)..(313): n is a, c, g, or t
  modified_base (505)..(505): a, c, t, g, unknown or other
  misc_feature (505)..(505): n is a, c, g, or t
  modified_base (507)..(517): a, c, t, g, unknown or other
  misc_feature (507)..(517): n is a, c, g, or t
  modified_base (519)..(532): a, c, t, g, unknown or other
  misc_feature (519)..(532): n is a, c, g, or t
tcagatagagtactcacgaccggtgctcgatttagtatcactcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgccctccctgaccatctcngggctccaggctgacatgacggtgattattactgtctgcttcagtttgcaggccacccggnaccgtgtgtatcgttcgggcggagggaccaagcctacggacccgtccgtacggtcacgtctacgaacggcctaccgccccctaggtcctactccttcccgtttcccccacccgttcctaccgtacgttacctaccttactccgttaggacggtccgggacgttcgggaccgaacgggtccgacgtaatacgngnnnnnnnnnnncnnnnnnnnnnnnnn

SEQ ID NO: 94207 - DNA, 519 bp, Homo sapiens
  misc_feature: GYAE6OF02FMCZQ.29.85.H08.1.454.CMB.1.raw
  modified_base (224)..(224): a, c, t, g, unknown or other
  misc_feature (224)..(224): n is a, c, g, or t
  modified_base (296)..(296): a, c, t, g, unknown or other
  misc_feature (296)..(296): n is a, c, g, or t
  modified_base (413)..(413): a, c, t, g, unknown or other
  misc_feature (413)..(413): n is a, c, g, or t
  modified_base (456)..(456): a, c, t, g, unknown or other
  misc_feature (456)..(456): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataactttgtctctggtaccacaacacccagcgacggcccccgatcataatttangatgtcattaacgcggtccctcgaggggtccctgatcgcttctctggctccaagtctggccaacactcgccctccctgacctatcctcgtgggtctccgaggctgacgatgacggtnattatactgccttgccttctatttgcacggccacccgcactgngtatcgttcggcggacggaccaagtcctacggccgttacgtacggtccaggtcctacgaacgg

SEQ ID NO: 94208 - DNA, 152 bp, Homo sapiens; identical to SEQ ID NO: 93475
  misc_feature: GYAE6OF02FSWA8.29.85.H08.1.454.CMB.1.raw
  modified_base (150)..(152): a, c, t, g, unknown or other
  misc_feature (150)..(152): n is a, c, g, or t

SEQ ID NO: 94209 - DNA, 510 bp, Homo sapiens
  misc_feature: GYAE6OF02I6UYO.29.85.H08.1.454.CMB.1.raw
  modified_base (224)..(224): a, c, t, g, unknown or other
  misc_feature (224)..(224): n is a, c, g, or t
  modified_base (296)..(296): a, c, t, g, unknown or other
  misc_feature (296)..(296): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (442)..(442): a, c, t, g, unknown or other
  misc_feature (442)..(442): n is a, c, g, or t
  modified_base (499)..(499): a, c, t, g, unknown or other
  misc_feature (499)..(499): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataacttgtctcctggtaccaacaacaccaggcgacggcccccgatcataattangatgtcattaagcgcctcgacggggtcctgatcgcttctctgctcaagtctgacacnctcgcctccngacctatctcgtcgggcctccgagtcctgacgatcggacgtgtattacgttactgctgtctactgtttcgcgacggccnccgatacgtgtacgtgtcgtcgggcggacggaccagtcgtcgaccgtcgtacgtacncgtctcgacgg

SEQ ID NO: 94210 - DNA, 518 bp, Homo sapiens
  misc_feature: GYAE6OF02FT6FO.29.85.H08.1.454.CMB.1.raw
  modified_base (199)..(199): a, c, t, g, unknown or other
  misc_feature (199)..(199): n is a, c, g, or t
  modified_base (353)..(353): a, c, t, g, unknown or other
  misc_feature (353)..(353): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (515)..(518): a, c, t, g, unknown or other
  misc_feature (515)..(518): n is a, c, g, or t
tcagatagagtactcacgaccggtgctcgatttagtatcactcagtcgtgccctgactcagcctcgctcacgtgtccgggtctcctggacagtcagtcaccatctcctgcactgggaaccagcagcgatgtcggtggttataactttgtctcctggtaccaacaacacccgaggcgaggcccccccgatcataatttangatgtcattaagcggtcccttcaggggtccctgactcgcttctctggctccaagtctggcaacactgccctccctgaccctatctctgggctccaggctgacgatcggacggttggactttattactgctggcctcatttggcaggccacccgntactgtgactcttcggcggaggaccagctgaccgtctaggtcagctcgaaggctcgtccccctggtccacgttctcgttacccaccctcctccacgttcctctactcgtgacgcggtctacggacgaacggcgcgtagtagcngcagntcgtncntccgtcnnnn

SEQ ID NO: 94211 - DNA, 579 bp, Homo sapiens
  misc_feature: GYAE6OF02HI5YI.29.85.H08.1.454.CMB.1.raw
  modified_base (359)..(359): a, c, t, g, unknown or other
  misc_feature (359)..(359): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcgtgggttttcctgttgctattttaaaaggtgtccagtgtgaagtgcagctggtggagtctgggggagtcgtggtacagcctggggggtccctgagactctcctgtgcagcctctggattcaagtttaatgtatttttccatacactgggtccgtcaagcgtccggggaaggtctgggagtgggtctcttcttattaatcgagacggtnctactacattctatgcagactctgtaggaagggccgtattcacctatcctaccagagaacaaacaactaacgtacctcccttagtactctagacaaatgaacagtctagagtaagtgaacgacgacgtcggtcttcttagttattaggtacgtaacaaaaggtacgaaacgggtacgaagggtacttacgtaaagggttcgggttccggtaggtttacgg

SEQ ID NO: 94212 - DNA, 584 bp, Homo sapiens
  misc_feature: GYAE6OF02GTIQA.29.85.H08.1.454.CMB.1.raw
  modified_base (292)..(292): a, c, t, g, unknown or other
  misc_feature (292)..(292): n is a, c, g, or t
  modified_base (358)..(358): a, c, t, g, unknown or other
  misc_feature (358)..(358): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccagcagcgatgtcggtgttataacttgtctcctgtaccaacaacaccaggcgacgcccccgatcatattangatcgtcattaagcggccctcggacgggtccctgatccgtcttctctcggctctaagtctgacacnctcgccctcctacgacctactcctccgtcgggcctccgagcttacggaccgtagtacggtaccggtgtaactttacttacgtcgtcgtgtccttactagtttcgaccgtaccggcctacccggtctaaccgttgtactacgttccggttccggggcgggaaccgggtaccgaacggtccgtacggtacccgttacgtacggtaccgtacgtaccgtacgtaaccgg

SEQ ID NO: 94213 - DNA, 523 bp, Homo sapiens
  misc_feature: GYAE6OF02FRKAN.29.85.H08.1.454.CMB.1.raw
  modified_base (223)..(223): a, c, t, g, unknown or other
  misc_feature (223)..(223): n is a, c, g, or t
  modified_base (293)..(293): a, c, t, g, unknown or other
  misc_feature (293)..(293): n is a, c, g, or t
  modified_base (355)..(355): a, c, t, g, unknown or other
  misc_feature (355)..(355): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcgtgttatactttgtctctgtaccaacaacaccaggcgacggcccccgatcataatttangatgtcattaagcgtccctgacggggtccctgactcgcttctctcggctcaagtctgcaacnctcgccctcctgacctatctcgtggcctccgagctgacgatggacgtgtattactactgtctgctgtatttgctacggcctacccgctacgtgtgtacttccgttacgggcgggaacggaccctaaggtccgtacggacccgttcgtacggtcacgtctacgtaccgg

SEQ ID NO: 94214 - DNA, 578 bp, Homo sapiens
  misc_feature: GYAE6OF02I6LNE.29.85.H08.1.454.CMB.1.raw
  modified_base (216)..(216): a, c, t, g, unknown or other
  misc_feature (216)..(216): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (369)..(369): a, c, t, g, unknown or other
  misc_feature (369)..(369): n is a, c, g, or t
  modified_base (556)..(556): a, c, t, g, unknown or other
  misc_feature (556)..(556): n is a, c, g, or t
  modified_base (558)..(560): a, c, t, g, unknown or other
  misc_feature (558)..(560): n is a, c, g, or t
  modified_base (562)..(563): a, c, t, g, unknown or other
  misc_feature (562)..(563): n is a, c, g, or t
  modified_base (566)..(566): a, c, t, g, unknown or other
  misc_feature (566)..(566): n is a, c, g, or t
  modified_base (570)..(571): a, c, t, g, unknown or other
  misc_feature (570)..(571): n is a, c, g, or t
  modified_base (576)..(577): a, c, t, g, unknown or other
  misc_feature (576)..(577): n is a, c, g, or t
tcagatagagtactcacgaccggtgctcgatttagtatcactcagtctgccctgacgtcagcctcgctcgagtgtccgggtctcctggacacgtcaggtccaccagtctccctgcactggaacctagcacgccgatcgttccggtggttagtaaccttttcgtctcctggtaccaaacgaacacccaggtcgaggtcccccgactcattaatttcngactcgtctatttaacgccgccctggagggtccctgactccgcttcctcgtggcctcgagtctggcaacactcgcctcctgaccatctactcggctcgcgcnggcgntgacggtntattctctgctgctactagtttcgcgacggccacccgnaccgttggtcacgtttccggtcggacgggtacgggaccaggcctacggtaccgttcctacggtcctacgtccgtacgacggtcctccgtccccgttcggtcctaccttcgtcgtttccccgttccctccttactacgttacttctacgtctcgacggtccggtcctcggacgcgcgtcgtagtcggngnnngnncgnacgnntcgcnnc

SEQ ID NO: 94215 - DNA, 515 bp, Homo sapiens
  misc_feature: GYAE6OF02IDIDM.29.85.H08.1.454.CMB.1.raw
  modified_base (294)..(294): a, c, t, g, unknown or other
  misc_feature (294)..(294): n is a, c, g, or t
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (448)..(448): a, c, t, g, unknown or other
  misc_feature (448)..(448): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcgtgtatacttgtctctgtaccaacaacacccaggcgacggcccccgatcataactttancgatgtctattaacgcgccctcgacggggtcctgactcgcttcnctgctcagtctgcacnctcgcctccngacntctctggcctcgagctgacgtagtcgacgtgtatttacttacgtgctgtcttctatttcgcgacgccacccgcacgtgtntacgttcgtcgggcggtacggaccaagtcctacgtacccgtcgtaacggtcacgtcctacgtaacgg

SEQ ID NO: 94216 - DNA, 160 bp, Homo sapiens
  misc_feature: GYAE6OF02H2JGN.29.85.H08.1.454.CMB.1.raw
  modified_base (149)..(160): a, c, t, g, unknown or other
  misc_feature (149)..(160): n is a, c, g, or t
tcagatagagtactcacgaccggtgctcgatttagtatcactcagtcgcgggacacgactggagattaaacgaactgtggctgcaccatctgtcttcatcttcccgcatctgaatagcgtactctgagcgggctggcaaggcgcatagnnnnnnnnnnnn

SEQ ID NO: 94217 - DNA, 151 bp, Homo sapiens; identical to SEQ ID NO: 93409
  misc_feature: GYAE6OF02GGUM7.29.85.H08.1.454.CMB.1.raw
  modified_base (150)..(151): a, c, t, g, unknown or other
  misc_feature (150)..(151): n is a, c, g, or t

SEQ ID NO: 94218 - DNA, 555 bp, Homo sapiens
  misc_feature: GYAE6OF02JGEC3.29.85.H08.1.454.CMB.1.raw
  modified_base (194)..(194): a, c, t, g, unknown or other
  misc_feature (194)..(194): n is a, c, g, or t
  modified_base (213)..(213): a, c, t, g, unknown or other
  misc_feature (213)..(213): n is a, c, g, or t
  modified_base (317)..(317): a, c, t, g, unknown or other
  misc_feature (317)..(317): n is a, c, g, or t
  modified_base (535)..(535): a, c, t, g, unknown or other
  misc_feature (535)..(535): n is a, c, g, or t
  modified_base (544)..(546): a, c, t, g, unknown or other
  misc_feature (544)..(546): n is a, c, g, or t
  modified_base (548)..(551): a, c, t, g, unknown or other
  misc_feature (548)..(551): n is a, c, g, or t
  modified_base (553)..(555): a, c, t, g, unknown or other
  misc_feature (553)..(555): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgctcctggtaccaacacacccaggcgacggcccccgatcactaatttacngatgtcattaagcggcctnacggggtcctggatcgcttctctggctcagtctggcacactgcctcctgaccatctctggctccaggctgacgatcgacggtgattacttactgctggcctacncttttggcacggccaaccggtcaccgttgagtactcggttacggcgggacgggaccaaagtccgtacggaccgttccgtacggtctacgtccgtcgaacgggtctaccgcccccgtttcgggacctacccgttcgttcccggttccccgccgttcctaccgagttaccctctaacgttcctcggagtccgggtctggaccgtaaggcgtcacgtaggntcgctgacnnncnnnncnnn

SEQ ID NO: 94219 - DNA, 572 bp, Homo sapiens
  misc_feature: GYAE6OF02HNKDA.29.85.H08.1.454.CMB.1.raw
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcgtgttatacttgtctctgtaccaacaacaccaggcgacgcccccgatcataattatgatgtcattaacgcgtcctcgacggggtcctgactcgtcttctcgtgctccaagtctagacaacactcgcctccctgacctatctcgtcggcctcgagctgacgatcggacgtanattactacngtctgtctagtattcgacgtacggcctacccgtcgacttgtcgtacgttccggtttaccgggacgggtaacgggaacccgtaacggtacccgttaccggtaaccccggttaccggttaacgggttacccgaacggttacccgtacggtaaacccggg

SEQ ID NO: 94220 - DNA, 537 bp, Homo sapiens
  misc_feature: GYAE6OF02IOYFE.29.85.H08.1.454.CMB.1.raw
  modified_base (296)..(296): a, c, t, g, unknown or other
  misc_feature (296)..(296): n is a, c, g, or t
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatcctcctgcactggaaccagcagcgatggtcggtgttataacttgtctcctgtaccaacacaccagcgacgcccccgactcataattangatgtctaattaacgccggcctcgacggggtccctgactcgtcttctctcggctacaagtctggacaacactgccctccctcgacactctcgtcggcctcgagctgacgntggacgtanattactactgctgctntagtttcgcacggccaccgctacgtgtcgacgtcgttccgggcggaacggtaccaaggtccgtacggtaccgttccggtacgtccggacgaccgttacgaaccggg

SEQ ID NO: 94221 - DNA, 550 bp, Homo sapiens
  misc_feature: GYAE6OF02GUS0S.29.85.H08.1.454.CMB.1.raw
  modified_base (223)..(223): a, c, t, g, unknown or other
  misc_feature (223)..(223): n is a, c, g, or t
  modified_base (293)..(293): a, c, t, g, unknown or other
  misc_feature (293)..(293): n is a, c, g, or t
  modified_base (325)..(325): a, c, t, g, unknown or other
  misc_feature (325)..(325): n is a, c, g, or t
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtcgtccggtctcctggacagtcagtcaccatctcctgcactggaaccngcagcgatgtcggtgttatacttgtctctgtaccaacaacaccgagcgacggcccccgatcattaattangatgtacattaacgccgcctcgacggggtccngactcgtctctctgctcaagtctgcaactctcgtccctcctgaccctatcgtcgtcgggtctccgaggtcctagacgagtcggacggttntaagtttacttacgngtccttgcttactagtttcgcgacggtcccaccgtcaccgtgtcgacttccggtacgggaacggacgggtaccaaggtccttacggacccgttccgtagtaccgacgtcgacgtaaccgg

SEQ ID NO: 94222 - DNA, 150 bp, Homo sapiens
  misc_feature: GYAE6OF02GK9VI.29.85.H08.1.454.CMB.1.raw
  modified_base (149)..(150): a, c, t, g, unknown or other
  misc_feature (149)..(150): n is a, c, g, or t
tcagatagagtactcacgaccggtgctcgatttagtatcactcagtcgcgggacacgactggagataaacgaactgtggctgcaccatctgtcttcatcttcccgccatctgaatagcgtactctgagcgggctggcaaggcgcatagnn

SEQ ID NO: 94223 - DNA, 561 bp, Homo sapiens
  misc_feature: GYAE6OF02GMN1B.29.85.H08.1.454.CMB.1.raw
  modified_base (402)..(402): a, c, t, g, unknown or other
  misc_feature (402)..(402): n is a, c, g, or t
  modified_base (423)..(423): a, c, t, g, unknown or other
  misc_feature (423)..(423): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagccgtggggggtccctgagactctcctgtgcagcctctggattcaagtttaatgtattttcatacactgggtcctcaagctccggggaaggtctggagtgggtctctcttattaatcgagacggtgctactacattctatgcagtactctgtgacggcattcactatctcaganacaacaacaacgtacctcctntactctgactaaatcgaacgtagtactgaagaacgttgaacgaacaggcggtactttactatttataggtagaacgaaaaggaaggaaacggcgaagggtattaccgttaagggtcgggttaccgttaggtttaacgg

SEQ ID NO: 94224 - DNA, 689 bp, Homo sapiens
  misc_feature: GYAE6OF02H5JSZ.29.85.H08.1.454.CMB.1.raw
  modified_base (223)..(223): a, c, t, g, unknown or other
  misc_feature (223)..(223): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgtgtctcctggacagtcagtcacatctcctgcactggaaccngcagcgatgtcggtgttatacttgtctctgtaccaacaacaccaggcgacggccccccgatcattaattatgtatgtctaattaacgccggtcctcgtacggggtccctgtactcgtctttctcgtggtcctaccgtaagtcgtacggactaaaccgtaccgtcggtccccttacccgtacgtaaccctacgtttccgttcccggttcgggggtcccttcccgaacgggtcccgttacggaacgttaacgttcgggtaaccgggttagtaacgttttaacgtttaccgtcggtacttcggtaccttacgttaacgtttcggaccgtacggtcccaacccggtactacgttcggtacgtacgttcccgggttaccgggaccggggtaacgggtaacccgtaacgggtcccgttaaccgggtaccccggttacccgttaacgggtacctaccgggtccgttaaccggg

SEQ ID NO: 94225 - DNA, 588 bp, Homo sapiens
  misc_feature: GYAE6OF02GZLVB.29.85.H08.1.454.CMB.1.raw
  modified_base (300)..(300): a, c, t, g, unknown or other
  misc_feature (300)..(300): n is a, c, g, or t
  modified_base (365)..(365): a, c, t, g, unknown or other
  misc_feature (365)..(365): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatcctcctgcactggaaccagcagcgatggtcggtggttataactttgtctcctgtaccaacaacacccaggcgacggcccccgatcataattangatgtcattaagcggccctcgacggggtccctgctcgcttctctggctccaagtctggactaacnctcgccctcctgaccatctcgtcgggtcctccgaggctacggacgtagtcggtacggttgtaactttagttactcggtacttgtccttacgttagtttcgaccgtacggcccacccgctacgtgtcgtacgttccggttacggggaccggaacgggaccaaacggtccgttaccggtacccggttaccggttacgggtaccgacggtccgtaccgtaaccggg

SEQ ID NO: 94226 - DNA, 542 bp, Homo sapiens
  misc_feature: GYAE6OF02G6U3M.29.85.H08.1.454.CMB.1.raw
  modified_base (224)..(224): a, c, t, g, unknown or other
  misc_feature (224)..(224): n is a, c, g, or t
  modified_base (358)..(358): a, c, t, g, unknown or other
  misc_feature (358)..(358): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtggttatacttgtctctgtacaacacaccaggcgacggcccccatcattaattatgattcgtcattaagccggcctgacgggtccctgactcgtcttctctcggctacgacgtctgcaacnctcgccctccgtgaccatccgtcgtggcctcgagctgacgagtcggacgttgatttacgtactcgcttgcttctagtttcgcgtacggtccacccgctacgtgtcgtacttccggttcgggacgggtaccggaacgtagtccgtacgtacccgttcgtaggtaccacgttccgacgtaaccggg

SEQ ID NO: 94227 - DNA, 610 bp, Homo sapiens
  misc_feature: GYAE6OF02HWSY1.29.85.H08.1.454.CMB.1.raw
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
  modified_base (531)..(531): a, c, t, g, unknown or other
  misc_feature (531)..(531): n is a, c, g, or t
  modified_base (583)..(583): a, c, t, g, unknown or other
  misc_feature (583)..(583): n is a, c, g, or t
  modified_base (589)..(590): a, c, t, g, unknown or other
  misc_feature (589)..(590): n is a, c, g, or t
  modified_base (594)..(594): a, c, t, g, unknown or other
  misc_feature (594)..(594): n is a, c, g, or t
  modified_base (597)..(597): a, c, t, g, unknown or other
  misc_feature (597)..(597): n is a, c, g, or t
  modified_base (603)..(603): a, c, t, g, unknown or other
  misc_feature (603)..(603): n is a, c, g, or t
  modified_base (608)..(608): a, c, t, g, unknown or other
  misc_feature (608)..(608): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggccgaggccccccgatcataatttangatgtcattaagcggccctnacggggtccctgatcgcttctctgctccagtctggcaacntcgcctccctgaccatctcgtggctccagctgacgtagtcggacggtgtacttacgttacctagctgtcgtctagttcgacgtcggaccctaccggctaacgtcgtaggtcttaccggttcgggaccggggacggaacccgtaaggcccgtacggtacccgttccggtaacgggtccaccgtcgtaaccggacgtcgtccccgtccccgttacggtcctaccgttccgttcccgttcccgtcccgttacctccgtaacgttcctaccgtctaccgnggtacggtcggggtaccgtacggaccggaacggttcggacctagttaccggngtcacnntcgngcncgcgancgcgncg

SEQ ID NO: 94228 - DNA, 468 bp, Homo sapiens
  misc_feature: GYAE6OF02IYO3G.29.85.H08.1.454.CMB.1.raw
  modified_base (316)..(316): a, c, t, g, unknown or other
  misc_feature (316)..(316): n is a, c, g, or t
  modified_base (439)..(439): a, c, t, g, unknown or other
  misc_feature (439)..(439): n is a, c, g, or t
  modified_base (453)..(453): a, c, t, g, unknown or other
  misc_feature (453)..(453): n is a, c, g, or t
  modified_base (457)..(468): a, c, t, g, unknown or other
  misc_feature (457)..(468): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataattatgatgtcattaagcggccctcaggggtccctgatcgcttctctggctccaagtctggcaacactgcctccctgaccatctctgggctcaggctggacgatgacggtgattattactgctgctnatttgctaggcacccgcactgtgatcttcggcggaggaccaagcctgaccgtcctaggtcagctcaaggctcgccccctcggtccactcctcgttccccgccctccctcacgtctctatctgngcggctggcaggcnatgnnnnnnnnnnnn

SEQ ID NO: 94229 - DNA, 477 bp, Homo sapiens
  misc_feature: GYAE6OF02JBX99.29.85.H08.1.454.CMB.1.raw
  modified_base (465)..(477): a, c, t, g, unknown or other
  misc_feature (465)..(477): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggccaccgcactgtgatcgttcggcggaggaccaagctgaccgtccgtaggtcagcctcgaggctcgccccctcggtccacttctcgttcccgccctcctcacgtactctatctgacgtcggcgtggcgaaggcgacatgnnnnnnnnnnnnn

SEQ ID NO: 94230 - DNA, 564 bp, Homo sapiens
  misc_feature: GYAE6OF02H887Y.29.85.H08.1.454.CMB.1.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (322)..(322): a, c, t, g, unknown or other
  misc_feature (322)..(322): n is a, c, g, or t
tcagatagagtactcacgaccggtgctcgatttagtatcactcagtcgcggggggggtctcaggaggcagcgctctggggacgtctccaccatggcctgggctctgctcctcctcacctcctcactcagggcacaggctcttgggcccagtctgccctgattcagcctccctccgtgtccgggtctcctggacagtcagtcgccatctcctgcactggaaccngcagtgatgttgagaattangactgtctcccttgtaccaacaacacccagacacagtacccaacaaaaccacatagaataataacaatgtacaaatacnccggccctcgacgggtccctgacttcgtttctcgtggcctaccaagtcgtggacaatcggccggtccctccgatcgaccactctcgtgacctccgaggctggacggacgaggtccgtagtatttagttagtcgtcttgacctcaattaatagtaagctagttcgtacgtacgttagggtggttacggcgggacggaccaagtcgtacggtaccgtcgtacgggtcacggtcccgaggtcccg

SEQ ID NO: 94231 - DNA, 570 bp, Homo sapiens
  misc_feature: GYAE6OF02JR813.29.85.H08.1.454.CMB.1.raw
  modified_base (420)..(420): a, c, t, g, unknown or other
  misc_feature (420)..(420): n is a, c, g, or t
tcagatagagtactcacgaccggtgctcgatttagtatcactcagtcgcggggggtctcaggaggcagcactctcgggacgtctccaccatggcctgggctctgctcctcctcagcctcctcactcagggcacaggatcctgggctcagtctgccctgactcagcctcgctcagtcgtccggtctcctggacagtcagtcaccatcctcctgcactggaaccagcagcgatgtcgtggttataactttgtctcctggtaccaactaacacccaggccgacggccccccgatccacttaagttactgatgtacattaagcgcctcgaggggtcctgatcgcttctctgctcgagtctggcaacgactcgcctcccgtgaccactctcgtcggctccgagctgaccgtagtacgacggttanagttactttacgtgccgttcgcttaccgtagttttcgcgaacggtccaaccccggctaacgtcgtcgtacttcggtttaccggcggtaacggtaccgaaagtccgtcggacccggttccgtacggttcgaccgtacgtaccgtaaccggg

SEQ ID NO: 94232 - DNA, 152 bp, Homo sapiens
  misc_feature: GYAE6OF02GG17Q.29.85.H08.1.454.CMB.1.raw
  modified_base (149)..(152): a, c, t, g, unknown or other
  misc_feature (149)..(152): n is a, c, g, or t
tcagatagagtactcacgaccggtgctcgatttagtatcactcagtcgcgggacacgactggagattaaacgaactgtggctgcaccatctgtcttcatcttcccgcatctgaatagcgtactctgagcgggctggcaaggcgcatagnnnn

SEQ ID NO: 94233 - DNA, 556 bp, Homo sapiens
  misc_feature: GYAE6OF02IN0B5.29.85.H08.1.454.CMB.1.raw
  modified_base (289)..(289): a, c, t, g, unknown or other
  misc_feature (289)..(289): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgcggtgttatactttgctctgtaccaacacaccagcacggccccgactcataattangatgtcattaagcggcctgacggggtcctgatcgcttctctggctcaagtctagcaacactcgccctccgtcgaccactctcgtcgggcctccgacggctacggacgtagtggtacggtgttaacttagttaacgtgtcctcgtcttacgtagttttcgcgtacggccacccgcgtaccgtgtcgtattccgttaccgggcgggtaacgggaccaacggtcctacggtacccggttcgtacgggtacacggtaccgtacgtaaccgg

SEQ ID NO: 94234 - DNA, 567 bp, Homo sapiens
  misc_feature: GYAE6OF02IY63N.29.85.H08.1.454.CMB.1.raw
  modified_base (287)..(288): a, c, t, g, unknown or other
  misc_feature (287)..(288): n is a, c, g, or t
  modified_base (293)..(293): a, c, t, g, unknown or other
  misc_feature (293)..(293): n is a, c, g, or t
  modified_base (346)..(346): a, c, t, g, unknown or other
  misc_feature (346)..(346): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgtatacttgtctctgtacaacacaccaggcgacgcccccatcataattnnatgtnattacgcgcctcgacgggtcctgactcgtcttctctggctcgagtctgacacnctcgcctcctgaccatctcgtcgggcctccgaggtcctggacgtagtcggacgttgtaactttacttactgtacctgtccttacgttagtttcgaccgtacggtccctacccggctaacgttcgtcgtacgttccggttacgggaaccgggtacggaacccgtaacggtccgtaccggtacccgttccggtaacggccgtacggtcccgtaccggtaccgg

SEQ ID NO: 94235 - DNA, 526 bp, Homo sapiens
  misc_feature: GYAE6OF02HYC7G.29.85.H08.1.454.CMB.1.raw
  modified_base (379)..(379): a, c, t, g, unknown or other
  misc_feature (379)..(379): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagcctggggggtccctgagactctcctgtgcagcctctggattcaagtttaatgtatttttccatacactgggtcctcaagcgtccggggaaggtctggagtgggtctctcttattaatcgagacggtgctactacattctatgcagactcngtgaagggccattcacatctcagagacaacaacaagtacctcctgtatctgacaaatgaacagtcagagaagtgacgacagcggtcttctattatgagtacaaaaggagaaggcaggactacgtaaaggttcgggtcgcgtttacgg

SEQ ID NO: 94236 - DNA, 515 bp, Homo sapiens
  misc_feature: GYAE6OF02GF6LC.29.85.H08.1.454.CMB.1.raw
  modified_base (353)..(353): a, c, t, g, unknown or other
  misc_feature (353)..(353): n is a, c, g, or t
  modified_base (398)..(398): a, c, t, g, unknown or other
  misc_feature (398)..(398): n is a, c, g, or t
  modified_base (448)..(448): a, c, t, g, unknown or other
  misc_feature (448)..(448): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcatgtcggtggttataactttgtctctgtaccaacaacacccaggcgacgcccccgactcataattatgatgtcattaagcgccctcgagggtccctgatcgcttctctggctcagtctgcaacnctcgcctcccgtcgaccacgtctcgtcggtcctccgagctgacgngcgtacggtgtattacgttacgtgctgctactatttgcacggccacccgnactgtctacttcgtcgggcggaacggtccaagtctacgaccgttccgtaggtcacgcctcgaaccgg

SEQ ID NO: 94237 - DNA, 479 bp, Homo sapiens
  misc_feature: GYAE6OF02GHT51.29.85.H08.1.454.CMB.1.raw
  modified_base (207)..(207): a, c, t, g, unknown or other
  misc_feature (207)..(207): n is a, c, g, or t
  modified_base (269)..(269): a, c, t, g, unknown or other
  misc_feature (269)..(269): n is a, c, g, or t
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
  modified_base (345)..(345): a, c, t, g, unknown or other
  misc_feature (345)..(345): n is a, c, g, or t
  modified_base (421)..(421): a, c, t, g, unknown or other
  misc_feature (421)..(421): n is a, c, g, or t
  modified_base (457)..(457): a, c, t, g, unknown or other
  misc_feature (457)..(457): n is a, c, g, or t
  modified_base (462)..(463): a, c, t, g, unknown or other
  misc_feature (462)..(463): n is a, c, g, or t
  modified_base (465)..(467): a, c, t, g, unknown or other
  misc_feature (465)..(467): n is a, c, g, or t
  modified_base (469)..(469): a, c, t, g, unknown or other
  misc_feature (469)..(469): n is a, c, g, or t
  modified_base (471)..(472): a, c, t, g, unknown or other
  misc_feature (471)..(472): n is a, c, g, or t
  modified_base (474)..(478): a, c, t, g, unknown or other
  misc_feature (474)..(478): n is a, c, g, or t
tcagatagagtactcacgaccggtgctcgatttagtatcactcagtcgtggccctgactcagcctccgctcagtgtccgggtctccgtggacaggtcagtcaccatcttcctgcactggaaccagcagcgatgtccggtggttataactttgtctcctggtaccaacgtaaccaccctaggcgaggtccccccgagtcataatttangatgtcattaagcggcctgaggggtcccgtgatcgcttctcgtggcctccaagtctggcaanctgcctcctgaccatctctgggctccaggctagacgntggacggtnattatctgctgctcagttgcgaggcaccgntactgtgatcgtcggcgaggaccagcctagaccgtctagtcagctacgagtctcgcccctgtcacgtctcgtcccncctctactacgtactctatcagcgcgctcgcaggcnagtgnngnnncngnncnnnnnc

SEQ ID NO: 94238 - DNA, 575 bp, Homo sapiens
  misc_feature: GYAE6OF02I9FB7.29.85.H08.1.454.CMB.1.raw
  modified_base (362)..(362): a, c, t, g, unknown or other
  misc_feature (362)..(362): n is a, c, g, or t
  modified_base (522)..(522): a, c, t, g, unknown or other
  misc_feature (522)..(522): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctgggtggagtctggggggagtcgtggtacagccgtggggggtcccctggagactctcctgtgcagcctctggattcaagtttaatgtatttttccatacactgggtccgtcagcgtccggggaagggtctggagtgggtctcttcttattatcgagacggtnactactactattctatcgcagtcttctgtaggaacgggccgtattccacctactcctaccagacgaacaaacaaacacgtaccctcctagtatctagacaaatgaactagtctaggaagaaggtgaaccgagacgtcgtactttactagtttattggtanaacaaaggagaagacgaaggtactacgttaagggtcgggtcgtacgtttacgg

SEQ ID NO: 94239 - DNA, 643 bp, Homo sapiens
  misc_feature: GYAE6OF02H3WGN.29.85.H08.1.454.CMB.1.raw
  modified_base (224)..(224): a, c, t, g, unknown or other
  misc_feature (224)..(224): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccngcagcgatgtcggtgttatactttgtctcctgtaccaacaacaccaggacgaccgcccccgactacattaatttatgtatcgtcattaacgccggccctcgtacggggtccctgactcgcttctctgctcgagtcngacaacnctcgccctcctcgacctatccgtcgtcgggcctccgaggtctacggacgtagtacggtacggttagtaattttacgttaacgtcggtaccttcggtcctttaccgttaacgttttcgtaccggtaccggtacccgtaaccccgggtcttaaccgttcggttacgtacgtttccggtttaccgggggaccgggtaaacccggggtacctaaaccggtcccgtaccggttacccggttaccggtaccgggttaccgtacggtacctacggtaaccggg

SEQ ID NO: 94240 - DNA, 523 bp, Homo sapiens
  misc_feature: GYAE6OF02HL1NX.29.85.H08.1.454.CMB.1.raw
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (320)..(320): a, c, t, g, unknown or other
  misc_feature (320)..(320): n is a, c, g, or t
  modified_base (341)..(341): a, c, t, g, unknown or other
  misc_feature (341)..(341): n is a, c, g, or t
  modified_base (394)..(394): a, c, t, g, unknown or other
  misc_feature (394)..(394): n is a, c, g, or t
  modified_base (457)..(457): a, c, t, g, unknown or other
  misc_feature (457)..(457): n is a, c, g, or t
  modified_base (466)..(466): a, c, t, g, unknown or other
  misc_feature (466)..(466): n is a, c, g, or t
  modified_base (507)..(508): a, c, t, g, unknown or other
  misc_feature (507)..(508): n is a, c, g, or t
  modified_base (510)..(512): a, c, t, g, unknown or other
  misc_feature (510)..(512): n is a, c, g, or t
  modified_base (514)..(514): a, c, t, g, unknown or other
  misc_feature (514)..(514): n is a, c, g, or t
  modified_base (516)..(520): a, c, t, g, unknown or other
  misc_feature (516)..(520): n is a, c, g, or t
  modified_base (522)..(523): a, c, t, g, unknown or other
  misc_feature (522)..(523): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacaccaggcgacggcccccgatcataatttatgatgtcattaagcggcctcgaggggtccctgatcgcttctctggctcaagtctggcaacntcgcctcccctgacctatctcgtgggcctcgagctgacgntggacggtnacttatacngcngtcctntagtttcgctaggccacccgntacgtgtcgattcgtcggcggtaacggaccaagccgtcgaccgtcgtaaggtnacgctacgaaggctaccgcccgtgctacgtccttcgttccccaccttccgtacacttaccttntacttccgngacggtcggtccgtacggactagggacctgaacgttcgacnncnnngncnnnnncnn

SEQ ID NO: 94241 - DNA, 150 bp, Homo sapiens; identical to SEQ ID NO: 93401
  misc_feature: GYAE6OF02IGXHE.29.85.H08.1.454.CMB.1.raw
  modified_base (150)..(150): a, c, t, g, unknown or other
  misc_feature (150)..(150): n is a, c, g, or t

SEQ ID NO: 94242 - DNA, 559 bp, Homo sapiens
  misc_feature: GYAE6OF02FH6UG.29.85.H08.1.454.CMB.1.raw
  modified_base (302)..(302): a, c, t, g, unknown or other
  misc_feature (302)..(302): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccagcagcgatggtcggtggttataactttgtctcctggtaccaacaacaccaggccgacggccccccgatcataactttangtatgtacattaagcggccctcgacggggtcctgatccgcttctctggtctccagtctggcaacactcgccctccctcgaccatcgtccgtgggcctccgaggcctgacgatggacgtgtattatactgcttgctcgtactttgacgtacggtccacccgtcgaccttgttcgacttccgttccgggtaacgggacggaccgtaacggccgttacgacccgttaccgtacgggtaccacggtacctacggtacccgg

SEQ ID NO: 94243 - DNA, 731 bp, Homo sapiens
  misc_feature: GYAE6OF02JA4FN.29.85.H08.1.454.CMB.1.raw
tcagatagagtactcacgaccggtgctcgatttagtatcactcaggtcggcggggagctctgggagaggagccccagccctgagattcccaggtgttccattcggtgatcagcactgaacacagagaacgcaccatggagtttggactgagctgggtttccttgttgctatttaaaggtgtccagtgtgaagtgcagctggtggaggtcgtgggggagttcggtgggtacacggtccgtggggggtccctggacgacgtcctcctggtcgcacgcctcgtaggattacgtaagtttaatgtatttttccatacgacgttcgggtccgtacaacggtcgtccggggaaggtcgtgggacggtgggtcctcgttacttattaactcggtagacggtgtacgtacgtactactttctaatcggctaaggtacttcgtaggtaggtaacggggtcctaacgtcgtaaccgtactaccgttaccgaaacggaacgtaaactaaactaaaccgtaaacgttacccgtaccgttacgttaacttcgtaacgtaacgtaaactacggaaacgtaacgtttaacggacgtaaacggaaggttacgaaccgttaaccggaacgtccgggtactttaccgttacgttacgttaggtaaccgaacgtaaaaggtaacggtaaggtaacgaacgggtacgttaaccggttaaggggttacgggttacggttaccggtttaacgg

SEQ ID NO: 94244 - DNA, 655 bp, Homo sapiens
  misc_feature: GYAE6OF02IPHCW.29.85.H08.1.454.CMB.1.raw
  modified_base (307)..(307): a, c, t, g, unknown or other
  misc_feature (307)..(307): n is a, c, g, or t
  modified_base (341)..(341): a, c, t, g, unknown or other
  misc_feature (341)..(341): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagccgtggggggtccctgagactctcctgtgcagcctctggattcaagtttaatgtattttccatacactgggtccgtnaagcgtacgggggaagggtctggagtggtctctnttatatcgagacggtgactactacattctatgacagtactcgttggtacggaacgggtcccgtatttccgaacctaacgtccctacccgaaggtaacgaaacctaaacaaaccgtaaacgtacccttacccgtagttactacgtagaacaaatcgaaactagttaccgtaggaaacggtaaggttacggaaccgtaacgacggtacccggtctttaccgttagtttaacgtttggtaacgtaaaccgaaaaaggtacgggaagaccggaaggtaccttaggtaaagggttcgggttaccggtacgttttaacgg

SEQ ID NO: 94245 - DNA, 665 bp, Homo sapiens
  misc_feature: GYAE6OF02JUVKG.29.85.H08.1.454.CMB.1.raw
  modified_base (290)..(290): a, c, t, g, unknown or other
  misc_feature (290)..(290): n is a, c, g, or t
  modified_base (322)..(322): a, c, t, g, unknown or other
  misc_feature (322)..(322): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcacatctcctgcactcggaaccagccagcatgtcgtgttatacttgtctcgtgtaccaacaacaccaggcgacggccccgatcatattngtatgtcatacgcgtacctcgtacgggtcccngactcgtctactcgtcgtacctcgtacgtcttacggaccaacctactccgccctcctacgacctactcttcgtacgggtaccttccgacggtcgtacggtacgtaacgtccggtaccggttagttaacgtttaaccttacgttccggtaacgttaccgtcgtttaaccgttacgttttaccggaccttaacccgggtacccgtaaccccggtactaacccgggttagtaccgtaccggtttaaccggttcggggacccgggtaaccgggtaccgtaaccggtacgttacccggtacccgggtttccgtaccggtacgtacccgtaccggttagtaaccccggg

SEQ ID NO: 94246 - DNA, 601 bp, Homo sapiens
  misc_feature: GYAE6OF02FW9Z3.29.85.H08.1.454.CMB.1.raw
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
  modified_base (470)..(470): a, c, t, g, unknown or other
  misc_feature (470)..(470): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgcttattttaaaaggtgtccagtgtgaagtgcagctggtggagtcgtgggggagtcggtggtacagccgtggggggtccctgagactctccgtgtgcagcctctggattcaagtttaatgtatttttccattaccactgggtcccgtcgaagcgtaccggggaagggtcgtggtaggtgggtctcttcttattatcgagacggtgtcctactactattctatgcagactntgtgacggtcatcacntctcagagaacaacaacaacgtacctccttagtacttctacgtaacaaatacgaaacngttactaggaagtaagtagaaccgaacacggtcgtcttaccgttatttacgttaggtgaaacgtaaaaggaacggaaggtacgaagggtacttaaccggttaagggttacgggtaccggttggtttaacgg

SEQ ID NO: 94247 - DNA, 720 bp, Homo sapiens
  misc_feature: GYAE6OF02J2TJG.29.85.H08.1.454.CMB.1.raw
  modified_base (131)..(131): a, c, t, g, unknown or other
  misc_feature (131)..(131): n is a, c, g, or t
  modified_base (189)..(189): a, c, t, g, unknown or other
  misc_feature (189)..(189): n is a, c, g, or t
  modified_base (221)..(221): a, c, t, g, unknown or other
  misc_feature (221)..(221): n is a, c, g, or t
  modified_base (246)..(246): a, c, t, g, unknown or other
  misc_feature (246)..(246): n is a, c, g, or t
tcagatagagtactcacgaccggtgctcgatttagtatcactcagtcgcggggggtctcaggaggcagcgctctgggacgtctccaccatggcctgggctctgctcctcctcacctcctcactcaggcacngctctggcccagtctgccctgacttcacgcctccctccgtgtccggtctcctggaccngtccagtccgccatcctcctgcactggaaccngcagtcgatgttagacgtaatttangactgtctcccttgtaccaacaacaccagactacacgtaccacaaaccacaactgaactactaacaattacgaactaactacctaccggaccctacgtacggggtacccctacgacgtttccgtttaccttcctcggtacctaccgtaaacgttctacgggtacctaacgttcggtacccggccttcccgtacgttaccgaacccgtacttccgttaccgtaccgggtacccttacccgagggtcccttagggaaccgggaacggtacgggtcccgttagtacctttaagttaccggttcgtcgttcgtactccgttaaattaacgtaaccgttaagtactacggttacgttaccgtaacggttttaggggttacggtttaccgggaccggggttaaccgggacctaaccggttaccgtacggtacccggttccccggtaggtaccgaccggttaccccggtaacggtccccgg

SEQ ID NO: 94248 - DNA, 572 bp, Homo sapiens
  misc_feature: GYAE6OF02FFZGH.29.85.H08.1.454.CMB.1.raw
  modified_base (223)..(223): a, c, t, g, unknown or other
  misc_feature (223)..(223): n is a, c, g, or t
  modified_base (252)..(252): a, c, t, g, unknown or other
  misc_feature (252)..(252): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgtatactttgtctcngtaccaacaacacccaggcgacgcccccgatcataattatgatgtctattaagccggtccctcgacggggtccctgactcgcttctctcggcctccgaagtctggcaacactcgccctcctgaccctatcctcgtcgggtcctccgaggtcctgaccgagtcggacggtgtatttacttacgtgccgtgtccttactagttttcgacgtacgggcccacccgtctaccgttgtacgtacgttccgttaccgggaccgggtaacgggaccctaaggccgttacggaccccggttctaacggtccacggtctacgtaaccgg

SEQ ID NO: 94249 - DNA, 554 bp, Homo sapiens
  misc_feature: GYAE6OF02JTEDQ.29.85.H08.1.454.CMB.1.raw
  modified_base (184)..(184): a, c, t, g, unknown or other
  misc_feature (184)..(184): n is a, c, g, or t
  modified_base (266)..(266): a, c, t, g, unknown or other
  misc_feature (266)..(266): n is a, c, g, or t
  modified_base (285)..(285): a, c, t, g, unknown or other
  misc_feature (285)..(285): n is a, c, g, or t
tcagatagagtactcacgaccggtgctcgatttagtatcactcagtcgcgggggggtctcgaggaggcagcactctcgggacgtctccaccatggcctgggctctgctcctcctcagcctcctcactcagggcacaggatcctgggctcagtctgccctgactcagcctgctcagtgtccggtntcctaggacagtcagtcaccatctcctgacacgtggaaccagcagcgatgtcgtgtatacttgtctctggtaccacacaccngcaggccccatcatattangactgctattaagcgtcctcaggggtcctgatccgtctctctcggtctccgtaaagtcgtgacctaacgacctcgtccctacctcggacctacgtctccgtggccctccaggtctcgacactggacgtcgagttcttacgtcgctcgtctagtagtttcgacttgggacctacccgcgtaacttcgatcgtcctttcggggaccgggtaacggacctacggtccagggttacccgccgtaacggttccgagacccgtttcgaacccggg

SEQ ID NO: 94250 - DNA, 601 bp, Homo sapiens
  misc_feature: GYAE6OF02GOC9Y.29.85.H08.1.454.CMB.1.raw
  modified_base (224)..(224): a, c, t, g, unknown or other
  misc_feature (224)..(224): n is a, c, g, or t
  modified_base (290)..(290): a, c, t, g, unknown or other
  misc_feature (290)..(290): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttatacttgtctctgtaccaacacaccagcgacgcccccgatcataattangatgtctattaacgcgcctcgacggggtccctgactcgtcttctcgtggctcgaagtctggacaacactcgccctcctgacctactcctcgtcgggcctccgacggtcctcgaacgtacgtcggtacgggttgtactttacgttacgtgtacctcgtccttactagttttcgcgtacggtcccacccggtactaccgttcgtacgtacgttacccggttcggggaccgggtaacggaacccgtaagggtcccgttaccggtaccccggttaccgttaacgggtaccaacgggttccctacggtaacccggg

SEQ ID NO: 94251 - DNA, 635 bp, Homo sapiens
  misc_feature: GYAE6OF02I5FFG.29.85.H08.1.454.CMB.1.raw
  modified_base (381)..(381): a, c, t, g, unknown or other
  misc_feature (381)..(381): n is a, c, g, or t
tcagatagagtactcacgaccggtgctcgatttagtatcactcagtcgcgggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctgggtggagtcgtggggggagtcggtggtacaggccgtggggggtccctggagactctccgtgtgcagcctctggattcaagtttaatgtatttttccatacacgttcgggtcctacgaagtcgtaccggggaaggtctggaggtgggtctctcttattaatgagacggtgactacgtanacttctatgctagtactcgtggtaggaacgggcctattaccaacctatcctaccgagtacaaccaaacaaacgaacgtacctacccttagtacttctagactaaagtcgaaactagtctaggaagtaaggtactaacgacaggtaccggtctttacgttatttacgttaggtacgaaacgtaaaacggtaaggaaacggagtaacggtaacgttaggttaaagggttcgggttaccggttaccggttttaacgg

SEQ ID NO: 94252 - DNA, 711 bp, Homo sapiens
  misc_feature: GYAE6OF02I3FH5.29.85.H08.1.454.CMB.1.raw
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagccctcgctcagtcgtccgggtctcctggacagtcagtcaccatcctccngcactggaaccngcagcgatgtcggtggttattacttgtctctaggtaccaacaaccacccaggccgaccggccccccgataccgaattaactttagtagaattgtactaatttaacggccgtcccgtacgacggggtccctagacttccgtctttccgtcgtcggtccttacccgtaagttccgtacggacctaaaccgtaccgtccgtccccgtttacccctacgtaacccgtattccccgttaccgttcggggccctcccggtaacgggtccgtacggaaccgtacgtttaacgggacggttattaacgtttaaacgttcgttaccggtcttcgttccgtactttagtttacccgaccggttaaccgcccgtaaccccgtactacgttacggttagaccgtttccggttaccggggtacgggaccggtaaaccggacgtccggttaacccgtccggttacccggtagttaccacgggttacctacgttaaccgg

SEQ ID NO: 94253 - DNA, 150 bp, Homo sapiens; identical to SEQ ID NO: 93401
  misc_feature: GYAE6OF02H2HUI.29.85.H08.1.454.CMB.1.raw
  modified_base (150)..(150): a, c, t, g, unknown or other
  misc_feature (150)..(150): n is a, c, g, or t

SEQ ID NO: 94254 - DNA, 625 bp, Homo sapiens
  misc_feature: GYAE6OF02H99M5.29.85.H08.1.454.CMB.1.raw
  modified_base (224)..(224): a, c, t, g, unknown or other
  misc_feature (224)..(224): n is a, c, g, or t
  modified_base (301)..(301): a, c, t, g, unknown or other
  misc_feature (301)..(301): n is a, c, g, or t
  modified_base (362)..(362): a, c, t, g, unknown or other
  misc_feature (362)..(362): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatggtcggtggttataactttgtctctggtaccaacaacacccaggcgacggcccccgactcataatttangtatgtcattaagcgccctgacgggtcctgatcgcttctctggcctctaagtctgacaacnctcgcctccctgacctatcctcgtcgggccttccgaggtcctacggacgtagtacggaccggttagtatttaacgtttacgtggtaccttgtcccttacgtacgttttcgccgtaaccggggtccctaaccccggtctaaccgtttgtacgttacgttccggtttaccggggacccgggtaaacggggaccctaaacggtccgttaccgggtaccccggttaccgtaaccgggttaccgaacggttcccgtaccgtaaccggg

SEQ ID NO: 94255 - DNA, 529 bp, Homo sapiens
  misc_feature: GYAE6OF02GDGZS.29.85.H08.1.454.CMB.1.raw
  modified_base (267)..(267): a, c, t, g, unknown or other
  misc_feature (267)..(267): n is a, c, g, or t
  modified_base (290)..(290): a, c, t, g, unknown or other
  misc_feature (290)..(290): n is a, c, g, or t
  modified_base (352)..(352): a, c, t, g, unknown or other
  misc_feature (352)..(352): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcgtggttataacttgtctctgtaccacacaccngcgacgcccccgatcataattangatgtcattaagcgcctcgacggggtcctgactcgtcttctctcgctccaagtctggcaacnctcgcctccctagaccctatctcgtgggtcctccgacggctgacgagtcggacggtgtattacgttactcgtctgctctagttcgcacggccacccgctacgtgtacgtacgttcgtcgggcggtacgggaccagtccgtacgacccggttcgtacggcctacgtcctacgaaccgg

SEQ ID NO: 94256 - DNA, 594 bp, Homo sapiens
  misc_feature: GYAE6OF02I2SOV.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcacgggcacaggatcctgggctcagtctgccctgactcagcctcgctcagtgtccggtctcctggacagtcagtcacatctctgcacgtggaaccagcagtgacgttgtcgcttataaccgtgtctcctgtaccagcacgccccaggcacacgaccccaaactcatcgtattttcgacgtcagtactccgcctcgacgggtcctgactcgcttctcgtcggtaccaagtcgtgcacgcacgccctcctagtacttactctcgtggctcagacgtggacggaccgaggtcctacgtaacttacgttactcgactacgtcttacgaacttacgaaccgtaacggtaactaaacgtacttagtaccgtaccgttacggaacgtacgggtaaaccctaaacggttcccgaaccgttaccgtacggtacctaccggaaccccgtaaccggtacccctaacccgtactacccg

SEQ ID NO: 94257 - DNA, 682 bp, Homo sapiens
  misc_feature: GYAE6OF02ITG0C.29.85.H08.1.454.CMB.1.raw
  modified_base (584)..(584): a, c, t, g, unknown or other
  misc_feature (584)..(584): n is a, c, g, or t
  modified_base (627)..(627): a, c, t, g, unknown or other
  misc_feature (627)..(627): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagttggactgagcgttgggttttccttgttgtcttaattttaaaaggtgtccagtgtgaagtgcagctggtggagtcgtgggggagtcgtagggtacgacggtccggtggggggtccctggacgtaccgtccgtccgtgtggcacgtcctgtggattcgtaaagtttaattgttatttttccaattacgtacgttcgggttcccgtagtaacggtcccggtaccgggggaaaggttcgtagggtacggtcggggttacctcgttcgtttaattaacgtcgaggtacggtgtacctactactatttctaagtgactagtctgtaggtacggaacgggtctagttccactacgtcacgagacaaacaaacaaacgtaacgtaccttacgacgtttacttacaactaaagtcgaaacgtcgtacgtagaaagtaacgtacgaacgtaacncggtacgtacttagttaacttagtaggtaacgaactaaaaggnggaaaggcgaaggtaatcggttaaaggtcccgggtttagttacggtaggtaccgg

SEQ ID NO: 94258 - DNA, 658 bp, Homo sapiens
  misc_feature: GYAE6OF02IF483.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacgagccgtggggggtccctgagactcctcctgtgcagcctcgtggtattctaaagtttaatgtaatttttccaattactacgttgggtccgtacaaggtccgtacgggggaaggtcgtggagtcgggtctcttcttaattaagtcgagtcggtgaccttactactattctatcgctacgtacttcttggtagaacgggccgtattaccacctactcctaccgaagaacgaacaaacaaactaacgtacctcccttagtactcgtacaacaaatacgaaacgtagttcgtagaagtaagtacgaaaccgacgacggtccggtactttacgttatttacgtttggtaacgtaaaccgaaaagggtaacggtaaaggaccgtaggtaacgttacgtaaaggggtttcgggttaccggttacggttttaaccggg

SEQ ID NO: 94259 - DNA, 549 bp, Homo sapiens
  misc_feature: GYAE6OF02IT0P0.29.85.H08.1.454.CMB.1.raw
  modified_base (297)..(297): a, c, t, g, unknown or other
  misc_feature (297)..(297): n is a, c, g, or t
  modified_base (486)..(486): a, c, t, g, unknown or other
  misc_feature (486)..(486): n is a, c, g, or t
  modified_base (494)..(494): a, c, t, g, unknown or other
  misc_feature (494)..(494): n is a, c, g, or t
tcagatagagtactcacgaccggtgctcgatttagtatcactcagtcgcggggggggtctcaggaggcagcactctcgggacgtctccaccatggcctgggctctgctcctcctcagtccgtcctcactcagggcaccaggatcctgggctcagtctgccctgacctcagcctcgctcagtgtccggtctctggacagtcagtcaccatctcctgcactggaaccagccagcgtatggtcggtgttataacttgtctctgtaccaacacaccagcgacgcccccgatcattaattangatgtcattaacgcggccctcgtacggggtccctgtactccgtcttctccgtggcctaccgaagttctacggacaactactcgccctccctagaccctatcctcgtcgggcctccgaggtcgtacgacgtagtcggtaacggtgtaactttacgtactcgacttgtctctagttgactacggccaccgnacgtgtancgtcgtcgggacggacggacctagacgtcgaccggtctagcgtacgctacgacgg

SEQ ID NO: 94260 - DNA, 795 bp, Homo sapiens
  misc_feature: GYAE6OF02G9H3P.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgacctcgacgtcctcgctcgaggttcggtccggtcctccgtacgacgtcgtacacgtaccacctacttcctccgtcgacctacggtacggaaccacgacgacggacgtagtcggttcggttaggtttaactttacgtttcgtccttcgtacgtaaaccaaaccaacccgaccgacggaccggaccccggacccccgtactacgtaactttaagtttacgacgtacgttacgtactaagttaaccggcccggtacccgtacgggtacccgggtcctagtcgtccgttccttctcggtcgtaccctacgtacgtcgtacgaaccaaccgtacgtccgtccctccgtaccgaacctcgttccgtcgggttccgctaccggcgtccgtacggtaaccgtggtaccggttaacggttacttaacgttttacgttacgtacggccgtttacgtaccgtttaccgtttaggtttccgaaccgggtacccgttaccccgacccgtacgttaacggttgttaaccggtcttttacccgggggtacggggaacccggggtaaccggtaaccgtacccggttcggttacccggtaaccccggtttgggtaaccggttacccgaccggttaccgtaacccgtaccggg

SEQ ID NO: 94261 - DNA, 517 bp, Homo sapiens
  misc_feature: GYAE6OF02JC6EY.29.85.H08.1.454.CMB.1.raw
  modified_base (291)..(291): a, c, t, g, unknown or other
  misc_feature (291)..(291): n is a, c, g, or t
  modified_base (347)..(347): a, c, t, g, unknown or other
  misc_feature (347)..(347): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaccagcagcgatgtcggtgttatacttgtctctgtaccaacacaccaggcgacggcccccgatcataattangatgtcattagcgtccctgacgggtcctgactcgcttctctgctcagtctgcaacnctcgcctccctgaccatcctcgtcgggcctccgaggctaggacgactcggacggtgtactttatactgcttgctactatttcgctacggccacccgctacgtgtcgtacttccggtcgggcggacggacctaagtccgtacgtaccgtccgtaggtcacgtctacgacgg

SEQ ID NO: 94262 - DNA, 555 bp, Homo sapiens
  misc_feature: GYAE6OF02HAQYD.29.85.H08.1.454.CMB.1.raw
  modified_base (284)..(284): a, c, t, g, unknown or other
  misc_feature (284)..(284): n is a, c, g, or t
  modified_base (346)..(346): a, c, t, g, unknown or other
  misc_feature (346)..(346): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatggtcggtgtatacttgtctctgtacacacaccagcgacgccccatcatattngatgtcattacgcgtcctcgacgggtcctgactcgtcttctcgtcgctcagtctgaccaacnctcgcctcccgtgacctactctcgtcggcctccgagtctcgacgngtcggtacggtntacttacgttctcgtctcgtctcttagtttcgaccgacggcccaccgcgtacgttgtacgtacgttccggtccgggaacgggtaaccgggacctaaggtcccgtacggtaccccgttacggtacggttaccacggtccgtaccgtaaccggg

SEQ ID NO: 94263 - DNA, 664 bp, Homo sapiens
  misc_feature: GYAE6OF02J24SK.29.85.H08.1.454.CMB.1.raw
  modified_base (223)..(223): a, c, t, g, unknown or other
  misc_feature (223)..(223): n is a, c, g, or t
  modified_base (262)..(262): a, c, t, g, unknown or other
  misc_feature (262)..(262): n is a, c, g, or t
  modified_base (286)..(286): a, c, t, g, unknown or other
  misc_feature (286)..(286): n is a, c, g, or t
  modified_base (330)..(330): a, c, t, g, unknown or other
  misc_feature (330)..(330): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtccaccatctcctgcactggaaccngcagcgatgtcgtgtatacttgctctgtaccacacaccnggcgacgcccccgatcataattangatgtctattaacgcggccctcgacgggtcctgtactcgcttcncgtcggcctacaagtctacggcaacgactcgccctccctagacctactccgtcgtaccggggccttaccgaacgggtccgtacggaaccgtagttcgggaaaccggtttcgttaaacttttagtaacccgtttggaccgtttgtacccgttcgttaacgttttccggaccgttaaccgggtcccctaaccccggtaactccggttcggttacggttacccgttccgggtttacccggggaaccggggtacggtaacccgtaaccggtacccggttacggaacccccggtttacgtaaccgggtccctaaaccgggttctaccccgtaaccgggg

SEQ ID NO: 94264 - DNA, 540 bp, Homo sapiens
  misc_feature: GYAE6OF02I6RJU.29.85.H08.1.454.CMB.1.raw
  modified_base (216)..(216): a, c, t, g, unknown or other
  misc_feature (216)..(216): n is a, c, g, or t
  modified_base (256)..(256): a, c, t, g, unknown or other
  misc_feature (256)..(256): n is a, c, g, or t
  modified_base (303)..(303): a, c, t, g, unknown or other
  misc_feature (303)..(303): n is a, c, g, or t
  modified_base (318)..(318): a, c, t, g, unknown or other
  misc_feature (318)..(318): n is a, c, g, or t
  modified_base (439)..(439): a, c, t, g, unknown or other
  misc_feature (439)..(439): n is a, c, g, or t
  modified_base (520)..(520): a, c, t, g, unknown or other
  misc_feature (520)..(520): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (534)..(535): a, c, t, g, unknown or other
  misc_feature (534)..(535): n is a, c, g, or t
  modified_base (537)..(539): a, c, t, g, unknown or other
  misc_feature (537)..(539): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataacttttgtctcctggtaccaacaacacccaggcgaggccccccgactcataatttatgatgtcattaagcggccctnagggtccctgatcgcttctctggctccaagtctggcaacnctcgcctccctgaccatctctgggctccgaggctgacgatgacggtnattattctgctgctntatttgcaggccaccgcacgtgtgactcgttcggcggacgggaccaaggctcggaccgtccgtaggtacagtcctacgacgtctccgtccccgtcggtcctaccgttccttccgttccccncccttcctcctacgttaccttcctacttccgtacggacggccgggtacgtcgggacgaacgggccgtacgacgtagcgtcngacgncngcncncnncnnnc

SEQ ID NO: 94265 - DNA, 484 bp, Homo sapiens
  misc_feature: GYAE6OF02JCJUA.29.85.H08.1.454.CMB.1.raw
  modified_base (214)..(214): a, c, t, g, unknown or other
  misc_feature (214)..(214): n is a, c, g, or t
  modified_base (328)..(328): a, c, t, g, unknown or other
  misc_feature (328)..(328): n is a, c, g, or t
  modified_base (469)..(476): a, c, t, g, unknown or other
  misc_feature (469)..(476): n is a, c, g, or t
  modified_base (478)..(483): a, c, t, g, unknown or other
  misc_feature (478)..(483): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggccctnaggggtcctgatcgcttctctggctccaagtcctggcaacactgcctcctgaccatctctggctccaggctgacatgacggtgattattactgctgctcatttgcagcacccgnacgtgtgactcgttcggcgaggacctagctgaccgtctacggtcagtctacgagctcgcccgtcgtcacgtcgtcgttccccgcctcctacacgttactctactcgtcgacggtcggatcggacgaacgggctcagtacgnnnnnnnncnnnnnnc

SEQ ID NO: 94266 - DNA, 606 bp, Homo sapiens
  misc_feature: GYAE6OF02GGSA6.29.85.H08.1.454.CMB.1.raw
  modified_base (279)..(279): a, c, t, g, unknown or other
  misc_feature (279)..(279): n is a, c, g, or t
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggtttccttgttgctattttaaaggtgtccagtgtgaagtgcagctggtggagtcgtgggggagtcgtggtacagccgtggggggtccctgagactctcctgtgcagcctctggattcaagtttangtattttccatacactgggtcctcaagtcgtaccggggaggtctgggagtgggtctctcttataatcgagacgtgctactacatttctatgacagactgtgtgagggcctattccactntcctcaganacaaacaactaacgtacctcccgttagtacttacgtgaccgtaaatacgaaactgttactaggaaggtaaagtcgaaccgaacgtacggcccggttactttacttaattttacgttggtaacgtaaacgaaaacggtaaggaaccggtgaacgggtacttaccggttaaagggtcgggtttacggtcggttttaacggg

SEQ ID NO: 94267 - DNA, 500 bp, Homo sapiens
  misc_feature: GYAE6OF02GH01J.29.85.H08.1.454.CMB.1.raw
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
  modified_base (309)..(309): a, c, t, g, unknown or other
  misc_feature (309)..(309): n is a, c, g, or t
  modified_base (334)..(334): a, c, t, g, unknown or other
  misc_feature (334)..(334): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (494)..(495): a, c, t, g, unknown or other
  misc_feature (494)..(495): n is a, c, g, or t
  modified_base (498)..(500): a, c, t, g, unknown or other
  misc_feature (498)..(500): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggccctcgaggggtccctgatcgcttctctggctcaagtctggcaacnctgcctccngaccatcncgtgggctccaggctgacgatgacggtgatttatacngctgctgatttgctacggcacccgnaacgtgtcgattcgtcggcggaggacccaaggcctgacccgtcgtaggtcagtctgacgtctcgccctgcctacttctccgttcccgcctcctcacgttcctactacgtccgtgacggcggtcgtggcgaacgcgacagtancncgtncgtnagtncngnngcnnn

SEQ ID NO: 94268 - DNA, 607 bp, Homo sapiens
  misc_feature: GYAE6OF02IG60J.29.85.H08.1.454.CMB.1.raw
  modified_base (587)..(587): a, c, t, g, unknown or other
  misc_feature (587)..(587): n is a, c, g, or t
  modified_base (592)..(592): a, c, t, g, unknown or other
  misc_feature (592)..(592): n is a, c, g, or t
  modified_base (594)..(607): a, c, t, g, unknown or other
  misc_feature (594)..(607): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagtgacgttggtggttatgactatgtctcctggtatcaacaacaccccggcaaacgtccccaaactcctgatttatgacgtcgctacgcgaccctcgaggggtccctgatcgtcttttctggctccaagtctggcaacacggcctccctgaccgtctctgggctccaggctgacgatgaggctgacttattactgccttcctcattatgacgtaggaccaaacaaccttattttagtacggtttttcgggacgggtaacgggaacctaaaggtccgtacgtacccggtccctacgacgtccaagccttacgaacgggtcctacccggcccccgttcggtacctaacccgttccttaccggtttcccccaaccccttcccgttaccgtaacggttacccttaccgtaacttccggtacggtacgggtccggggtacctcgggtaccgaacggccgtactacgtaacgnatcgngnnnnnnnnnnnnnn

SEQ ID NO: 94269 - DNA, 645 bp, Homo sapiens
  misc_feature: GYAE6OF02GQ4XJ.29.85.H08.1.454.CMB.1.raw
  modified_base (371)..(371): a, c, t, g, unknown or other
  misc_feature (371)..(371): n is a, c, g, or t
  modified_base (419)..(419): a, c, t, g, unknown or other
  misc_feature (419)..(419): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagccgtgggggtccctgagactctcctgtcgcagcctctggattcaagtttaatgtatttttccatactactgggtcctcgaagtcgtaccgggggaaggtcgtgggtaggtgggtcctcgttcttattaagtcgagacggtnctactacattctatcgcagactctaggtgaagggtcattcaccatccncagagaacaacaaccaagtacctacctgtaactctagactaaatacgaacgagttactaggaacgtaaagttacgaacgtaaaccgacggtccgggtacttttaccgttagttttaacgtttagggtaccgtaaacgtaaaaacgggaaggtaaaccgggacggtaaaggtaacggtttaaccggttaaagggttcggggttacccgtttacgggttttaaccggg

SEQ ID NO: 94270 - DNA, 538 bp, Homo sapiens
  misc_feature: GYAE6OF02F54AW.29.85.H08.1.454.CMB.1.raw
  modified_base (397)..(397): a, c, t, g, unknown or other
  misc_feature (397)..(397): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagcctggggggtccctgagactctcctgtgcagcctctggattcaagtttaatgtatttttccatacactgggtccgtcaagctccggggaaggtctggagtgggtctctcttattaatcgagacggtgctactacatttctatgcagactctgtgagggccatcaccntctcagagacaaacaacaacgtactccctagtactctgactaaatgaactagtactagaagaagtgacgacaggcggtcttactattattggtgacaaaaggagaaggcaggtatacgtaaggtcgggtacgtgtttacgg

SEQ ID NO: 94271 - DNA, 209 bp, Homo sapiens
  misc_feature: GYAE6OF02HPBI1.29.85.H08.1.454.CMB.1.raw
  modified_base (129)..(129): a, c, t, g, unknown or other
  misc_feature (129)..(129): n is a, c, g, or t
  modified_base (156)..(209): a, c, t, g, unknown or other
  misc_feature (156)..(209): n is a, c, g, or t
tcagatagagtactcacgaccggtgctcgatttagtatcactcaggtcggcgggacacgactggagattaaacgaactggtcggctgcacccatctgtcttcatcttcccgccatctgaatgcgtactntgacgcgggctggcaaggccgcatagnnnnnnnnnnnnnnnnnnnnnnnnnnnnnnnnnnnnnnnnnnnnnnnnnnnnnn

SEQ ID NO: 94272 - DNA, 149 bp, Homo sapiens; identical to SEQ ID NO: 93464
  misc_feature: GYAE6OF02IYLB0.29.85.H08.1.454.CMB.1.raw

SEQ ID NO: 94273 - DNA, 586 bp, Homo sapiens
  misc_feature: GYAE6OF02I1XUH.29.85.H08.1.454.CMB.1.raw
  modified_base (197)..(197): a, c, t, g, unknown or other
  misc_feature (197)..(197): n is a, c, g, or t
  modified_base (305)..(305): a, c, t, g, unknown or other
  misc_feature (305)..(305): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (415)..(415): a, c, t, g, unknown or other
  misc_feature (415)..(415): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacngtcacgtcaccatcctcctgccactcggaaccagcagcgatgtcggttagttatacttcgtctctagaccaacaacaccgaggcgacggccccatctaattaatttanagactgtacattaagccggtacctcgtacgggtcctgactcgtcttcgtcgtgctacgagttcgcgacaactactcgcctccgtanacctnttacgcgttcgggctacgnggtacgtcggacgtagtcggaacgttgtaatttacgtacgtgtcgtgtactacttagttcgacacggtaccacccgcaacgttcgtactcgttacggtccgggaacggtcgggaaccaaggtcccgtaacggttccgttacggtaacggtcgaacggtcctacggaaccgg

SEQ ID NO: 94274 - DNA, 599 bp, Homo sapiens
  misc_feature: GYAE6OF02GQR55.29.85.H08.1.454.CMB.1.raw
  modified_base (223)..(223): a, c, t, g, unknown or other
  misc_feature (223)..(223): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatcctcctgcactgaaccngcagcgatggtcgtgttactactttgtctctagtaaccaacacacccgagccgacggcccccatcaattattatgatgtactagtacgccgtccctcgacgggtccctgactccgtcttctcgtcggacctacgtacgtcgtcgactaccactcgtccctccgtacgacctactcctacggtcggtccctaccgaggtccgtacgtaccgtagtacggtacggttagtaactttacttacgtcgtacttcgtacttcgttatttacggcgtaacggcccaccgtcgtaacgttcgtacgtacttcggtacggccgggtaacggtacctacggttacaccggtcccgttacgtcggacctacgtccgtacgacccgg

SEQ ID NO: 94275 - DNA, 468 bp, Homo sapiens
  misc_feature: GYAE6OF02IQYE7.29.85.H08.1.454.CMB.1.raw
  modified_base (214)..(214): a, c, t, g, unknown or other
  misc_feature (214)..(214): n is a, c, g, or t
  modified_base (333)..(333): a, c, t, g, unknown or other
  misc_feature (333)..(333): n is a, c, g, or t
  modified_base (431)..(431): a, c, t, g, unknown or other
  misc_feature (431)..(431): n is a, c, g, or t
  modified_base (455)..(468): a, c, t, g, unknown or other
  misc_feature (455)..(468): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttatgatgtcattaagcggccctnaggggtccctgatcgcttctctggctccagtctggcaacactgcctcctgaccatctctgggctccaggctgacgatggacggtgattattactgctgctcatttgctaggccacccgnactgtgatcgttcgggcggaggaccagctacgaccgtcctaggtcagctcgagctcgcccctcggtcactctcgtcccgcctcctcacgtctctatcngagcggctcggacaggcgcatagnnnnnnnnnnnnnn

SEQ ID NO: 94276 - DNA, 600 bp, Homo sapiens
  misc_feature: GYAE6OF02JYN6J.29.85.H08.1.454.CMB.1.raw
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (579)..(579): a, c, t, g, unknown or other
  misc_feature (579)..(579): n is a, c, g, or t
  modified_base (584)..(584): a, c, t, g, unknown or other
  misc_feature (584)..(584): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (595)..(595): a, c, t, g, unknown or other
  misc_feature (595)..(595): n is a, c, g, or t
  modified_base (597)..(598): a, c, t, g, unknown or other
  misc_feature (597)..(598): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgatccataatttatgatgtcattaacgcggccctcgaggggtccctagactcgcttctctggctaccaagtctggcaacactgcctcctgaccatcgtctgggctcgngctgacntcgacggtgattatctgtctgcttctattgcgacggccaccgctacgtgtgacttcgttcggggacggtaacgggacctaacggccgtacggtacccgtcgttacggtacacggtcctaacggtacggccgttacccggtccccggttaccggacccttaccgttccgttcccggttaccccctaccccgttcccgtacctacggtttaaccctgttaaccgtcgtacggtaccggtcgggtacgttacggacgaacggtccgcgtacgtcggcaacgtcgncgtcngcgtctntncncnncg

SEQ ID NO: 94277 - DNA, 570 bp, Homo sapiens
  misc_feature: GYAE6OF02JD83L.29.85.H08.1.454.CMB.1.raw
  modified_base (364)..(364): a, c, t, g, unknown or other
  misc_feature (364)..(364): n is a, c, g, or t
  modified_base (464)..(464): a, c, t, g, unknown or other
  misc_feature (464)..(464): n is a, c, g, or t
  modified_base (489)..(489): a, c, t, g, unknown or other
  misc_feature (489)..(489): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaggtgtccagtgtgaagtgcagctggtggagtctgggggagtcgtggtacagccgtggggggtccctggacgactctcctgtgcagcctctggattcaagttttaatgtatttttccatactactgggtccgtacaacgcgtccggggaaggtctgggagtgggtctcttcttataatcgagtcggtnctactacattctatgcagtctctgtgaagggtccattcaccatctccagacgaacaaacaacaacgtacctcccgtatacttctagaccaaatcgaaacngtctaggaacgtaagtcgaacgaanacggtccggtcttacttattagttggaagtaacaaaggagaacggacgaagtaactagtagggtcggttcggtgtttaacg

SEQ ID NO: 94278 - DNA, 573 bp, Homo sapiens
  misc_feature: GYAE6OF02IX2FX.29.85.H08.1.454.CMB.1.raw
  modified_base (223)..(223): a, c, t, g, unknown or other
  misc_feature (223)..(223): n is a, c, g, or t
  modified_base (287)..(287): a, c, t, g, unknown or other
  misc_feature (287)..(287): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccngcagcatgtcgtgtatacttgtctctgtaccaacaacaccagcgacgcccccgatcataattangatgtactagtaacgccgcctcgacggggtcctgactcgcttctcgtggctaccaagtctaggacaactacgtcgccctcccgtacgacctatctacgtcggcctcgagtctcgacgtatggacgtagttacttattacgtgacttcgtcgttacttactttcgcgtaacggtcccaaccggtactacgtgtacgtcgttaccgtcggggtaaccggtaaccggaactaacggtcgtaccgtacccggttacgtaaccggtaccgtaagtcccgtagtaacccggg

SEQ ID NO: 94279 - DNA, 581 bp, Homo sapiens
  misc_feature: GYAE6OF02F4PIH.29.85.H08.1.454.CMB.1.raw
  modified_base (223)..(223): a, c, t, g, unknown or other
  misc_feature (223)..(223): n is a, c, g, or t
  modified_base (307)..(307): a, c, t, g, unknown or other
  misc_feature (307)..(307): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtcggttataactttgtctccgtggtaccaacaacacccgaggccggacggcccccgactcctataatttangtatgtcattaagcggtccctacgacggggtcctgactcgcttctctgcctctaacgtctacggcaacacgtcgtcctccgtcgtaccactcctacgtcggcctccgagtacctgaccgagttcggacggtgtacttacttacgtcgtccttggtcctcgtaatttcgcgacggtccaacccgctagtcgtcgcgtttacgtcgggtacggtaccgggacctaacgtccggtacgtacccggtccgttacggtaccgacgtccgtacgtaccgg

SEQ ID NO: 94280 - DNA, 533 bp, Homo sapiens
  misc_feature: GYAE6OF02F18K5.29.85.H08.1.454.CMB.1.raw
  modified_base (224)..(224): a, c, t, g, unknown or other
  misc_feature (224)..(224): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttataacttgtctctgtaccacaacaccaggcgacgcccccgatcataattatgatgtcattacgcgccctcgacggggtcctgactcgcttctctggctcagtcgngcacnctcgcctccncgaccatcctcgtcgggcctccgagtccgtacgacgagtaggtacgtagtatttactactcgctgtcctatatttgacgtacggacccaccgtcgtacgtgtacgtactcggtcggacgggacggaccaacgtcgtacggtacccgtcgtacgtccacgtccgtacgtacgg

SEQ ID NO: 94281 - DNA, 658 bp, Homo sapiens
  misc_feature: GYAE6OF02IUWET.29.85.H08.1.454.CMB.1.raw
  modified_base (558)..(558): a, c, t, g, unknown or other
  misc_feature (558)..(558): n is a, c, g, or t
  modified_base (610)..(610): a, c, t, g, unknown or other
  misc_feature (610)..(610): n is a, c, g, or t
tcagatagagtactcacgaccggtgctcgatttagtatcactcagtcgcggggagctctgggagaggtagcccagccctgagagttcccaggtgtttccattcggtgatcagcactgaacacagagaacgcaccatggagtttggactgagctgggttttccttgttgctattttaaaggtgtccagtgtgaagtgcagctggtggagtcgtggggggagtcgtggtacagcctggggggtccctgagactctcctgtgcagcctctggattcgtaagtttaatgtatttttccatacacgtgggtccgtacaagccgtaccgggggaaggtctggggtagtggggtcttacgttcgtttaattaacgtcggtaaggtacggtaggtccttaactacctagttctactggacagtactcgtaggtcggaaagggcccgtattacccactacttcctacccgaagaacggaaaccaaactaaaccaacgtacccttccctaagttactctaacggtacctaaagtacgaacctagtctagtaagaacgtagaccgaacnggaccgttcttacgttatttacgttggtaacgactaaaaaggcgtaaacggngtaaggaacttaccggttaagggttaccggggttgtaccgtttaacgg

SEQ ID NO: 94282 - DNA, 620 bp, Homo sapiens
  misc_feature: GYAE6OF02JHXJB.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatcctctgcactggaaccagcagcgatgtcggtggttataacttgtctctgtaccaacacaccgagcgacgcccccgactacattaacttatgtaactggtacagttaacgccggtaccccgtgtacggggtccctaggactccgtcttccttcgtcggtcctccgaacgtcgtacggacaaacgtccgtcgcccttacccgtcgtaccctacgttcctcggttccggggtactacccgacggtcgttacgacgtagtcggacgttacggtaatttacttacgtgtccgttgtaccttctagtttcgaccgtacgtccacccgtcgtacgttgtgaccgttcgttcggaacgggtacgtaaccgacgtcgttaccggacccgttacgtacggttaccacggtacctcgtaaccgg

SEQ ID NO: 94283 - DNA, 606 bp, Homo sapiens
  misc_feature: GYAE6OF02FGETW.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggtttcctgttgctatttaaaggtgtccagtgtgaagtgcagctggtggagtcgtgggggagtcgtggtacagccgtggggggtccctgagactctcctgtgcagcctctggattcaagttttaatgtatttttccatacatcgggtccgtcaagctaccggggaaggtctggtaggtgggtctcgtcttattaatcgagtacggtgctactacatttcatgcagtactctgtgaagggcatcacatctccagagacaacaacaatacctcctagtactctagacaaaatcgaaactgtaccgtagtaagaaggttacgaacggaacaggtccggtactttacgtttaatttaccgttgggttaacgaacgtaaaaaggacgggtaaacggaccgtaagggtactttaaccggttaagggttccgggggttaccgttagggtttttaaccggg

SEQ ID NO: 94284 - DNA, 514 bp, Homo sapiens
  misc_feature: GYAE6OF02FHBXQ.29.85.H08.1.454.CMB.1.raw
  modified_base (257)..(257): a, c, t, g, unknown or other
  misc_feature (257)..(257): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
  modified_base (338)..(338): a, c, t, g, unknown or other
  misc_feature (338)..(338): n is a, c, g, or t
  modified_base (468)..(468): a, c, t, g, unknown or other
  misc_feature (468)..(468): n is a, c, g, or t
  modified_base (495)..(495): a, c, t, g, unknown or other
  misc_feature (495)..(495): n is a, c, g, or t
  modified_base (500)..(506): a, c, t, g, unknown or other
  misc_feature (500)..(506): n is a, c, g, or t
  modified_base (508)..(514): a, c, t, g, unknown or other
  misc_feature (508)..(514): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgactcataatttatgatgtcattaagcggccctcaggggtccctgactcgcttctctggctccagtctggcaacnctgcctcctgacccatctcgtgggctccaggctgaccgatgacggtnatttattacngctgctctattgcaggccacccgnacgtgtgtacttcgtcgggacggtagggaccagcctacgaccgtcctaggtcacgtcctacgacggcctccgtcccccgtcggcctaccgttcctccgttcccgtcccctcctcgtacgtctcgtactcngtacggcgggtcgtcggacgaggctanatagnnnnnnncnnnnnnn

SEQ ID NO: 94285 - DNA, 610 bp, Homo sapiens
  misc_feature: GYAE6OF02IVJR2.29.85.H08.1.454.CMB.1.raw
  modified_base (226)..(226): a, c, t, g, unknown or other
  misc_feature (226)..(226): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtccacatcctctgcacgtggaaccngcagcgatggtcggtggttatactttgtctcctggtaccaacaaccacccaggccgacggcccccgatacgataatttatgatgtctattaacgccggcctcgacggggtccctgactcgtactctcgtcgcctacagtcgtgcactactcgcctcctcgacctactcgtacgtcgggcctaccgacgtcgtacggacgtacgtaggtacggttagtactttacttacgtcgtactgtcccttatacgtttacgccggtagcccaaccgcttaacgttgtacgttacgttcggttaccgggacgggtaccggtaaccgtaacgtacggtacccggttacccgtaccggttacggtccgtaaccgttaccggtacgtaacccggg

SEQ ID NO: 94286 - DNA, 768 bp, Homo sapiens
  misc_feature: GYAE6OF02IXCAN.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggtttccttgttgctatttaaaggtgtccagtgtgtaagtgcagtctggtggtagtctgggggagttcgtgggttacaggtcctgggggggtccctggacgtaccgtcgtccctggttcgccgaggcccttcgtcggtattccaaggttttaatgtactttttaccattacgacttcgggtccgttacgtaacgtcgtaccggggaaagggttcctggggtacgtcggggtcttcgttcttaagttaacgtcgtaagtacggtagccgttactaacgtatttcgtaacgtgacgtagaacttcgtaaggttcgaacggggtcctaacgttcgtaacccgtaagttccgtacccgtaacggtagtaaaccgaaaaaccctaaccgttaaaacggtaccttaacccccggttgtttaaaccttcgttaaccaacgtaaaacgtagtaaaaccgtacgtaccgtaggtaagaaaggttcggaaacgttaccgaacggtaccggtacgtttacctagtttacgtttagggaaccgttaacaaaaagggaactaaaggggtaacctaacgggtaagttaccgttaagggtacccggggttaacggtcggttttaaaccgg

SEQ ID NO: 94287 - DNA, 566 bp, Homo sapiens
  misc_feature: GYAE6OF02GWRL0.29.85.H08.1.454.CMB.1.raw
  modified_base (194)..(194): a, c, t, g, unknown or other
  misc_feature (194)..(194): n is a, c, g, or t
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (473)..(473): a, c, t, g, unknown or other
  misc_feature (473)..(473): n is a, c, g, or t
  modified_base (553)..(557): a, c, t, g, unknown or other
  misc_feature (553)..(557): n is a, c, g, or t
  modified_base (559)..(566): a, c, t, g, unknown or other
  misc_feature (559)..(566): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttangatgtcattaagcggccctnaggggtccctgatcgcttctctggctccagtctggcaacnctgccctccctgaccatctctgggcctccgaggctggacgtatcggacggtgaatttactacgtgctgcttcatttgccaggccaccgcacgtgtcgattccgttcgggacggacgggaccaaggtccgtacgtacccggttccgtacgggtcctacgccgtacgaacgggtctcccgtcccccgttcggtaccctaccgttccgtcccgtttcccccncccgttcctaccgtaacgttaccgttctacttccgtgaccggtccggtcgacggaccgtaggaccgtcgactcggatcgnnnnngnnnnnnnn

SEQ ID NO: 94288 - DNA, 601 bp, Homo sapiens
  misc_feature: GYAE6OF02HDBZT.29.85.H08.1.454.CMB.1.raw
  modified_base (223)..(223): a, c, t, g, unknown or other
  misc_feature (223)..(223): n is a, c, g, or t
  modified_base (297)..(297): a, c, t, g, unknown or other
  misc_feature (297)..(297): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccngcagcgatgtcggtgttatactttgtctcgtgtaccaacaacaccaggcgaccggcccccgatcaattaattangtactgtactaagttaacgccgcctcgacgggtccctagactcgcttctctcggtctaccgaagtcgtgacaactactcgcctccctagacctatccgtcgtcggcctccgaggtctacggacgtagtcggaacggttactaatttacttacgtgtccttggtccttagtagtttccgcgtaaccggccctacccggtctaaccgttggtacgtacgttccggttaccgggacgggtaaccgggaaccaacggtaccgtacggtacccgttaccgtacggtacgacggttacgaccgtaaccgg

SEQ ID NO: 94289 - DNA, 607 bp, Homo sapiens
  misc_feature: GYAE6OF02HCOJ5.29.85.H08.1.454.CMB.1.raw
  modified_base (271)..(271): a, c, t, g, unknown or other
  misc_feature (271)..(271): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacgaggatcctgggctcagtctgccctgactcagcctcgctcagtcgtccggtctccgtggacagtcagtcaccatctcctgcactggaaccagcagcgatggtcggtggttatacttgtctctgtaccaacacaccnggcgacgcccccgatcattaattatgatgtcattaacgcgcctcgacggggtcctgactcgtcttctcgtcggtcctccgaagtctgacaacctactcgtccctccctgacctattcctcgtcggtcctcgaggcctagacgtacgtacggtacggtagttaacttagttcgtctcggtccttacggtccttacgttacgtttcggaccgtaccgggaccctaaccccggtctacgttcgtacggtccgtttacgggtccggggaccggtaacggggaccctaacggtccgttaccggaccccggttcgtaacgggtcctacggtcccgtaaccgg

SEQ ID NO: 94290 - DNA, 625 bp, Homo sapiens
  misc_feature: GYAE6OF02HBL34.29.85.H08.1.454.CMB.1.raw
  modified_base (390)..(390): a, c, t, g, unknown or other
  misc_feature (390)..(390): n is a, c, g, or t
  modified_base (409)..(409): a, c, t, g, unknown or other
  misc_feature (409)..(409): n is a, c, g, or t
  modified_base (428)..(428): a, c, t, g, unknown or other
  misc_feature (428)..(428): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatcctcctgcacgtggaaccagcagcgagtgtacggtggttattaactttgtctcctaggtaccaacaaccacccgaggccgaccggcccccgactacattaatttatagatgtactaagttaacggccgtaccctcggacggggtccctgactcgtcttctctcgctacagtctacggacaacnctcgccctccgtcgacctntccgtcgtcggtcctccgngctgacgtagtcggtacgtagtaacttattacgtgtcttcgtctttacgtctttacggacgtaccggaccctacccggactaccgtagttcgacgttccggttacggggaccgggtaaccgggaaccctaggtccgttaaccgtaccccgggtttaccgtaccggttaaccgaccgttaccggtacccgtaaccggg

SEQ ID NO: 94291 - DNA, 661 bp, Homo sapiens
  misc_feature: GYAE6OF02GAV5J.29.85.H08.1.454.CMB.1.raw
  modified_base (254)..(254): a, c, t, g, unknown or other
  misc_feature (254)..(254): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcgagtctcgcctgactcgacgccctcgctcgtagttcggtcccgggttctccgtggactacgtcacgtccacctacttcctccgtcgacctacggtacggaaaccngacgagacgagttcggtcggttagttaattacgtttgtccttccgtacggtaaccaacaaccgaccgaggaccgaccggcccccgatactaattaacttagtcgtagtcgtactaacgttacgccgtcctcggtacggtcctgactcgtctctcgcgtactacgtacgtcgacggaaccacgtacgtccgtaccctcgtcgacctcttacgtcgcggtcctcgcggtctagacgtagtacggtaccgtattacttaacgttcgcgttcgtctacgttacgttagttcgacgaccgtacccgaccgttcgaacgttggtaccttccgttcggttaccgggaacgggtacgaacccgtcgtaccgtccggtaccggttacgtccggtacgaccgtaccgaggtacccgg

SEQ ID NO: 94292 - DNA, 150 bp, Homo sapiens; identical to SEQ ID NO: 93401
  misc_feature: GYAE6OF02HM64B.29.85.H08.1.454.CMB.1.raw
  modified_base (150)..(150): a, c, t, g, unknown or other
  misc_feature (150)..(150): n is a, c, g, or t

SEQ ID NO: 94293 - DNA, 607 bp, Homo sapiens
  misc_feature: GYAE6OF02IVST0.29.85.H08.1.454.CMB.1.raw
  modified_base (222)..(222): a, c, t, g, unknown or other
  misc_feature (222)..(222): n is a, c, g, or t
  modified_base (282)..(282): a, c, t, g, unknown or other
  misc_feature (282)..(282): n is a, c, g, or t
  modified_base (346)..(346): a, c, t, g, unknown or other
  misc_feature (346)..(346): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcacatctctgcactggaaccngcagcgatgtcgtgtatacttgctctgacaacacaccaggcgacgccccgatcatattangatgtacataacgcgtcctcgacgggtcctgactcgcttctcgtcgctacaagtcgtcgcaacnctcgccctccgtgaccatcctcgtcggtcctcgacgtctaggaccgagtcggacgtagtaacttattactgtactgtcttacgtacgttttcgacgtacggtcccgtaacccgtacgttacgttacggttacgtaccgtttcccggtttaccggggccggggttaaccgggaacccgtaaacggtacccggttaccgggttaaccccggttaccggtttaaccgggtaaccgtaaccggttaccgttaaccgtaacccggg

SEQ ID NO: 94294 - DNA, 561 bp, Homo sapiens
  misc_feature: GYAE6OF02F4UA7.29.85.H08.1.454.CMB.1.raw
  modified_base (287)..(287): a, c, t, g, unknown or other
  misc_feature (287)..(287): n is a, c, g, or t
  modified_base (418)..(418): a, c, t, g, unknown or other
  misc_feature (418)..(418): n is a, c, g, or t
  modified_base (466)..(466): a, c, t, g, unknown or other
  misc_feature (466)..(466): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcacatctcctgcactggaaccagcagcgatgtcggtgtatacgttgtctctgtaccacaacaccagcgacgccccgatcatattngatgtcattagcgtcctcggacggtcctgacgtctctctcgtcgtcctacacgtcgcgactaacctcgtcctccctccgtacacctctccgtcgtcggccttcgacgtcgtacgacgtagtcggtacggtnttaacgtttacttacgtcgtcgtctctattacgttgcgacgtccaccncgtcgtagttcgtacgttccggttacgggacggtacggtaacccgaggtaccgtaccggtacccgttcggtacgctaaccgtcgtaccgtaccgg

SEQ ID NO: 94295 - DNA, 565 bp, Homo sapiens
  misc_feature: GYAE6OF02HRFUI.29.85.H08.1.454.CMB.1.raw
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (430)..(430): a, c, t, g, unknown or other
  misc_feature (430)..(430): n is a, c, g, or t
  modified_base (445)..(445): a, c, t, g, unknown or other
  misc_feature (445)..(445): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcggtggtacagccgtggggggtccctgagactctcctgtgcagcctctggtattctaaagtttaatgtatttttccattactactgggtcctcaagcgtccggggaaggtctggagtgggtctctntattancgagcggtnctactacattctatgcagtctctgngaaggcatcacntctcaganacaacacaacgtacctcctgtacnctagactaaagcaanaggttacaggagaagtgacgacgaggccgtactttattagtttattaggtggaaaccaaaaggtaggaacggaccgtaaggtacttaggttaacgggtcgggttacgttcggtttaacgg

SEQ ID NO: 94296 - DNA, 591 bp, Homo sapiens
  misc_feature: GYAE6OF02FZL6K.29.85.H08.1.454.CMB.1.raw
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatggtcggtgttatactttgtctcgtgtaccaacaacacccaggcgaccgcccccgatcataattatgatgtacattaacgccgtccctcgtacggggtcctgactcgcttctctgcctcagtcngacaacnctcnccctcctgacctntcctcgtcggtcctccgnggtcctacggacgtagtcggtacggtataacgtttacttaccgtgtacttcgtctacttagttcggacgaccggtacccacccgtctaacgttgtcgtacgttccggttacggggtaacgggaccggtaacccgaacggtccgtacccggtacccgttaccgtaccggtaccacggttccgtaacgtacccggg

SEQ ID NO: 94297 - DNA, 150 bp, Homo sapiens; identical to SEQ ID NO: 93401
  misc_feature: GYAE6OF02IO4EL.29.85.H08.1.454.CMB.1.raw
  modified_base (150)..(150): a, c, t, g, unknown or other
  misc_feature (150)..(150): n is a, c, g, or t

SEQ ID NO: 94298 - DNA, 537 bp, Homo sapiens
  misc_feature: GYAE6OF02GKNTV.29.85.H08.1.454.CMB.1.raw
  modified_base (297)..(297): a, c, t, g, unknown or other
  misc_feature (297)..(297): n is a, c, g, or t
  modified_base (357)..(357): a, c, t, g, unknown or other
  misc_feature (357)..(357): n is a, c, g, or t
  modified_base (411)..(411): a, c, t, g, unknown or other
  misc_feature (411)..(411): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtgttatactttgtctcctgtaccaacaacacccaggcgacggcccccgatcataatttangatgtcattaagcgccctcgaggggtccctgactcgcttctctggctcaagtctgcaacnctcgccctccctgaccatcctcgtcgggcctccgaggcctgacgatggacggtnatttattactgctgctctagtttcgacgacggccacccgctaccgttgtcgtacgttccgttcgggcgggtaacgggaccaacggtcctacggacccgttccgtaggtccaggtcctacgtaacgg

SEQ ID NO: 94299 - DNA, 215 bp, Homo sapiens
  misc_feature: GYAE6OF02IOO6A.29.85.H08.1.454.CMB.1.raw
  modified_base (154)..(215): a, c, t, g, unknown or other
  misc_feature (154)..(215): n is a, c, g, or t
tcagatagagtactcacgaccggtgctcgatttagtatcactcagtcggcgggacacgactggagattaaacgaactgtggctgcaccatctgtcttcatcttcccgccatcgtgaatgcgtactctgagcgggctggcaaagggctcatagcnnnnnnnnnnnnnnnnnnnnnnnnnnnnnnnnnnnnnnnnnnnnnnnnnnnnnnnnnnnnnn

SEQ ID NO: 94300 - DNA, 626 bp, Homo sapiens
  misc_feature: GYAE6OF02GF1EU.29.85.H08.1.454.CMB.1.raw
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggactcctgggctcagtctgccctgactcagcctcgctcagtgtcccggtctcctggacngtcagtccaccatctcctgcacgtggaaccngcagcgatcgtggtgttatacttgtctcgtacgtaccaacaccaccgaggccgaccgccccgatccaattaattatgtactgtactaagttaacggccgtacccgtcggaccggggttcctagactccgtcttctcgtcgcctaccgaagtcgtcgaccaacgtacctcgtccctcccgtagaccctacgtccgttcgtcggtacctcgacgtcgtacggaccgtgacggttacgtacgttactttacgttaccgtgtccttcgtcctacgttcttcggccgtacggccaaccgtctacgtcgttcgtaccgttacggttccgggaaccggaacggaccgtaacggtccgtaaccggtaccggttccggtaccggttccgacgtcgtaaccggtaccgg

SEQ ID NO: 94301 - DNA, 722 bp, Homo sapiens
  misc_feature: GYAE6OF02HWOKJ.29.85.H08.1.454.CMB.1.raw
  modified_base (194)..(194): a, c, t, g, unknown or other
  misc_feature (194)..(194): n is a, c, g, or t
  modified_base (231)..(231): a, c, t, g, unknown or other
  misc_feature (231)..(231): n is a, c, g, or t
  modified_base (305)..(305): a, c, t, g, unknown or other
  misc_feature (305)..(305): n is a, c, g, or t
  modified_base (351)..(351): a, c, t, g, unknown or other
  misc_feature (351)..(351): n is a, c, g, or t
  modified_base (687)..(687): a, c, t, g, unknown or other
  misc_feature (687)..(687): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgatcataattangatgtcattaagcgcctgacgggtcctgatcgcttcnctggctccaagtctggacaacacgtcgccctccctgaccatctcgtgggcctccaggcctgacgatggacggtnaattacttaacgtgctgccttcgtatttgcgtacggcctacccggntacgttgtagacgttcggttaccgggaggtaacgaacgggaaccctaaggtccgtaacggtacccggttaccgttaacgggtaaccacggtaccgttacggtaaaaccgggtccgttacccgggtacccccccgtttaccgggtacccgttaacccgttttaccccgttacccgtttaccccccgtacccccgtttccccgttaacccgttaaaccggtttaaccctttacccgttaaccgtttaccgttaacggggtaaccggggtaccccggggtacgttacccgggaaaccgtaaccggggtacccgtacgtaacggtacgtaacgcgtaccncgtacgacgacgtacgcgtacgtacgtcgtagtac

SEQ ID NO: 94302 - DNA, 618 bp, Homo sapiens
  misc_feature: GYAE6OF02GDRYE.29.85.H08.1.454.CMB.1.raw
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
  modified_base (295)..(295): a, c, t, g, unknown or other
  misc_feature (295)..(295): n is a, c, g, or t
  modified_base (327)..(327): a, c, t, g, unknown or other
  misc_feature (327)..(327): n is a, c, g, or t
  modified_base (360)..(360): a, c, t, g, unknown or other
  misc_feature (360)..(360): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccggtctccgtggacagtcagtccacatctctgcactggaaccngcagcgatggtcggtagtatacttgtctcncggtaacaacaactacgaggcgacgccccatcattacttangatcgtactagtacgcgcctcggacgggtccngtactccgtctccgtcgtcgcctacgtagttcncggtacaaaccgtaccgtcgtaccctccgacgtacctactccgttacggtccggtccttacccgacggtaccttcggtaaccggtagttaccggtacgtagttaacgttacgttacgcgttccgtacgtcgttacgtacgtttcgacgttaccggccctaccgcgtacgttcgtagttacgttcggtccggtaacgggacgtaacccggtactaccggtacgacccggttcggacgtctacggccgtacggtaaccgg

SEQ ID NO: 94303 - DNA, 606 bp, Homo sapiens
  misc_feature: GYAE6OF02H00C6.29.85.H08.1.454.CMB.1.raw
  modified_base (126)..(126): a, c, t, g, unknown or other
  misc_feature (126)..(126): n is a, c, g, or t
  modified_base (256)..(256): a, c, t, g, unknown or other
  misc_feature (256)..(256): n is a, c, g, or t
  modified_base (347)..(347): a, c, t, g, unknown or other
  misc_feature (347)..(347): n is a, c, g, or t
  modified_base (593)..(606): a, c, t, g, unknown or other
  misc_feature (593)..(606): n is a, c, g, or t
tcagatagagtactcacgaccggtgctcgatttagtatcactcaggtcctgccctgacctcagccttcgctcgagtgtccgggtctccgtggacagtcagtcaccatctcctgcactggaaccagnagcgtatgtcggtggttattaactttgtcctcctggttaccaacaacacccaggccgaggcccccccgtagtcaagtaactttagtgaatgtacattaaggcggccctgacgggtccctgatcgtcttcnctcggcctccaagtctaggacaaccacgtcgtaccctccgtagaccgactcgtcgtagggcctaccgaaggtcgtagacgtagtgacggtntacttatacgtgctgctactagtttgaccgtaacggcccaacccgtctaactggtatacgttccgtcgggagggaacggaacccaagtcgtacgtaccgttccgtaaggctacggaccttagaacggtcgtacccgccccttcggtcctaacgttcccgttccgttccccgccccttaccgtcgtaacgttacctacttacgtcgtacggaggtccgggcctaggacgaaacgcgacgtagtcgannnnnnnnnnnnnn

SEQ ID NO: 94304 - DNA, 578 bp, Homo sapiens
  misc_feature: GYAE6OF02IWI1U.29.85.H08.1.454.CMB.1.raw
  modified_base (562)..(562): a, c, t, g, unknown or other
  misc_feature (562)..(562): n is a, c, g, or t
  modified_base (565)..(578): a, c, t, g, unknown or other
  misc_feature (565)..(578): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctctggtaccaacaacaccaggcgacggcccccgactcataatttatgatgtctattaacgcggcctcgacggggtccctgactcgtccttcctctcggctccaacggggggggtctcggacaacactcgcctccgtcgacctactctcgtcggtcctccgacggtcgtcggacgtacgtacggacggtagtagttacttacgtcgtctcgtctacgtacgttcgacgacggccacccgcgtacgtgtcgtacgtcgtcgggacgggacggacgacgtcgtacggtaccgtccgtacggtacgtacgtcgtacgacggtccgtccgtccccgtcgtcctccgttcgtccgtcccgtcccgtcctccacgttcctacgtacgtcgtggcggtcggtcgtcggacgacggcgacgagncgnnnnnnnnnnnnnn

SEQ ID NO: 94305 - DNA, 730 bp, Homo sapiens
  misc_feature: GYAE6OF02GZAL1.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggttttccttgttgcttaattttaaaaggtgtccagtgtgaagtgcagctggtggagtcgtgggggagtcgtggtacacggccggtcggggggtccctggacgacctccgtccgtgtgccacgtcctcgtggtacttactaaagttttaatgttactttttccaatactacgttcgggtcccgtacgaacggtccggtaccgggggaagggtcgtggggtaggttcgggttcttcctttacgtttaagtttaaacgcgggtaacggtacggttacgtaccgttaaccttatactttacgtaagtcgactagtacttcgtaggtacggaacgggtcctacttaccaaccctatccctacgaagacgaacaaacaaactaacgtaccctccgttagtactacctacaacgtaaactacgaacgtacgttagaacgtaagtaacgtacgaacgaacgtcggtaccggtacctttacgttaacgtttgtttaacggtaagtaaacaaacggggtaagaacggtaacgtaacgggtacgttaccggtaaagggggttccggttacggttacggtttccggg

SEQ ID NO: 94306 - DNA, 585 bp, Homo sapiens
  misc_feature: GYAE6OF02GE4LT.29.85.H08.1.454.CMB.1.raw
  modified_base (226)..(226): a, c, t, g, unknown or other
  misc_feature (226)..(226): n is a, c, g, or t
  modified_base (297)..(297): a, c, t, g, unknown or other
  misc_feature (297)..(297): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
  modified_base (473)..(473): a, c, t, g, unknown or other
  misc_feature (473)..(473): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgccactggaaccngcagcatggtcggtggttataactttgtctcctggtaccacaacaccagcgacgcccccgatcatatttangatgtacattaacgcggccctcgacggggtccctgactcgcttctcngctcatctgcaacnctcgccctcctcgaccattcctcgtgggccctcgacggctgacgtagtcggaccggttagactttatacgtgtaccgttgtcttacgtcgtttggaccgtagtacccgaacccgntaaccgttgttacgtacgttcggttccggggacgggtaaccgggtaacccaagggtccctacgggtacccgttccggttaacggttcgaccgggttccgttacgaacccggg

SEQ ID NO: 94307 - DNA, 776 bp, Homo sapiens
  misc_feature: GYAE6OF02H9XOX.29.85.H08.1.454.CMB.1.raw
  modified_base (224)..(224): a, c, t, g, unknown or other
  misc_feature (224)..(224): n is a, c, g, or t
  modified_base (456)..(456): a, c, t, g, unknown or other
  misc_feature (456)..(456): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcaggcacaggatcctggctcagtctgccctgactcagcctcgctcagtcgtccgggtctccgtggacagtcagtcaccatctcctgcactaggaaccngcagcgtatcggttcggtggtttaactaacgtttcgtctaccgttacggtaacctaacaaccacccgaggccggaacccggtccccccgaaccgttacctaactttaaacgttttacagtaacttacgtacctaagttttaaacggcccggtacccttacggaacgggggttccctagtactccgtctttccgtcgtcggtacctccgtaaacgtcgttacggcctaaaacnccgttcgcccctttaccccgtacgtaccctacgttcccgttccggtacggggtccctacccgtagggtccctacgggtaaccggtaagttccggtaaacgggtttcgttaacgttttaacgtttaaccgtccggttaccgttgttacccgtttacgttacgttttaccggaccgtaccgggtaccccgtacccgtacgtacccgttgttcgtaccgttccgggtttaccgggcggggtaccgggaaccgaacccggttcgtaacccggtacccggttaccgttaccggtaccgtacggttaccccgtagggtaaccccgg

SEQ ID NO: 94308 - DNA, 637 bp, Homo sapiens
  misc_feature: GYAE6OF02F04SN.29.85.H08.1.454.CMB.1.raw
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
tcagatagagtactcacgaccggtgctcgatttagtatcactcagtcgcgggggggtctcaggaggcagcgctctggggacgtctccaccatggcctgggctctgctcctcctcacctcctcactcagggcacaggctcgttgggcccagtctgccctgattcagccctcctcgtgtccggtctcctggacagtcagtcgccatctcctgcactggaaccagcagtgatgttnagtaattngactgtctccttgtaccaacaacaccagacacacgtacccaacaaaacacatagaatataacgaatgtacaaatactccggcctacgacgggtcccctgacttcgtttctcgtggaccttaccgaagttctagggcctaaagttcggcggtcccttacgatcgaaccctattcgtccgttacggaccttcccgacgggtctacgggacggaccggaacggtctacgtatttagttaagtcgtcgttgcttcaaattacgtaataacgtccgtagttacgttactaacgggtttaacgggttgggttcccggggaagggtaaccgggtaaccgtaaggtccgtacggtacccggtacccggttaggggtacccaacgggtaccccaagggttcccgg

SEQ ID NO: 94309 - DNA, 151 bp, Homo sapiens; identical to SEQ ID NO: 93409
  misc_feature: GYAE6OF02HDSZ5.29.85.H08.1.454.CMB.1.raw
  modified_base (150)..(151): a, c, t, g, unknown or other
  misc_feature (150)..(151): n is a, c, g, or t

SEQ ID NO: 94310 - DNA, 530 bp, Homo sapiens
  misc_feature: GYAE6OF02HR77A.29.85.H08.1.454.CMB.1.raw
  modified_base (442)..(442): a, c, t, g, unknown or other
  misc_feature (442)..(442): n is a, c, g, or t
  modified_base (505)..(505): a, c, t, g, unknown or other
  misc_feature (505)..(505): n is a, c, g, or t
tcagatagagtactcacgaccggtgctcgatttagtatcactcagtcgcggggagctctgggagaggagccccagccctgagattccccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagccgtggggggtccctgagactctcctgtgcagcctctggattcaagtttaatgtatttttccatactactgggtccgtcaagctccggggaagggtctggagtgggtctcgttcttattatcgagcggtgctactacattctatgcagactctgtgaagggccgatcaccatcctcacgagaaccaacaacaacgtactccctgtactctnactaatagaacagtctagagaagtgaacgcagcgtcttcgtattagttgtgacaaagagaagngagatacgtagtgggtcgtgttacg

SEQ ID NO: 94311 - DNA, 155 bp, Homo sapiens; identical to SEQ ID NO: 93444
  misc_feature: GYAE6OF02HG5Z8.29.85.H08.1.454.CMB.1.raw
  modified_base (150)..(155): a, c, t, g, unknown or other
  misc_feature (150)..(155): n is a, c, g, or t

SEQ ID NO: 94312 - DNA, 796 bp, Homo sapiens
  misc_feature: GYAE6OF02IKE54.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcgagggcacaggatcctgggctcagtctcgccctgactcagcctcgctcagtgtccggtctccgtgacagtcagtcacatcctctcgactactaggaaccagcacgacgatcggtacggttaggttaattaaccgtttgtccgttaccgtacggttaaccaaacaaaccgtacccgacggaccggaaccggccccccgacgtacctaacgttaactttacgtacgtactgtactaacgttaacggccggtacccgttacggtaccggggttcccgtaggacgtccggttacttcgtaccgttcggtaccgttacccgtaacggtttccgtacgggtacctaaaccgtaccgtaccggtacccccgttccgtaccgtaacccgttacgttaccgtttccggttaccgggtccgttacccggtacggtaccgtacgaaacggtacgttacggtaacgggttacgttaacgtttaacgtttaaccgttacggtccgttacggtacctttaccggttaacgtttcggaacccggtacggtaccccgtaccggtacccgtacgttgggttacgtacgttccggtttacggggaaccgggtaacgggaacccgtacggtacccgttacggacccgtttcggtaccggttacgacggttacccggtagtaacccgg

SEQ ID NO: 94313 - DNA, 616 bp, Homo sapiens
  misc_feature: GYAE6OF02HNMC5.29.85.H08.1.454.CMB.1.raw
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccagcagcatgtcggtggtatactttgtctcctgtaccaacaacaccaggcgacggcccccgactcataatttangatgtcattaagcggccctcgagggtccctgatcgcttctctggctccaagtctggacaacnctcgcctcccgtagaccctatcctcgtcgggcctccgaggtcttacggacgtacgtacggtaccggttgtaactttacttaacgtgtccttacgcctttacctagttttcgcgtaaccgggtccaccccggtctaccgttgttacgtacgtttcccggttaccggggaaccgggtacgggaaacccgtaagggtacccgttacgggtaaccccggttaccgtaaccgggttaccgaccggttccgtaaccgtaaccggg

SEQ ID NO: 94314 - DNA, 747 bp, Homo sapiens
  misc_feature: GYAE6OF02FGU7J.29.85.H08.1.454.CMB.1.raw
  modified_base (744)..(744): a, c, t, g, unknown or other
  misc_feature (744)..(744): n is a, c, g, or t
tcagatagagtactcacgaccggtgctcgatttagtatcactcagtcgtgccctgacgtctagcctcgcctcgacgtcgtccgggtctcctaggaacagtcaagtccaccgagttctcctcgcactggaaccagcacgccgaatggtccgggttggttactaacctttggtctcctaggtaccaacaaccacccgaggtccggacggcccccgatcgaataagtttactgactgtcctagttaacgccgccctcgacgggtccctgactcgcttcgtctggcttccgaagtccgaggtactaacgtaccgtcgtcccgtaccgtacgtacctacctccgtacggtaccggtacccgtaccggacgggtccgtacggaacgtacggtacggtaacggtacgtaacgtttaacgttacgtcgtacggttacggtaccgttaccgtaacgttaccggacccgtacggacccgtacccgtcgtaaccgttacgtacgtacgttccggtacgggaacggtaacggtaaccgtacgtaccgtaaccggtaaccgttacgtacgtccgtaacggtaccgtacggaacgtccgtacccgtcccgtacgtacctaccgtccgtacccgtacccgtaccgtccgtacgtacgttacctacgtacgtcgtacggacggtcgtacgtaccgacgtacgggtccgtacgtagtacgtgtacgcgtacgtcgtactgcgttcgacgtagacgtacgtntcg

SEQ ID NO: 94315 - DNA, 620 bp, Homo sapiens
  misc_feature: GYAE6OF02IX1C0.29.85.H08.1.454.CMB.1.raw
  modified_base (240)..(240): a, c, t, g, unknown or other
  misc_feature (240)..(240): n is a, c, g, or t
  modified_base (311)..(311): a, c, t, g, unknown or other
  misc_feature (311)..(311): n is a, c, g, or t
  modified_base (608)..(609): a, c, t, g, unknown or other
  misc_feature (608)..(609): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
  modified_base (615)..(615): a, c, t, g, unknown or other
  misc_feature (615)..(615): n is a, c, g, or t
  modified_base (617)..(618): a, c, t, g, unknown or other
  misc_feature (617)..(618): n is a, c, g, or t
  modified_base (620)..(620): a, c, t, g, unknown or other
  misc_feature (620)..(620): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgatcataatttatgatgtacagttaagccggcctcgacggggtccctgactcgcttcnctggctccgaagtctggcaacgactcgcctcctcgaccatctcgtggctccgaggctggacagtgacggtnattatactgctgctcgtattgcacggccacccgctaccgtagtcgtacttcggttaccggacgggtaacggacctaaacggtccgtcgtaacccggtttccgtacggtacgtacgtacccgtacgtaacggtccgttacccggcccccgttaccggtaccttaccgttccgtttcccgttaccccctaccccgttaccgttaccaccggtttaccttaccgtaccttcgtaccggaccgggtccgggtacgtccgggaacgaaccgggtcgtacgtacgtcggacgcacgagcgtcnncncngncnngn

SEQ ID NO: 94316 - DNA, 706 bp, Homo sapiens
  misc_feature: GYAE6OF02I55LI.29.85.H08.1.454.CMB.1.raw
tcagatagagtactcacgaccggtgctcgatttagtatcactcagtcgcgggggagctctgggagaggagccccagccctgagattccccaggtgtttccattcggtgatcagcactgaacacagagaacgcaccatggagtttggactgagctgggttttccttgttgcttattttaaaaggtgtccagtgtgaagtgcagctgggtggagtcgtggggggagtcggtggtacgacgccgtcggggggtccctggacgactctcctgtgcagcctcgtggtattctaagtttaatgtatttttccattacacgtcgggtccgtcaagccgtacgggggaagggtccgtgggaggttgggtccttcgtctttattaacgtcgagtacggtgactaactactattctatgacagtactcgtaggtacggaacgggtccgattaccgaacctattacctaccgaaggacgtaaaccaaactaaaccgtaaacggttaccctaccccgttagttaccttaccgttacgaaacttaaacacggtaaactaaggttaccttaagggaacgttaaaggtaccggtaaccgaaccgtaaggcccgggttatttaccgtagttttaacgttaggtaagaaccggtaaaaggaacggtaaaggacggtaacggacgttaacggtaagggttacggggttacgttcggtttaacgg

SEQ ID NO: 94317 - DNA, 705 bp, Homo sapiens
  misc_feature: GYAE6OF02JGXBQ.29.85.H08.1.454.CMB.1.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
  modified_base (313)..(313): a, c, t, g, unknown or other
  misc_feature (313)..(313): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtgtccggtctcctggaccngtcagtcaccntcctcctgcactcggaaaccgcagcatgtcggtagttactacttcgtctcgtagtaccaacaaccaccgacggaccgaccggaccccctactactaacttaacttacncgtactacgtactacgttaacggccgtaccgtacggtacgggtaccctagtacgtccgtccttcgttcgtccggtacctaccgtaacgttccgtacgacctaaaccgtccgttaccgtccccgttcccgtacgaccctacgttcccgttccgtcgggtcctaccgtaggtccgtacgtaaccggtacgttacggacgggttacttaacgtttacgttacgtcgtaccgttacgtacctttacgttaacgtttcggaccgtaaccggtaccctacccgggtacttaccggtgtaccgttacggttccggttacggggtaccgggaaccggtaaccgtacgacccgttacggtaacccggttcggaaccggttcgaaccgtactacgggtaccg

SEQ ID NO: 94318 - DNA, 539 bp, Homo sapiens
  misc_feature: GYAE6OF02GAELR.29.85.H08.1.454.CMB.1.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (288)..(288): a, c, t, g, unknown or other
  misc_feature (288)..(288): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacngtcagtcaccatctctgcactggaaccngcagcgatgtcggtgtatacttgtctctgtaccaacacaccaggcgacgcccccgatcataattangatgtcataagccgcctcgacggggtcctgactcgtcttctctgctcagtctgcaacncncgcctcctgaccatctcgtcggctcgngctgacgngtcggacggtntattattactgtctgtctctagtttcgacacggtccacccgtctaacgtgtacgtacgttccggttaccgggacgggtaacggaacccgtaacggtccgttacggtaccccgttccgtaacggtccacggtacctcgtaaccggg

SEQ ID NO: 94319 - DNA, 534 bp, Homo sapiens
  misc_feature: GYAE6OF02HV54J.29.85.H08.1.454.CMB.1.raw
  modified_base (224)..(224): a, c, t, g, unknown or other
  misc_feature (224)..(224): n is a, c, g, or t
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (401)..(401): a, c, t, g, unknown or other
  misc_feature (401)..(401): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcacgtggaaccngcagcatggtcggtggttataacttgtctctgtaccaacaacacccaggcgacggcccccgatcaattaattatgatgtctataagccgcctcgagggtccctgactcgcttctctggctcagtctgcacnctcgcctccctgaccntcncgtggctcgngctgacagtcgacggtnattagtgactgtactcgctacgatttgactacggcccaccgctacttgtacgtacgttccgtcgggtaccgggacgggtaaccctaacggtccgtacggacccgttccgtacgggtaccacgtccgtaaccgg

SEQ ID NO: 94320 - DNA, 632 bp, Homo sapiens
  misc_feature: GYAE6OF02IE3TD.29.85.H08.1.454.CMB.1.raw
  modified_base (332)..(332): a, c, t, g, unknown or other
  misc_feature (332)..(332): n is a, c, g, or t
tcagatagagtactcacgaccggtgctcgatttagtatcactcagtcgcggggggggtctcaggaggcagcactctcgggacgtctccaccatggcctgggctctgctcctcctcacgcctcctcactcagggcacaggactccgtgggctcagtctcgccctgacctcacgccctcgctcgagttcgtccggtctccgtggactagtcacgtccaccatccttcctgctactaggaaccagcagcgtatcggttcggtggttaactacgtttcgtctccgtaggtaccaacaacacccgaggaccgaccggcccctactcaattacgttangtatcgtactacgttaacgccgtaccgtacggaccggtcctgacttcgtccgttcgtcgtacgtctacgtacgtcgcgtacactacgtcgcctccgtcgtacctcgttccgtcgtcggtcctcgacggtcgtagacgtagtacggtacggttagtactttacgtactagtcttacgtcttcgtagtttcgacgaccgtaccaccgtactacgtcgtagtaccgttcggtccgggaacggtaccggtaccgaacggtccgtaacggtcccgcgttacggacctcggtacgtaccgtaccgg

SEQ ID NO: 94321 - DNA, 627 bp, Homo sapiens
  misc_feature: GYAE6OF02F4PNO.29.85.H08.1.454.CMB.1.raw
  modified_base (188)..(188): a, c, t, g, unknown or other
  misc_feature (188)..(188): n is a, c, g, or t
  modified_base (194)..(195): a, c, t, g, unknown or other
  misc_feature (194)..(195): n is a, c, g, or t
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (474)..(474): a, c, t, g, unknown or other
  misc_feature (474)..(474): n is a, c, g, or t
  modified_base (513)..(513): a, c, t, g, unknown or other
  misc_feature (513)..(513): n is a, c, g, or t
  modified_base (537)..(537): a, c, t, g, unknown or other
  misc_feature (537)..(537): n is a, c, g, or t
  modified_base (550)..(550): a, c, t, g, unknown or other
  misc_feature (550)..(550): n is a, c, g, or t
  modified_base (562)..(562): a, c, t, g, unknown or other
  misc_feature (562)..(562): n is a, c, g, or t
tcagatagagtactcacgaccggtgctcgatttagtatcactcagtcggcggggagctctgggagaggacgccccagcccctgagacttcccaggttgtttccattcggtgatcagcactgaacacagagaacgcaccatggagtttggactgagcgtggtttcgtgtagctatttaaagtgtcagtntgagtnnagctggtggagtgnggggngtcggtgacncgccggtcgggggtcctggacgctcctccgtgcgcacgtccgtctggtaattacgttaaagttttaatcggttactttttaccagttaactaccgttaggggtccccttacgaaggtccggtaccgggggtaacgggttcggtagggtaggtcgggtctcttaatttagttaatacggaagccggttancgttactacnttactagngtacacgcttcgtggtaggaacgggcttatccaccatccaacngaacgaactaacgaacaacgtcctaccctgtaatcgaanacaatgaactatcgtagaacgtanaggtacagtacgngtccttaagttntacgtgttacggaaataaacggtagagacgttaggacttacggttaaggtcggtacgtcgttacg

SEQ ID NO: 94322 - DNA, 603 bp, Homo sapiens
  misc_feature: GYAE6OF02JFMST.29.85.H08.1.454.CMB.1.raw
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccggtctcctggacagtcagtcaccatcctcctgcactaggaaccngcagcgatcgtcggtgttatacttntctcctagtaccaacacaccaggcgaccgccccgatacattattatgatgtcagtacgccgtcctcgacgggtcctgactcgcctctctcgcctcgacgtctacgacacncgtcncctcctacgacctatccgtcgtcggtcctacgacgcgtacgacgtagtcggacgtattaattacgtacgtcgtcgtctcttacgttacgttcgccgtacggccctaccggtacaccgttcggttacgtacgtttccgggtaccggggaacggtaaccgggtaaccgtacggttaaccgaccggttacccggttaccggtaaccggtacctaccggtacccgttaccggtaacccggg

SEQ ID NO: 94323 - DNA, 897 bp, Homo sapiens
  misc_feature: GYAE6OF02I4OKV.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcacatggagtttggactgagcttgggttttccttgttgctattttaaaggtgtccagtgtgaagtgcagctgggtggagtcgtgggggatcggtggtacagccgtcggggggtccctggagacctctaccgtgtacgcgacgtcctcgtggtaactttcgtaaagttttaattacgttaacttttttaccaacttaccgtacgttacggggtcccgttacgaacggtccgggtaccggggggtaaacggggttcgtacgggtacgggttgggttccgttccgtttacgttttaagttaaagtaccgggtaaggtaccggggttacgttaccgttaaaccttaaccttattttaccgttagtacggtactaaacgggtccctttacgttacggggttaacggggaaaccggggtacccgttaactttaaccggaacccctttaactttaccccgtaacccgtaaacggtaacggaaaaccctaaaaccgaaaaacctaaaccgggtttaacccctaaccccgtttaggttaaaacccttccgttaacggtaaaccctaaaaagtttaaccgggaaaccttaacggttacgtttaagggaaacgttaaacggggttacgaaacggtacgtaacggttacggttacctttaacgtttatttaccggttttaaggtacggtaaaagaaaacggtaaacgggaacggttaacggaagggttaacttaagggttaacggggtttacggggttaccggtttacgggtttaaccgg

SEQ ID NO: 94324 - DNA, 543 bp, Homo sapiens
  misc_feature: GYAE6OF02H0U6X.29.85.H08.1.454.CMB.1.raw
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (342)..(342): a, c, t, g, unknown or other
  misc_feature (342)..(342): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcaggcacaggatcctgggctcagtctgccctgactcagcctcgctcagtgtccggtctcctggacagtcagtcaccatctcctgcacgtggaaccagcagcgatgtcggtgttaatatttcgctcgtgacaacacnccgagcgaccgccccatcataattngatcnaatagcgcctgacggtccngntcgcttcncgtgcctacgagctgacacnctcgcctccncgacntctcgtcggcctcgagcgtacgagtcgtagcggttagtatttacttacgtgtccgtcgttctcgttatttcgaccggtacgtcccacccgtcacgttcgtacgacgttcggttccgggaacggaaccggtacacgggtactccggttaaccgccggttacggaccgacggtcccgtagtaacccgg

SEQ ID NO: 94325 - DNA, 153 bp, Homo sapiens
  misc_feature: GYAE6OF02HNJQR.29.85.H08.1.454.CMB.1.raw
  modified_base (151)..(153): a, c, t, g, unknown or other
  misc_feature (151)..(153): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcgggctgggcaaggcgcatagnnn

SEQ ID NO: 94326 - DNA, 562 bp, Homo sapiens
  misc_feature: GYAE6OF02GELKZ.29.85.H08.1.454.CMB.1.raw
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (286)..(287): a, c, t, g, unknown or other
  misc_feature (286)..(287): n is a, c, g, or t
  modified_base (407)..(407): a, c, t, g, unknown or other
  misc_feature (407)..(407): n is a, c, g, or t
  modified_base (432)..(432): a, c, t, g, unknown or other
  misc_feature (432)..(432): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatcctgggctcagtctcgccctgactcagcctcgctcagtcgtccgggtctcctggacngtcagtcacctatctcctgactacgtggaaccngcagcatgtcggtgtatacttntctctgtacaacacncagcgcgcccntcatatnnatgtcatagcgcctgacgggtcctgactcgcttctctcggtcctcgtaacgtcgtgtactaacgactcgtccctccgtacgtacctactccgtcgtccggcctccgaggtctacggacgngtacgtacggtagtatttatacgtntctgtcgttcttacgttcgacgaccgccgtacccgtcgacgttgtacgtcggtccggttccgggaccgggaaccgggtaccgaacggtccgtcggtacccgtccgttaggccacggtctaccggtaccgg

SEQ ID NO: 94327 - DNA, 422 bp, Homo sapiens
  misc_feature: GYAE6OF02GGGCL.29.85.H08.1.454.CMB.1.raw
  modified_base (410)..(422): a, c, t, g, unknown or other
  misc_feature (410)..(422): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgatcataatttatgatgtcattaagcggccctcaggggtccctgatcgcttctctggctccaagtctggcaacactgcctccctgaccatctctgggctccaggctgacgatgacggtgattattactgctgctcatttgcaggcaccccgcactgtgatcgttcggcggagggaccaagctgaccgtctaggtcagctcaggctcgcccctggtcactctgttctccaccctctcagtactctatctgacgcggctggcgaaggcgacatagnnnnnnnnnnnnn

SEQ ID NO: 94328 - DNA, 544 bp, Homo sapiens
  misc_feature: GYAE6OF02HAJX7.29.85.H08.1.454.CMB.1.raw
  modified_base (518)..(529): a, c, t, g, unknown or other
  misc_feature (518)..(529): n is a, c, g, or t
  modified_base (531)..(544): a, c, t, g, unknown or other
  misc_feature (531)..(544): n is a, c, g, or t
tcagatagagtactcacgaccggtgctcgatttagtatcactcagtgtccgggtctcctggacagtcagtcaccatctcctgcactggaaccagcagcgatgtcggtggttataactttgtctcctggtaccaacaacacccaggcgacggcccccccgactcataatttatgatgtcattaagcggccctcgacggggtccctgatcgcttctctggcctccgaagtcgtggaccaacactcgccctccctcgaccatcctcgtcggggcctccgaggctgacgatggacggtgtatttactactgctgctctatttgacgacggaccacccgctacgtgtgacgttccggtcgggcggacggaccacgcgtacgtaccgtcgtacgcgacgtcgtacgaacgtccgtcccgtccccgtcggtcctacctccgtcccgtccccgtcccctcctcctacttactcttactcgtacggacgccgggtacgcggacggaacggcggtacgtacgagacgnnnnnnnnnnnngnnnnnnnnnnnnnn

SEQ ID NO: 94329 - DNA, 614 bp, Homo sapiens
  misc_feature: GYAE6OF02IZ1MG.29.85.H08.1.454.CMB.1.raw
  modified_base (194)..(194): a, c, t, g, unknown or other
  misc_feature (194)..(194): n is a, c, g, or t
  modified_base (234)..(234): a, c, t, g, unknown or other
  misc_feature (234)..(234): n is a, c, g, or t
  modified_base (274)..(274): a, c, t, g, unknown or other
  misc_feature (274)..(274): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggcccccgactcataatttangatgtcattaagccggcctgaggggtccctgatcgcttcnctggctccagtctggcaacactgcctccctgaccatcctntggggctccaggctgacgatgacggtgactttatactgctgctctatttgcctacggcctacccggctacgttgtcgtattccgtttcgggacgggagggacccaacggtcctacggacccgttccgtaggtcgacggtcctacgaacggtccgtcgccccccgttcggtaccctaccgttccgttccggtttacccccgcccttcccgtaccgtaccgttaccttccttacgtccgtacggtacgggtccgggtcctacggggtacccgtaaacggggcccgtaccacggttaacggtcgtacgaccgtcgacgtcgcgcgtcgcgtagacgtcgcgtc

SEQ ID NO: 94330 - DNA, 649 bp, Homo sapiens
  misc_feature: GYAE6OF02HD0ER.29.85.H08.1.454.CMB.1.raw
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtcagtcacatctcctgcacgtggaaccngcagcgatgtcggtagttataactttgtctccgtgtaccaacaacaccgaggcgacgccccccgatcaattaattangatcgtcattagccgtcctcgacggtcctgactcgtctctcgtcgtcctacgtaacgtcgtacggaccaacgtaccgtccgcccttaccctacgaaccctacgtccgttccggtcgggtaccctccggaacgggtccttacggaaccggtagtacgggtaacggtttacgttaaatttaccgtttacgttcgtccgttcgtacctttacgttacgtttacggaccgtaaccggtaccctacccggtacaccggtttcgtacgttacgttcggtaccgggaacggggtaccgaacgtacgtcgtaccgtacccggtaccgtcgtacgtacgtacgtacggtaaccgg

SEQ ID NO: 94331 - DNA, 476 bp, Homo sapiens
  misc_feature: GYAE6OF02FX96T.29.85.H08.1.454.CMB.1.raw
  modified_base (335)..(335): a, c, t, g, unknown or other
  misc_feature (335)..(335): n is a, c, g, or t
  modified_base (447)..(447): a, c, t, g, unknown or other
  misc_feature (447)..(447): n is a, c, g, or t
  modified_base (453)..(454): a, c, t, g, unknown or other
  misc_feature (453)..(454): n is a, c, g, or t
  modified_base (462)..(462): a, c, t, g, unknown or other
  misc_feature (462)..(462): n is a, c, g, or t
  modified_base (466)..(476): a, c, t, g, unknown or other
  misc_feature (466)..(476): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggcccccccgactcataatttatgatgtcattaagcggccctcaggggtccctgatcgcttctctggctccaagtctggcaacactgcctcctgaccatctctgggctccaggctgacgatggacggtgattattactgctgctcatttgcaggccacccgnactgtgatcgtcggcggagggaccaaggctgacccgtcctaggtcagctcgaaggcctccgccccctcgtcctacttcgtccgttcccgccctcctcacgtactctatctgnggcggnnggcagcgnatgnnnnnnnnnnn

SEQ ID NO: 94332 - DNA, 716 bp, Homo sapiens
  misc_feature: GYAE6OF02FNP76.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctatttaaaggtgtccagtgtgaagtgcagctggtggagtcgtgggggagtcggtggtacagccgtggggggtccctgagactctcctgtgcagcctctggattcaagttttaatgtatttttccattacacgtgggtccgtcgaagcgtccggggaaggtcgtggagtgggtctctcttattatcgagacggtgctactactattctatgacagtacctcgttgtaggtaacgggccgtatttcccgaacctacttccgaccgaaggtacggaaacctaaaccgaaaccgtaaacgttaacccttacccgtaagttaccttacgtaggtaacctaaaagtacgaaacgtaggtaccgttaagggaacgtaaacggttacggaaccgaaacgtacggtaccgggtaccttttacgttaacgttttaacgtttacggttaacggtaaaccgtaaaaacgggtaagggtaaacggtaaccggaaggggttaacgtttaaccgggttaaagggtttcgggggtttaaccggttacccgggtttttaaaccgg

SEQ ID NO: 94333 - DNA, 622 bp, Homo sapiens
  misc_feature: GYAE6OF02FZIIC.29.85.H08.1.454.CMB.1.raw
  modified_base (290)..(290): a, c, t, g, unknown or other
  misc_feature (290)..(290): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatggtcgtgttatacttgtctctgtaccaacacaccaggcgacgccccgatcataattangatgtacattaacgcgtccctcgtacggggtcctgactcgcttctcgtgctccagtctcgacaacactcgccctcctacgacctactccgttcgtcgggtccttcccgaggtcctacggaaccgtagttacggggacggttagttaactttaacgtttaccgtcggtaccgttacggtcccttacgtagttttcgaccgtaccggtacccgtaccccgtctaccgttgtacgtaccgttccggttaccgggaccgggaacggtaacccgtaacggttaccgtaccggttacccggtaccgtacgggttccgaacggtcctaacggtaaccgg

SEQ ID NO: 94334 - DNA, 544 bp, Homo sapiens
  misc_feature: GYAE6OF02FKHGV.29.85.H08.1.454.CMB.1.raw
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
tcagatagagtactcacgaccggtgctcgatttagtatcactcagtcgcggggagctctgggagaggagccccagccctgagattccccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagcctggggggtccctgagactctcctgtgcagcctctggattcaagttttaatgtatttttccatacactgggtccgtcaagcgtccggggaaggtctggagtgggtctctcttattaatcgagacggtgctactacattctatgcagactctgtgaagggccatcacntctcaganacaacaacaacgtacctccctagtactctagactaaatcgaaacagtctagaagaagtgaacgacagcggtcttacttattattggtagaacaaaaggagaaggacaggtactacgtaaggtcgggtcgtgtttacgg

SEQ ID NO: 94335 - DNA, 149 bp, Homo sapiens; identical to SEQ ID NO: 93464
  misc_feature: GYAE6OF02F95KY.29.85.H08.1.454.CMB.1.raw

SEQ ID NO: 94336 - DNA, 561 bp, Homo sapiens
  misc_feature: GYAE6OF02FMBH7.29.85.H08.1.454.CMB.1.raw
  modified_base (545)..(545): a, c, t, g, unknown or other
  misc_feature (545)..(545): n is a, c, g, or t
  modified_base (547)..(548): a, c, t, g, unknown or other
  misc_feature (547)..(548): n is a, c, g, or t
  modified_base (551)..(551): a, c, t, g, unknown or other
  misc_feature (551)..(551): n is a, c, g, or t
  modified_base (553)..(561): a, c, t, g, unknown or other
  misc_feature (553)..(561): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataacttttgtctcctggtaccaacaacacccaggcgacggccccccgactcataatttatgatgtcattaagcggccctcaggggtccctgatcgcttctctggctccaagtctggacaacactcgccttcctgaccatctctgggcctccaggctgacgatgacggtgatttatactgctgcttctatttgcacggccacccgctactgtgacttcgtccggacgggacggggaaccaacggtcctcggacccggttccgtaggtccgagtcgtaccgaaggtccgtcccgcccccgttcggtcctaccgttcctacccggtttcccctaccccgttccgttccgacgtttacccgtacttacgtcgttggcggtcgggtcgtcgacgtacgggcgtccgtagtcgngnncgncnnnnnnnnn

SEQ ID NO: 94337 - DNA, 659 bp, Homo sapiens
  misc_feature: GYAE6OF02GVIYH.29.85.H08.1.454.CMB.1.raw
  modified_base (353)..(353): a, c, t, g, unknown or other
  misc_feature (353)..(353): n is a, c, g, or t
tcagatagagtactcacgaccggtgctcgatttagtatcactcagtcgcgggggagctctgggagaggagccccagcccctgagattcccaggtgtttccattcggtgatcagcactgaacacagagaacgcaccatggagtttggactgagctgggttttccttgttgctattttaaaggtgtccagtgtgaagtgcagctggtggagtcgtgggggagtcggtggtacagccgtggggggtccctgagactctcctgtcgcagcctgtggattcaagtttatgtatttttccatactacgttcgggtccgtcaaggccgtaccgggggaaggtcgtggaggtgggtctctnttattaagtcgaggtacggtgtcctactactattactagtgacagtacttcgtggtacggaacggggtccctaattccaaccctactccgtaccaaggacaaaccaaacaaacaacgtacctcccgttagtaacctcgtacgaactaaagtcgaaactagtaccgtaggaacggtaaggtacgaaccgacggaggaccgttactttcttaagtttagttaggaacgtaaagaaaaaggtaacggaacggtacgtaaggttaaccgttaggtaaacggggttcgggttaccgggttacgtttaacgg

SEQ ID NO: 94338 - DNA, 764 bp, Homo sapiens
  misc_feature: GYAE6OF02H3BK8.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcaacctcgctcagtcgtccgggtctccgtggacagtcagtcaccatctctgcactggaaccagcagcgagtggtcggtggttattaactttgtctctggtaccaacaacaccaggccgacggaccccctactaccaattaatttacagtacttgttaccaagttaacgccggtccctacggtaccggggtcccctggtactcggtcctttcctcgtcgggccttaccgtaaggttccgtacggacctaaaccgtacctccggtccccttaccttaccgaacctcttaccgttccggtacgggtccctaccggaggtcctaggaccgagttcggaccggttagtactttaacgttacgtgtcgttacgtacccttagtacgttttacgaaccggtacgtaccccgtaacccggtccgttaaacgtcgggtttacggtaccccttaccggggtttacccggggaaccgggggttaaaccgggtaaccccgtaaaggggttccccgtttaaaccgggggtaaccccccgtttttcccgggaaaccgggggttaccttaaccccggggtaaccctttaccgggaaccgggggttaaccccccccg

SEQ ID NO: 94339 - DNA, 660 bp, Homo sapiens
  misc_feature: GYAE6OF02GJ31V.29.85.H08.1.454.CMB.1.raw
  modified_base (240)..(240): a, c, t, g, unknown or other
  misc_feature (240)..(240): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcgagggcacaggatccgtgggctcagtctcgccctgactcagcctcgctcgagtcggtccgggtctccgtggacagtcagtccacctatcctcctgcctacgtacggaaccngcgagcgtagttcggttcggttaggttattacgtttcgtcctccgtacggtaaccaacgtaaccgaccgacggccggacccggaccccctatacctaattaattacgtgtattcgtaactacgttaacggcccgtaccgtcggtacggtcctgtacgtccgtcttcgtcgtcgtactaccgtacgtcgacgtacaaccgtctccgtccctaccgtacgacctcgtccgtcggtcggtcctacgtcgtacgtacgacgtagtacggtagttattacttatcgtagtctcgtattcttagtaccgacgtaccgtacctacgtacgtacgttcgtagtaccgtcgggtacggaccgggtaacgaaccggtacgtaccggtacgaccggttacgtacggtccgtacgtaccgtaccgtacccgg

SEQ ID NO: 94340 - DNA, 803 bp, Homo sapiens
  misc_feature: GYAE6OF02G6RT5.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctatttaaaaggtgtcagtgtgaagtgcagctggtggagtcgtgggggagtcggtggtacaggccgtgggggtcctcgagacgtctcctcgtgcgacgaccgtcctggtagttacttaacggtttaaaatttagtatttttaccttaactactaacgttacggttcccgggttaccgtaacgtaccggtcccgggggtaacgggggttacggtcggtagggtaggtccgttcgttactttattaagttaccgaggtacggtacgtcgtacctaacgtattacttaactggcacgtactcgttagtacggtaacgggaccggtacttaccgaacccacgtccttaccgaacgtaaacggaccaaaaccaaaacggtaaaccttacccgttaacccttccggttaattaccgttaagacccgttaaaaacgtaagtaaaacccgtaagttccgtaacgggtaaacgtaaaggttacccggaaaggtaaccgtaacggaccgggtctttacccgtttattttaacgtttacggtggttaacgaaaaaaacggtaacgggaacgggtaaccggtaacggtaaggtttaaccttaaaggggggttaaccggggtttccgggttaccgtttttaaaccgggg

SEQ ID NO: 94341 - DNA, 652 bp, Homo sapiens
  misc_feature: GYAE6OF02GFDVT.29.85.H08.1.454.CMB.1.raw
  modified_base (291)..(291): a, c, t, g, unknown or other
  misc_feature (291)..(291): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcacatctcctgcactggaaccagcagcgatggtcgtggttatacttgtctctggtacaacacaccagcgacggcccccatcataatttangatgtcattaagccgccctcgacggggtccctgactcgcttctctcggtcctccgaagttctacggactaaccgacgtccggccccttacccgtacgaccctacgttccgtccggtacgggtccttacccgacggtccgttacggaccgtagtcggtacggttgttaactttacgttacctcgtaccgtgtccgttacgtacgttttcgaccggtaccggccctaccccggacgtacgttacgtaccgttacgttacccggtttacggggaaccggggtaaccgggacccgtaacggtaccggttaccggtaaccccggttccggttaaacggccgtacggtacccgttacggaacccggg

SEQ ID NO: 94342 - DNA, 724 bp, Homo sapiens
  misc_feature: GYAE6OF02H0LEV.29.85.H08.1.454.CMB.1.raw
  modified_base (347)..(347): a, c, t, g, unknown or other
  misc_feature (347)..(347): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggtttcctgttgctattttaaaggtgtccagtgtgagtgcagctggtggagtcgtgggggagtcggtggtacaggccgtggggggtccctggagactcctctgtgcagcctctggtacttcaagtttatgtatttttccatactactgggtccctacagtcgtaccggggaaggtctggtaggtgggtctcgtnttataagtcgagtacggtgtctactactattacctatcgactacgtaacttcgtcggtaaggaacgggtcccgtattaccgacctactccgttaccaaggtacaaaccaaacgtaacctaacgtaccctcccgttagtacctcgttacgactaaaagtacgtaaacctacgtaccgtaaggaacgtaaagggttaccgaaaccggtaaccgaacgggtacccgggttacttttaccgttaacgttttacggtttacggtaacggtaaaccgtaaaaagggtaaccggtaaaaccgggtacggtaacggggaaccgtttaaccgggttaaacggggtttaccggggttacccggtttaaccgggtttttaacccgggg

SEQ ID NO: 94343 - DNA, 601 bp, Homo sapiens
  misc_feature: GYAE6OF02JJFKU.29.85.H08.1.454.CMB.1.raw
  modified_base (269)..(269): a, c, t, g, unknown or other
  misc_feature (269)..(269): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaggtgtccagtgtgaagtgcagctggtggagtcgtgggggagtcggtggtacagccgtggggggtccctggagacctctccgtgtgcagcctntggattcaagtttaatgtacttttcatacacttgggtccgtacagtcgtaccggggaagggttctagggagttggggtactcgtacttattaactcggtagacggtcgctactacactttctatgcagtacctgtcggaggaacgggccgtattaccacctactcctccgagtaacgacctaaacaaccgaatacccttccttagttactcttcgactaaactcgaactaacgtctagtacgtaaagtcgaacgacacgcggtcttctagtttactgtagaactaaaggacggaagacaggtacttacgtaaggtcgggtacgttgttacgg

SEQ ID NO: 94344 - DNA, 690 bp, Homo sapiens
  misc_feature: GYAE6OF02JDCQI.29.85.H08.1.454.CMB.1.raw
  modified_base (233)..(233): a, c, t, g, unknown or other
  misc_feature (233)..(233): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatccgtgggttcagtctgccctgactcagcctcgctcagtcgtccggtctccgtggacagtcagtccacctatcctcctgcctacgtggaaccngcaggcagtggtcggtagttatacgttcgtctcgtacgtaaccaacaaccgaccgacggccgacccggcccccatacgtaattaacttatacgtatcgtactaacgttaacggccgtacccgtacggtaccgggtccctaggtacttccgtacgtttcctccggtcgtcctacgtaacgtcgtacggacctaacgccgtccgtacccgttacccgtcgtaacccttcgtcccgttacggtccggtaccgttaccgacggtcgtacgtaacgtcgttacggtacggttataacgtttacttacgtcgtcgtcgtacttacgttagtacggcgaccggtacccaccgtacgtacgtcggttactaccggttcggtaacgggaccgggtaacgaccgtacgtacccgtaccggtaacccgttcggtacgttccgaccgttacgaccggtaccggttcccc

SEQ ID NO: 94345 - DNA, 777 bp, Homo sapiens
  misc_feature: GYAE6OF02J2O0I.29.85.H08.1.454.CMB.1.raw
  modified_base (274)..(274): a, c, t, g, unknown or other
  misc_feature (274)..(274): n is a, c, g, or t
  modified_base (340)..(340): a, c, t, g, unknown or other
  misc_feature (340)..(340): n is a, c, g, or t
  modified_base (721)..(721): a, c, t, g, unknown or other
  misc_feature (721)..(721): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggtttccttgttgcttattttaaaaggtgtccagtgtcgaagtgcagctggtggacgtcgtgggggtagtcggtggtaccgagccgttggggggtccctggaggtacctccgtcctggtcncgacgtccctcgtggattccgaaagttttatgttactttttccaatactacgtcgggttcccctanaacggtccgtaccggggtaagggttccctaggggtacggttcggggttccttcgttacgttttaacgttaaacgtcggaacggtacggttcggccttacgtactatttctactaggactcgtaacttccgtagtcggtaacggtacctagttcccacggtacctttcaacccgtaaggaactaaaccctaaacccgtaaacaaaccggtttaccctacccggttatttaaaccggttcgtaaccctaacgtaaagttccgggaaaactacgggtaacctaggtaaacgtaaggtacgtaaccggaaggtaccggttcgggtacctttacgttaacggttactttcggtaaaccgggtaaataaaaggtaccgggtaaccgnggttaaaccgtaccgtaggttaaaccggtcggggtttacgttacggtttaaccggg

SEQ ID NO: 94346 - DNA, 517 bp, Homo sapiens
  misc_feature: GYAE6OF02GBJM8.29.85.H08.1.454.CMB.1.raw
  modified_base (258)..(258): a, c, t, g, unknown or other
  misc_feature (258)..(258): n is a, c, g, or t
  modified_base (319)..(319): a, c, t, g, unknown or other
  misc_feature (319)..(319): n is a, c, g, or t
  modified_base (336)..(336): a, c, t, g, unknown or other
  misc_feature (336)..(336): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (506)..(517): a, c, t, g, unknown or other
  misc_feature (506)..(517): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagccggccctcgaggggtccctgatcgcttctctggctccaagtctggcaacnctgccctcctgaccatctctgggctccaggctgacgatgacggtgattattactgctgctntatttgcaggcacccgnactgtgacttcgttcgggacggagggaccagtcctgaccgtccgtacggtcagctacgaacggtcctccgccccgtcgtcctaccttcgtcccgttcccaccccttctacctacgttactcctacttcgtggacggcgggtccgtggaccgaagggtcgcagtagnangnnnnnnnnnnnn

SEQ ID NO: 94347 - DNA, 685 bp, Homo sapiens
  misc_feature: GYAE6OF02GMJXW.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcaccctcctcactcagggcacaggatcctgggctcagtctgccctgactcagcctccctcgtgtccgggtctccgtggacagtcagtcaccgtctcctgcagtcggaaccagcaggtcgtacgttggtgtacttaataaccggttgtcctccgtacggtaccacgccaccgccccgaggaccaccgaccgacccccctaaaactcaacgttagttactttttcggacgttacgtagtaacgtccggtaccctacggtaccgggtccctgtactcgtcttctcgtcggtacctagtcgtaggcgacgaccgaccgtcctaccgtagtacttactccgtcgtcggtcctaccgagtacgtcggaacgggacgtacggtactagtaattacttacggtcgacacgttctactagttaacgaaccggaaacggtacctaaacgttacgttacgttagttaaccgtacggtaaaccgtacggaaccgtacgtccgtacccggttaacggtaccgtaccgaccgtaacccgtaccggaaccccctacgtcctaacgtccctaccgtccgttaccccg

SEQ ID NO: 94348 - DNA, 486 bp, Homo sapiens
  misc_feature: GYAE6OF02HOUMM.29.85.H08.1.454.CMB.1.raw
  modified_base (194)..(194): a, c, t, g, unknown or other
  misc_feature (194)..(194): n is a, c, g, or t
  modified_base (214)..(214): a, c, t, g, unknown or other
  misc_feature (214)..(214): n is a, c, g, or t
  modified_base (307)..(307): a, c, t, g, unknown or other
  misc_feature (307)..(307): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
  modified_base (339)..(339): a, c, t, g, unknown or other
  misc_feature (339)..(339): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (474)..(486): a, c, t, g, unknown or other
  misc_feature (474)..(486): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgatcataatttangatgtcattaagcggccctnaggggtccctgatcgcttctctggctccaagtctggcaacactcgcctccctagaccatctcgtgggctccgaggtctgacgagtcgacggtnattattactgctnctntattcgcagccaccgnactgtgactcgttcggacggacggaccagctcgaccgtccgtagtcagctacgagctcgccctcgctactctcgtcccgcctctcacgtctctatcgtagcgtcggcgtcggacgaaggctacgagtacgngngnnnnnnnnnnnnn

SEQ ID NO: 94349 - DNA, 755 bp, Homo sapiens
  misc_feature: GYAE6OF02JAJYE.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagccgtgggggtccctgacgactctcctgtcgcagcctcgtggtattacgtaagtttaatgttactttttccaattactacgttcgggttaccgtcgtaaacggtccgttaccgggggaaggggttccgttaggggacgggtttacggggtccgttacgtttacgtttaagtttaaacgttcggaacgtaccggggttacgaccgttaacctacgtaactttcgtaatcggtaccaggtaccttcgtcgggtagggaacgggtcccgtactttaccaccctacgtccttacccgaagaaggaaaccaaacaaacgtaacgttaccttaccccgttgtaacttcgtacgaactaaagtacgtaaaccgtagttaccgttaggaacgttaaacggtcgaaacgtaccgtaaagggtcccgttaactttcttaagtttacgttggtaacgaaccgtaaaaagggtaacggtaacggacgttacggtaacgttaccggttaagggtccgggttacgttacccggtttacgg

SEQ ID NO: 94350 - DNA, 525 bp, Homo sapiens
  misc_feature: GYAE6OF02I2KKR.29.85.H08.1.454.CMB.1.raw
  modified_base (268)..(268): a, c, t, g, unknown or other
  misc_feature (268)..(268): n is a, c, g, or t
  modified_base (491)..(492): a, c, t, g, unknown or other
  misc_feature (491)..(492): n is a, c, g, or t
  modified_base (495)..(525): a, c, t, g, unknown or other
  misc_feature (495)..(525): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgccctccctgaccatctctgggcctccgaggctgacgatgacggtgattattacngctgctctatttcgcacggccaccccggcacgtggtacgacttcgttcgggcgggaacgggacccaagctacggacccttccgtaggtccagtcgtacaacggcctccgcccccttcggtcctacgtccttaccggtttccccccgccctttccgtactacgttaccttccgttactcgtgggacggtccgggtacgtcgggacgaacggtccgactagacgnngtnnnnnnnnnnnnnnnnnnnnnnnnnnnnnnn

SEQ ID NO: 94351 - DNA, 154 bp, Homo sapiens
  misc_feature: GYAE6OF02HFDFY.29.85.H08.1.454.CMB.1.raw
  modified_base (149)..(154): a, c, t, g, unknown or other
  misc_feature (149)..(154): n is a, c, g, or t
tcagatagagtactcacgaccggtgctcgatttagtatcactcagtcgcgggacacgactggagattaaacgaactgtggctgcaccatctgtcttcatcttcccgcatctgaatagcgtactctgagcgggctggcaaggcgcatagnnnnnn

SEQ ID NO: 94352 - DNA, 782 bp, Homo sapiens
  misc_feature: GYAE6OF02FEQ32.29.85.H08.1.454.CMB.1.raw
  modified_base (735)..(735): a, c, t, g, unknown or other
  misc_feature (735)..(735): n is a, c, g, or t
tcagatagagtactcacgaccggtgctcgatttagtatcactcagtcgcggggagctctgggagaggagccccagcccctgagacttcccaggtgtttccattcggtgatcagcactgaacacagagaacgcaccatggtagtttggactgagtcgttggttttccttgttagtactttaagtttaaaggtcgtcctagtgtagtaagtgacgagtcgtgggtggtagtcggtggggtacgtcggttaggtacgacggtccgggtcgggggtcctgtacgtacgttcctccgtgtcgcgtaccgtccgtagtaggttacttacgtaaagttttacgtagtttacctttaccgaacgttaccgtacggtcgggttaccgtacggtaacggtccgggttacggggtaagtcggtagggttacggttccggttacttctttaacgttaacgttaccggacggtaacggttaccggtacttaccgtaaccttagtacgtttacgacgtacgacgtacgttacgttcggtaagggtaccggtaaccgtctacctaccgaacctcgttaccgaacgaaacgtaacccaaactaaaccgttacgtaaccgttcccttacggtataaccgttacgaacgtaactaacggtacgttaaacgtgtaacgtaaacggaacgttcggaacgtaccgtacgtcggttcgttacttagttaagtcgtaaggaaacggaataaaccgggngttaccgaggtaagtcccgttagggtcggtcggttactaggttaccg

SEQ ID NO: 94353 - DNA, 626 bp, Homo sapiens
  misc_feature: GYAE6OF02J1X61.29.85.H08.1.454.CMB.1.raw
  modified_base (194)..(194): a, c, t, g, unknown or other
  misc_feature (194)..(194): n is a, c, g, or t
  modified_base (274)..(274): a, c, t, g, unknown or other
  misc_feature (274)..(274): n is a, c, g, or t
  modified_base (321)..(321): a, c, t, g, unknown or other
  misc_feature (321)..(321): n is a, c, g, or t
  modified_base (390)..(390): a, c, t, g, unknown or other
  misc_feature (390)..(390): n is a, c, g, or t
  modified_base (597)..(597): a, c, t, g, unknown or other
  misc_feature (597)..(597): n is a, c, g, or t
  modified_base (610)..(611): a, c, t, g, unknown or other
  misc_feature (610)..(611): n is a, c, g, or t
  modified_base (613)..(613): a, c, t, g, unknown or other
  misc_feature (613)..(613): n is a, c, g, or t
  modified_base (618)..(618): a, c, t, g, unknown or other
  misc_feature (618)..(618): n is a, c, g, or t
  modified_base (621)..(621): a, c, t, g, unknown or other
  misc_feature (621)..(621): n is a, c, g, or t
  modified_base (623)..(624): a, c, t, g, unknown or other
  misc_feature (623)..(624): n is a, c, g, or t
  modified_base (626)..(626): a, c, t, g, unknown or other
  misc_feature (626)..(626): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatggtcggtggttataactttgtctcctggtaccaacacacccaggcgacggcccccgatcataatttangatgtctagttaagccggccctcgacggggttcccaggtctcgtcttctcgtggtcctccgaaggttctcggaccaaacncctcggcccctccctacgaccattccgcgttcgggctcccgagtccngacgatcggacgttgtaatttactacgtcgcttacgtcttactgttcgaccgaccggcctaacccggtnaccgtttgtacgtcgtccggttacgggcgggtaacgggacgtagccgtacggaccgtaccgtggacagtcgtacgacgtccgtcccgacccggtcgtacctaccgttcgttacccgttccccgtcccgtccttaccgacgttaccttacgtccgttacgtacccccggagggtccgggtaccgtcggaaccggtacgaccgtaacgngttacgcgatcgnncngtcgncancnngn

SEQ ID NO: 94354 - DNA, 475 bp, Homo sapiens
  misc_feature: GYAE6OF02JA2D1.29.85.H08.1.454.CMB.1.raw
  modified_base (216)..(216): a, c, t, g, unknown or other
  misc_feature (216)..(216): n is a, c, g, or t
  modified_base (315)..(315): a, c, t, g, unknown or other
  misc_feature (315)..(315): n is a, c, g, or t
  modified_base (434)..(434): a, c, t, g, unknown or other
  misc_feature (434)..(434): n is a, c, g, or t
  modified_base (460)..(460): a, c, t, g, unknown or other
  misc_feature (460)..(460): n is a, c, g, or t
  modified_base (462)..(475): a, c, t, g, unknown or other
  misc_feature (462)..(475): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgactcataatttatgatgtcattaagcggccctnaggggtccctgatcgcttctctggctccaagtctgcaacactgcctcctgaccatctctgggctcaggctgacgatgacggtgattattactgctgctnatttgcaggccacccgcactgtgatcgttcggcggaggaccagctacgaccgtctaggtcagctgacgctcgcccctcgtcactctcgtcccgccctcctctacgtactctactcgtgnggccggcgtcggcgtacggcgcgagngnnnnnnnnnnnnnn

SEQ ID NO: 94355 - DNA, 636 bp, Homo sapiens
  misc_feature: GYAE6OF02II0YC.29.85.H08.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggatcctgggctcagtcctgccctgactcagccctcgctcaggtcgtccgggtctccgtggacngtcagtcaccntctcctgcagtggaaccngcagcatgtcggtgttataacttgtctcgtgtaaccaacgaacaccgaggccgaccggtcccccgataccaattaactttactacgtatcgtacaacttaacgccggtccttcggacggggttcctgtacgtccgtcttcgtcgtcggaccttaccgaagttccgagacctaaacctcgtccgtacccgtccgtacgaccgtactcgtcggtcggccctacgacggtcgtacggtacgtagttcggacggttatacgtttacttacgtgactcggtcttacgttagtttcgacgtaccggccgtaacccggacttacggtagtacgtcgttaccggttacggggccggtaacggaccaacggtccgtacggtacccgtcgttacggcgtaacgtccgtagtaccgg

SEQ ID NO: 94356 - DNA, 611 bp, Homo sapiens
  misc_feature: GYAE6OF02IZN5N.29.85.H08.1.454.CMB.1.raw
  modified_base (227)..(227): a, c, t, g, unknown or other
  misc_feature (227)..(227): n is a, c, g, or t
  modified_base (298)..(298): a, c, t, g, unknown or other
  misc_feature (298)..(298): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatcctcctgcactggaaccngcagcgatgtcggtagttataactttgtctcctgtacaacaaccaccagcgacgccccgactcattattangatgtctatagccgcctacgacgggtcctgacgtcgtcttctcgtcgctacctaagtccgtcggactaaccacgtccgtcccttcccgtacgaccctacttccgtccgtacgggtcctacccggacggtcgtacggaacgtcggtacgggtacggttgttaagtttaacttaccgtcgtacttcggccttacgttagtttccggaccgtaccggtccctaacccggtctacgttcgtacgtacgtcggttccgggacggtacgggacaacgtccgacgtacccgttacggtacgaccgacgtccagtacccgg

SEQ ID NO: 94357 - DNA, 562 bp, Homo sapiens
  misc_feature: GYAE6OF02HA6KP.29.85.H08.1.454.CMB.1.raw
  modified_base (232)..(232): a, c, t, g, unknown or other
  misc_feature (232)..(232): n is a, c, g, or t
  modified_base (308)..(308): a, c, t, g, unknown or other
  misc_feature (308)..(308): n is a, c, g, or t
  modified_base (380)..(380): a, c, t, g, unknown or other
  misc_feature (380)..(380): n is a, c, g, or t
  modified_base (396)..(396): a, c, t, g, unknown or other
  misc_feature (396)..(396): n is a, c, g, or t
  modified_base (411)..(411): a, c, t, g, unknown or other
  misc_feature (411)..(411): n is a, c, g, or t
  modified_base (450)..(450): a, c, t, g, unknown or other
  misc_feature (450)..(450): n is a, c, g, or t
  modified_base (461)..(461): a, c, t, g, unknown or other
  misc_feature (461)..(461): n is a, c, g, or t
  modified_base (499)..(499): a, c, t, g, unknown or other
  misc_feature (499)..(499): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggactccgtgggctcagtctcgccctgactcagcctcgctcagtcgtccgggtctccgtggacagtcagtcacctatcctcctgcacgtggaaccngcagcgatggtcggtggttataactttgtctcgtcgtaccaacaacaccaggcgaccgccccgatccaattattangattgtactattacggccgtccctcgtacggggtccctagacgtctcttctctcgtctacagtctgacaacnctcgccctccagaccntcgtcgtcggctcgnggtctcgaacgtcgtacggtacgtgttacttaactcgtnccgtgtccttntacgtttcgacgtacgccctacctcgtacgtgtacgtntacggtccggacgggacggacgacgtcgacgtacccgttacgcgtcgacgtcgtacgtaccgg

SEQ ID NO: 94358 - DNA, 784 bp, Homo sapiens
  misc_feature: GYAE6OF02GUTTR.29.85.H08.1.454.CMB.1.raw
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatccgtgggctcagtctgccctgactcagcctcgctcagtgtccgggtctcctggacagtcagtccactatctcctgactacgtacggaaccagacacggacgtagtcggtcggttaggttaacttaacgtttcgtccttaccgtacggtaacccaaaccaacccgtacccgacgggaccggaccccgggtacccccccgtaacgtacctaagtttaaactttacgtacggtaacgttcgttacctaagttaaaccggcccggtaccccgtacgggtaccgggggttacccctaggtaccgttaccggtccttttaccgttcgtccggacctttacccgtaacggttccgtacgaacctaacgtacctccggtcccctacccgtaccgacctcgttccgtcggtcggtccctaccggtacggtccgtacggaacgtacgtacggacggttagttacttaacttccgtacgtacttcgtacgtactttacgttacgccgtaaccgtccgaacccgacttacggtagttaccttccggttcgggtttaccgggggaacccggggtaaccggtaaccgtaccgggttaccgtacccggttacccggttaccggtacggtaccctacggggtaccctaacggtacccgg

SEQ ID NO: 94359 - DNA, 598 bp, Homo sapiens
  misc_feature: GYAE6OF02J19MU.29.85.H08.1.454.CMB.1.raw
tcagatagagtactcacgaccggtgctcgatttagtatcactcagtcgcggggggggtctcaggaggcagcgctctggggacgtctccaccatggcctgggctctgctcctcctcacctcctcactcagggcacaggctcttgggcccagtctgccctgattcagcctccctccgtgtccggtctcctggacagtcagtcgccatctcctgcactggaaccagcagtgatgttgagtaattatcgactgtcctcccttggtaccaacaacaccagacacagtccaacaaacacatgatatacaatgtacaatacgtccgcctacgacgggtcctgacttcgttctacgtgtacctcccgtaagtctggacaacgtcggccggtcctacgtactacgaccctagttcctcgtacggacctccgaacgggtctaggaacggacgtacggaccttagtaacttagttagcggtactacgtcctactaagttacgttaatacgtacgtacgtagttacgtacggtttaagggtcgttacgggcgggtaacgcccgtaagtccgtggtaccgtccgtggttaccacggtaccgtacggtcccg

SEQ ID NO: 94360 - DNA, 603 bp, Homo sapiens
  misc_feature: GYAE6OF02F6UJK.29.85.H08.1.454.CMB.1.raw
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (473)..(473): a, c, t, g, unknown or other
  misc_feature (473)..(473): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacgaggactccgtgggctcagtctcgccctgactcagcctcgctcagtcgtccgggtctccgtggacngtcagtcaccatctctgcacgtcggaaccngcagcgtatcggtcggtgttatacttgtctcgtcgtacaacacaccagcgcgcccatcatatngntntcatacgcgcctcgacgggtccagactcgtcttctactcggtactacctcgtcgtcgactaactccgtacgtccctaccgtcgaccctacgtcgttccgtccggtccgtacccgtaggtcctacggtaacggtcgtacggttacggtattacgtttacgttacgtcgtaccgtnttaccgtcttacgttcgacgtcggtaccaccgcgttcgtacgtcgtacgttccggtacgggtacggaccgggtacacggttccgtacggtacccggttactaccggtcgtaccggtcgtaccggtaccgg

SEQ ID NO: 94361 - DNA, 568 bp, Homo sapiens
  misc_feature: GYAE6OF02GR8WU.29.85.H08.1.454.CMB.1.raw
  modified_base (226)..(226): a, c, t, g, unknown or other
  misc_feature (226)..(226): n is a, c, g, or t
  modified_base (299)..(299): a, c, t, g, unknown or other
  misc_feature (299)..(299): n is a, c, g, or t
  modified_base (329)..(329): a, c, t, g, unknown or other
  misc_feature (329)..(329): n is a, c, g, or t
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
  modified_base (384)..(384): a, c, t, g, unknown or other
  misc_feature (384)..(384): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctcgccctgactcacgcctcgctcagtgtccggtctcctggacagtcagtcaccatctcctgcacgtcgaaccngcagcgatcggtcggtgttatacttgtcctctacgtacaacaacaccaggccgacgccccgactcataattangtatgtcattacgccgcctcgacgggtccngactcgtcttcncgtgctacagtcagacacnctcgcctcctacgacctatctcgnggtctcgagtcngactntaggacgtntacgttactactcgtctagtctacgttagttcgacgtacgcccgacccgtagtacgtggttactacgttcccggttacggggaccgggtaacggaaccctaggtcccgttacggacccggttaccgtaccggtccacggtaccgttacgaaccccggg

SEQ ID NO: 94362 - DNA, 631 bp, Homo sapiens
  misc_feature: GYAE6OF02HQX7B.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcgtggtacagccgtggggggtccctgagactctcctgtgcagcctctggattcaagtttaatgtatttttccatacacgtggtccgtcaagcgtaccggggaaggtctggaggtggtctctcttattaatcgagtacggtgcttactactattctatcgacagtactctggttggaacgggtccgtaattccaccgtatccgtccagacgaacaaacaacaagtaccttaccctgttactctacgaactaaatacgaactagttcctaaggacgtaaggtacgaacgtacgacggccggttacttacgttaatttacgtttaggtagaaaccgaaaaggtagggtaaacgggacgtaagggtaacttaacggtttaagggttacggggttaccgttaggttttaacccggg

SEQ ID NO: 94363 - DNA, 852 bp, Homo sapiens
  misc_feature: GYAE6OF02IEYMC.29.85.H08.1.454.CMB.1.raw
  modified_base (822)..(822): a, c, t, g, unknown or other
  misc_feature (822)..(822): n is a, c, g, or t
  modified_base (845)..(845): a, c, t, g, unknown or other
  misc_feature (845)..(845): n is a, c, g, or t
  modified_base (849)..(849): a, c, t, g, unknown or other
  misc_feature (849)..(849): n is a, c, g, or t
tcagatagagtactcacgaccggtgctcgatttagtatcactcagtctgccctgactcagcctcgctcagtgtccgggtctcctggacagtcagtcaccatctcctgcactggaaccagccagcgatgtcggtggttactaactttgtctctggtaccaacaacacccgaggccgacggtcccccccgacttccgaattaaactttatgtaattcgtactaagtttaacggccggtccccttacgaccgggggttcccctaggacttccggtcctttcctacgtcggtcctaccaagttcgtacggcaaaccaccgttcggtcccgttcccccgtagtaacccgtaatcccgttacgttcgggtaccctccgtaaggtcccgttaggaaccgtacgttcgggaaccggggttgtaaaccgtttagtttaccgtacgtcccgttgaccgttccgtaagttttcgaccggtacggccccgtaacccgtacgtaccggtcggtacgtaacttccggggtttaccggaccggggtaacgggtaacccgaaaggtcccggtttacccgggtaaccccggtttaccggttaaccgggtccgtaaaccggttccgtaacccggtaaaccgggtcccgttaccccggtccccccgttaaccgggttcccgtaacccgtttccccggtttacccggttaccccccggtcccgtttaccccctaacggtaacccggttaacctttaccgtttaacgtaccggttacggtacgggtccgggttaccgttaccggacggtaacgggccgtaaccgtagtaaccgtgaatcgtancccgtagccagttcgcaggtccncganacg

SEQ ID NO: 94364 - DNA, 699 bp, Homo sapiens
  misc_feature: GYAE6OF02FRWEA.29.85.H08.1.454.CMB.1.raw
  modified_base (319)..(319): a, c, t, g, unknown or other
  misc_feature (319)..(319): n is a, c, g, or t
tcagatagagtactcacgaccggtgctcgatttagtatcactcagtcgcggggggggtctcaggaggcagcactctcgggacgtctccaccatggcctgggctctgctcctcctcagccctcctcactcagggcacaggatcctggctcagtctgccctgactcagcctcgctcagtggtcccggtctccgtggacagtcagtcaccatctcctgccacgtcggaaccagcgacgcgattcggtcggttagttataacgtttcgtcctcctacggtaccaacaaccacccgaggccgaccgcccccgatccataattangtatcgtactattaacggcggtaccctcgacgggttcctcgactccgtccttctccgtcgacctacccgaagttccgtacggtacctaaaccgtaccgtccggtacccctacccgtacggaaccctcttaccgtcggtacggggtaccctaccggtacggtccgtacgtaaccggtacgttacggtaccggttacgttaacgttaaccttacgttcgtaccgttgtacccttacgtacgtttaccgtaccggtacgttaccccgaaccgtaccgtaccgttacgttaccggttacgtaccggtaccgggaccggtacggaacccgtaacgtcccgtaccggtaccggtaccgttaccggtcgaccgtccgaccgtaccgg

SEQ ID NO: 94365 - DNA, 730 bp, Homo sapiens
  misc_feature: GYAE6OF02G9ZQE.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagttggactgagcgtggtttctgtgctatttaaagtgtcagtgtgagtgcagtctggtggagtcgtgggggagtcgtggtacgagccgtgggggtcctgagtactctcgtgtgcagcctcgtggtattacgtaagttatgtattttccatacagtcggtcgtacagtcgtacgggaggtctaggtacggtggtcttcgttcgttaatacgtcggaaggtacggtgtactactactatttcagttagtcgtaacgtccgtcgtacgggtcggaaacgggtccctaacgtttaaccgtaccgtacgttaccgtacctaaacggtaacggtaaacctaaacaaccggttaaactacccttaccgttacggttacttaccgttaacgaaccgttaaataccggtaaacttacggtacgtttaacggaacttaaacgggtagaacccggaacgtaacgggtcccggtttacctttaggttaacgtttacgtttaggtaaccggaaaccgttaaaagggaaggttaaacgggaccgttaaaggggttactaaacccggggtttaagggttaccggggttgttacccgggtttaaccggg

SEQ ID NO: 94366 - DNA, 607 bp, Homo sapiens
  misc_feature: GYAE6OF02GXQNL.29.85.H08.1.454.CMB.1.raw
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcacgcctcgctcagtcggtccggtctcgtggacagtcagtcaccatcctcctgcactcggaaccaggcagcgtatcggttcggtggttaataacttttgtctccgtggtaaccaacaacaccaggcgacggcccccgatcataatttangtactgtctaattagccgcctcgacgggtcccngactcgtctctcgtgctcgacgtctcggacaacactcgaccctcctacgtaccactcctcgtcggtcgtaccgacggccgtttcgacgtactacggtacgtgtattacttactgtcgtacgtctactgtttacgacgtacggccgtaaccgctacgtcgtacgtacgttcggttcgggtaacgggaaccgggtaccgtaacgggtaccgtccggttaccggttaccggtacggtacgaccggttaccgtaccggtaaccggg

SEQ ID NO: 94367 - DNA, 610 bp, Homo sapiens
  misc_feature: GYAE6OF02HEIMS.29.85.H08.1.454.CMB.1.raw
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
  modified_base (333)..(333): a, c, t, g, unknown or other
  misc_feature (333)..(333): n is a, c, g, or t
  modified_base (354)..(354): a, c, t, g, unknown or other
  misc_feature (354)..(354): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctctgcactggaaccagcagcgatgtcggtgtatacttgtctctagtaccaacacnccagccgacggcccccatcattacttangtatttcattacgccgtcctcgacgggtcctgatccgctttcncgtcgctcagtctgactaacnctcgccctcctgacctactcctcgtcgggtcctaccgaggtcctagaccgtagtacgggacggttagtactttacgttaccgtgtacctgtaccgttacgtatttccgggacgaaccggttcccgaacccgtcgtaaccgtttcgtacggtaccgtttaccggttcgggggacccggtaacggggtaacccctagggtcccgttaccggtaccccggttacgttacggtcctacggaccttaccggacggtccccg

SEQ ID NO: 94368 - DNA, 592 bp, Homo sapiens
  misc_feature: GYAE6OF02FLPF9.29.85.H08.1.454.CMB.1.raw
  modified_base (284)..(284): a, c, t, g, unknown or other
  misc_feature (284)..(284): n is a, c, g, or t
  modified_base (326)..(326): a, c, t, g, unknown or other
  misc_feature (326)..(326): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcacatctcctgcactggaaccagcagcatgtgtgtataattgtctctgtaccaacacaccagcgacgccccgatcataacttangatgtcattaacgcggccctcgacgggtcctgactcgcttcnctggctacgagtcgtcgacaactactcggtccctcccgtagaaccctacttccgtcgttcggggcccttaccgaggtcctacggaacgtacgtacggaacggttagttaacgtttaacttacgtgtcgttcgttaccttacgttagttcgacaccgggtaccaacccggtctacgtcgtgtaccgtcggttaccgggacgggtaacggtacccgtagttaccgtaccggtacccgttcgtaccggtacgacgtcgtacgtacccgg

SEQ ID NO: 94369 - DNA, 438 bp, Homo sapiens
  misc_feature: GYAE6OF02G73RL.29.85.H08.1.454.CMB.1.raw
  modified_base (291)..(291): a, c, t, g, unknown or other
  misc_feature (291)..(291): n is a, c, g, or t
  modified_base (417)..(438): a, c, t, g, unknown or other
  misc_feature (417)..(438): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgacccatctctcgggcctccaggctgacgatgacggtgattattactgctgctcatttgcaggcacccgnactgtgatcgttcggcgagggacaagctgaccgtctaggtcagctcaaggcctcgccccctggtcacttctcgttccccgcctctcagtactctatctgagcggctggctaacggcgacactaggnnnnnnnnnnnnnnnnnnnnnn

SEQ ID NO: 94370 - DNA, 595 bp, Homo sapiens
  misc_feature: GYAE6OF02GAD8A.29.85.H08.1.454.CMB.1.raw
  modified_base (477)..(477): a, c, t, g, unknown or other
  misc_feature (477)..(477): n is a, c, g, or t
  modified_base (506)..(506): a, c, t, g, unknown or other
  misc_feature (506)..(506): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatggtcggtgttataacttgtctcctcgtaccaacaaccaccaggcgaccggcccccgactccattaatttatcgtatcgtactaacgttaacgccggtccccgtacgtacgggggttccctaggactcgtcttctcgtcggtcctccgtaacgtcgtcggaccaacctacgtccgaccctccctcgaccctatccgtcgtcgggtcctccgaggcctgtacgagtcggtacgtgtacttagtactntctgtctacgtgttcgcgtacgccacccnctacgtgtacgtacgttcgttacgggaccgggacggtaaccgacgtcggtaacgtacccgtacgtacggtccacgtccgtacgtaccgg

SEQ ID NO: 94371 - DNA, 580 bp, Homo sapiens
  misc_feature: GYAE6OF02GA7WJ.29.85.H08.1.454.CMB.1.raw
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (332)..(332): a, c, t, g, unknown or other
  misc_feature (332)..(332): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (383)..(383): a, c, t, g, unknown or other
  misc_feature (383)..(383): n is a, c, g, or t
  modified_base (428)..(428): a, c, t, g, unknown or other
  misc_feature (428)..(428): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggatccgtgggctcagtctcgccctgactcagcctcgctcagtcgtccgggtctcctggacagtcagtcaccntctcctgcacgtggaaccngcagcatgtcggtgtatacttgctctcgtaccaacacaccgaggcgacgccccatcatattngatntacatacgcgcctgacgggtcctagactccgtcttcnctggcctacagtctgacaanctcgcctcncgactntctcgtacgcctccgngtccgtcgagtagtcgtaacggtcgttattacgttacgctcggtntaccgttactacgttcgaccgtacgacccgtaaccgtcgttaccgtaggtccgtacgttccgggtaccggggtacgggaaaccgtacccgtaaggtaccgtaccggttacccggtccgttaagggtccgtacccgtacggtacggtaacccg

SEQ ID NO: 94372 - DNA, 595 bp, Homo sapiens
  misc_feature: GYAE6OF02HTVTW.29.85.H08.1.454.CMB.1.raw
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttatactttntctctgacacacaccagcgacgccccacncatattngntncatacgcgcctcgtcggtcctgactcgtcttctctcgcctacgagtcgtgacaacnctcgccctccncgacctacttccgtcgtcgggtcctcggacggtctacggacgtagtcggtacggttatacgtttaactacgtcgtacgttcgtacctttcgttacgtttcgaccggtaccggaccctaacccggactacgttcgttacgtaccgtttccggtacgggaccggggtaacggtaacccgtacgttaccgtaccggtacccgttaccggtacggtacgtaccggtaccgtacggtaacccgg

SEQ ID NO: 94373 - DNA, 564 bp, Homo sapiens
  misc_feature: GYAE6OF02JNBMJ.29.85.H08.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (300)..(300): a, c, t, g, unknown or other
  misc_feature (300)..(300): n is a, c, g, or t
  modified_base (449)..(449): a, c, t, g, unknown or other
  misc_feature (449)..(449): n is a, c, g, or t
  modified_base (454)..(454): a, c, t, g, unknown or other
  misc_feature (454)..(454): n is a, c, g, or t
  modified_base (489)..(489): a, c, t, g, unknown or other
  misc_feature (489)..(489): n is a, c, g, or t
  modified_base (496)..(496): a, c, t, g, unknown or other
  misc_feature (496)..(496): n is a, c, g, or t
  modified_base (546)..(546): a, c, t, g, unknown or other
  misc_feature (546)..(546): n is a, c, g, or t
  modified_base (552)..(552): a, c, t, g, unknown or other
  misc_feature (552)..(552): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggactccgtgggctcagtctcgccctgactcacgcctcgctcgagtcggtccggtctccgtaggacngtcagtcacatctcngcagtcgaaccngcagcgatgtcggtgttactactgtctcgtcgtaccaacaacaccgaggcgacggccccatctatattangatcgtcacgttagccgtccgtacgacggtcctagactcgtctctcgtcgcctcaacgtcgtcgacaactccgcgtcccgtacctcgaccgtactctcggtcggactccgagtcacggacgtcgtacgtacgtacgtaacgttccttanccgtntacgtcttaacttcgtacgacgtaccgcctaccgntacggtntacgtctacggcggtaacggacgtacggctcgtacggtccgtacgtaccncgtacnccgtacgtaccg

SEQ ID NO: 94374 - DNA, 688 bp, Homo sapiens
  misc_feature: GYAE6OF02IDFRJ.29.85.H08.1.454.CMB.1.raw
  modified_base (236)..(236): a, c, t, g, unknown or other
  misc_feature (236)..(236): n is a, c, g, or t
tcagatagagtactcacgaccggtgctcgatttagtatcactcagtcgcggggggggtctcaggaggcagcactctcgggacgtctccaccatgcctgggctctgctcctcctcagcctcctcactcgagggcacaggactccgtgggctcagtctcgccctgactcacgccctcgctcagtcgtccgggtctccgtggactagtcagtccaccatcctcctgcacgtacgaaccngcaggcagttcggtacggttagttaacttaactttcgtcctccgtacggtaaccaactaaccaccgaggaccgacccggccccgtactacgtaatttaacgttagcgtattcgtactaaacggtttaacgcccggtacccttacggaccggggttccctgtactccgtccttcgtccgtcggtcctacgtacgtccgtaggaccaaactccgtccgtaccctccgtacgacctcttccgtccgtacggccttcgacgtcgtaggacgagtcgggtaacgttagttattacgttacgcgtcttgtacttacgttagtcgaccgaccgtccgacccctgtaccgttgtccgtacgttcggttaccgggaccggtaaccggtaacctaccggtaccgttaccgggtaccccgttacggtaaccgggttcgacccgttaccggacggttacccggg

SEQ ID NO: 94375 - DNA, 500 bp, Homo sapiens
  misc_feature: GYAE6OF02GS9ZA.29.85.H08.1.454.CMB.1.raw
  modified_base (322)..(322): a, c, t, g, unknown or other
  misc_feature (322)..(322): n is a, c, g, or t
  modified_base (486)..(489): a, c, t, g, unknown or other
  misc_feature (486)..(489): n is a, c, g, or t
  modified_base (491)..(500): a, c, t, g, unknown or other
  misc_feature (491)..(500): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcagggggtccctgatcgcttctctggctccaagtctggcaacactgccctcctgaccatcctctgggctccgaggctgacgatggacggtgatttattactgctgctnatttgcaggcacccgcacgtgtgacttcgttcgggcggagggaccaaggcctcgacccgtccgtacggtcagcctacgaggcctcgcccctcggtccacttccgtccgttccccgccctcctcacgtctctatcgtgcggcgggctcggacgtaggcgcagagnnnncnnnnnnnnnn

SEQ ID NO: 94376 - DNA, 732 bp, Homo sapiens
  misc_feature: GYAE6OF02IDROI.29.85.H08.1.454.CMB.1.raw
  modified_base (239)..(239): a, c, t, g, unknown or other
  misc_feature (239)..(239): n is a, c, g, or t
  modified_base (434)..(434): a, c, t, g, unknown or other
  misc_feature (434)..(434): n is a, c, g, or t
  modified_base (594)..(594): a, c, t, g, unknown or other
  misc_feature (594)..(594): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggactcctgggctcagtctcgccctgacctcacgcctcgctcagtcggtccggtctccgtggactagtcagtccaccattctccgtgctacgtacggaaccngcacggcgagtcggtcggttagttaacttaacgtttcgtccttccgtacggtaaccctaaacaccgaacccgacgggtaccggacccggtaccccccggaacttacgtaacgtttaaactttacgcgtacttcgtactaacgtttaacggcccggtacccgtcggaccggggttcctagtacgtccgtccttccncgtcgtcctacgacgttcgtcggacctaacctccgtaccgtccctaccgtacgacctacttccgtcgtcgggtcctcgacggtcgtcgaacgtagcgtacgttagtactttaacgtctcggacttcgtccgtttagtacgttcggaacgtccgtaccccnccggtacctaccgttcgtaaccgtccgttaccgggttacccgggaccggggtaaccggaacccgttaacgggtcccgttccgggtaccccgttacggttaccggttacccggtaccgtccgtaccggttaaccccggg

SEQ ID NO: 94377 - DNA, 751 bp, Homo sapiens
  misc_feature: GYAE6OF02FG8CG.29.85.H08.1.454.CMB.1.raw
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgccactggaaccagcagccgatgtcggtggtataactttgtctctggtaccaacaacaccaggcgacgcccccgatccataatttatgattgtctaattaacggccggtacccctcggtacgggggtccctggacttccggctttccgtctcggtcctacccgtaacggttcctacggggacctaaaccgtaccgttccggtacccccttacccctacgtaacccctattcccgttaccggttccggggtcccttacccggacgggtcccgttacgggaacccggtagttccggggtaaccgggtttaggttaacgtttttaacttaccgttcggtccttacggtcccttacgttaagtttttacggaccgtaacgggtacccctaaccccggtccttaaccgttgggttaccgttaccgttccggtttacccgggggacggggtaaccggggtaaccctaacgggttcccgttaaccggtaccccggttaccggttaccgggttacccgtaacggtcccgtaccggtaaccccgggg

SEQ ID NO: 94378 - DNA, 614 bp, Homo sapiens
  misc_feature: GYAE6OF02IAQJN.29.85.H08.1.454.CMB.1.raw
  modified_base (238)..(238): a, c, t, g, unknown or other
  misc_feature (238)..(238): n is a, c, g, or t
  modified_base (306)..(306): a, c, t, g, unknown or other
  misc_feature (306)..(306): n is a, c, g, or t
  modified_base (589)..(589): a, c, t, g, unknown or other
  misc_feature (589)..(589): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (600)..(602): a, c, t, g, unknown or other
  misc_feature (600)..(602): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggtccctcgacggggtccctgatcgcttcnctgctcagtctgcaacactgcctcctgaccatctcgtgggctaccaggtctgaccgtatcggacggtntatttacgttactgctgtcttcgagtttgacgtacggcccaccgctacgtgtacgtactccgggtttcgggacggaaggggaccctaaaggtcttaccggtacccggttacgtaccggtaccgacgtacctaccgtaacggtccgtccggtcccccgttcggtaccctaccgttcccgttccgttcccccgtaccccgttccctacgaccgttacttaccttacgtcgttacggcgggtaccgggccgttacggaccggaacggtacgacgtacgtaggaccncgacngngacnnncgngngngntnc

SEQ ID NO: 94379 - DNA, 762 bp, Homo sapiens
  misc_feature: GYAE6OF02HLSY5.29.85.H08.1.454.CMB.1.raw
  modified_base (714)..(714): a, c, t, g, unknown or other
  misc_feature (714)..(714): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtcccgggtcctcgtacggacgtacgtacgtacgtcccgtaccgttccttaccgtcgtacgtacgggtaccggaaaccgtacgacggtaggtacggttacgggttgggtacgttaccgtttaaaccgttaaccggttcgttacccgttaccggttaccggtaaccgacgaccgaccccgaccccgacggtaccaaccgaccccgaacccctaactccgtagtacgtttactttacggaccgttacgtaacgttaccgtacccggtacctaccgggtaccggttcctacggtaccgtccgttccgttccgtcggtaccggtaacgtacgttccggtacgtacgtacgtaccgacccggtcccgtaccgtacgttaacgttacgtccggttacgggaccgtccctaaaccgtacgtacgtagggaaccggaacggtacgtacgtaaagttaattacgtttgaccgacggtactcgtaacgtaataacgtaacggaacgtactaacgttactatcgtacgaacgtacgacgtaacgtacncctacggtactacgactaccgacgaccgtaacccctacgtatccgtac

SEQ ID NO: 94380 - DNA, 739 bp, Homo sapiens
  misc_feature: GYAE6OF02HGTAK.29.85.H08.1.454.CMB.1.raw
tcagatagagtactcacgaccggtgctcgatttagtatcactcagtcgcggggagctctgggagaggagccccagccctgagattcccaggttgtttccattcggtgatcagcactgaacacagagaacgcaccatggagtttggactgagctgggttttccttgttgctattttaaaggtgtccagtgtgaagtgcagctggtggagtcgtgggggagtcgtggtacaggccgtgggggtccctgagactctccgtgtgcagcctcgtgattactaagtttatgttactttttacattacacgtcgggtccgtacgaacgtcggtaccgggggaaggtcgtgggaggttgggttcttcgttacttaagttaagtacgtaggtacggttgtacgtaactactactttactactcgacacgtaccttcgtaggtacggaacgggtccctagtttccaccctacttacctacaagaacgaaccaaacaaacgtaaaccgtaccttcccgttagtacttaccgtagaactaaagtacgtaaacgacgtaccgtaggaacggtaaacgtacgaaccgtaaccggaacggttaccggttacctttaacgttaacgttttaaggtttacggtaaacggtaaaccgtaaaaaggggtaacgaaacgggttaacgtaacggggttaacgttaaccgggtttaaacgggggtttaccggggttaccggtttaccggtttaaaccgggg

SEQ ID NO: 94381 - DNA, 692 bp, Homo sapiens
  misc_feature: GYAE6OF02G7TGT.29.85.H08.1.454.CMB.1.raw
  modified_base (309)..(309): a, c, t, g, unknown or other
  misc_feature (309)..(309): n is a, c, g, or t
  modified_base (499)..(499): a, c, t, g, unknown or other
  misc_feature (499)..(499): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcaacaggatccgtgggctcagtctgccctgactcagcctcgctcagtcgtccggtctccgtggacagtcagtcaccatctcctgcacgtcggaaccagcagcgatgtcggtgttattaacttgtctcgtacgtaccaactaacaccgaggcgaccggccccactcgaattaatttangtactgtctagttaacgcgtcctacggacggtcctgtacgtcgtacttctcgtcggtcctacgacgttccgacggtacctaaccgtccgttaccgtccccgttacccgtacggtaccctacgttcccgttcggtaccgggtccttacccggacgtccgtacggtaccgtagggttaccgtaacggggttnttaacgtttacgttacgttcggtaccgttacggttccttacgtttacgtttacgcccggttaaccgacccgttaaccccgcgtaaccgttcgtaccgtacgtttccggttaccggggaaccggaaccggtaccgtaaccgtccggttaccgtaccggttacgtacccggtacgacgttcccgacggtacccgg

SEQ ID NO: 94382 - DNA, 573 bp, Homo sapiens
  misc_feature: GYAE6OF02F8GHX.29.85.H08.1.454.CMB.1.raw
  modified_base (198)..(198): a, c, t, g, unknown or other
  misc_feature (198)..(198): n is a, c, g, or t
  modified_base (270)..(270): a, c, t, g, unknown or other
  misc_feature (270)..(270): n is a, c, g, or t
  modified_base (553)..(553): a, c, t, g, unknown or other
  misc_feature (553)..(553): n is a, c, g, or t
  modified_base (555)..(556): a, c, t, g, unknown or other
  misc_feature (555)..(556): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
  modified_base (568)..(569): a, c, t, g, unknown or other
  misc_feature (568)..(569): n is a, c, g, or t
  modified_base (571)..(573): a, c, t, g, unknown or other
  misc_feature (571)..(573): n is a, c, g, or t
tcagatagagtactcacgaccggtgctcgatttagtatcactcagtctgccctgactcagcctcgctcagttgtccgggtctcctggacagtcagtcaccatctcctgcactggaaccagcagcgatgtcggttggttataacttttgtctcctggtaccaacaacacccaggcgacggccccccgatcataatttangatgtcattaagcggccctcaggggtccctgactcgcttctctggctccaagtctggcaacactgccctccngaccatctctgggcctccaggctcgacgatggacggtgatttatactgtctgactctagtttgctaggcccacccggacaccgtggtactacttccggttcggggacgggaacgggaaccaaggtcctacggtacccgtccgtacggtcacgctacgaacggtcctcccgtccccttcggtacctaccgttccgttcccgttccccgccccttccgtacctaccgttaccttcgtacttaccgaggacggccgggtcgtcgggaccgaaggcgtacagtacgncnnancgatcncgcnncnnn

SEQ ID NO: 94383 - DNA, 635 bp, Homo sapiens
  misc_feature: GYAE6OF02GTFUQ.29.85.H08.1.454.CMB.1.raw
tcagatagagtactcacgaccggtgctcgatttagtatcactcagtcgcggggagctctgggagaggagccccagccctgagattcccaggtgtttccattcgatgatcagcactgaacacagagaacgcaccatggagtttggactgagctgggttttccttgttgctattttaaaaggtgtccagtgtgaagtgcagctggtggagtctgggggagtcgtggtacagcctggggggtccctggagactctcctgtgcagcctctggattcaagtttaatgtattttcatacactgggtccgtcgaagcgtaccggggaggtcgtggagtggtctctcttatatcgagacggtgctactactattcatgcagtactcgtgtaggaacgggccgtattaccgaacctactcctaccgaaggaacgaaccaaacctaaacgaaacgttaacccttccgttagtactcgtagaacctaaagtcgaaactaggtacgtaggaacggtaacgtcggaaaccgacgtaacggtccggtactttacgttaatttacggttagtaagtaaacgaaaacggtagggaaacggacggtaagggtacttaaccgggtaagggttcggggttaccggttaaccggg

SEQ ID NO: 94384 - DNA, 703 bp, Homo sapiens
  misc_feature: GYAE6OF02FYF1O.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcttgggttttccttgttgcttattttaaaggtgtccagtgtgaagtgcagctggtggagtcgtgggggagtcggtggtacaggtccggtggggggtccctggacgacctcctccgtgtcgcagcctcgtggtattactaagtttatgttacttttccaatactacgtcggtccgtacacggtccgtaccggggaggtcgtgggtagttcggggttcttcgttacgtttaagttaacgtcggtaacggtaccgggttgtaccgttaaccttacgtactttcttaactcgcgtaacgtacttcgtggtacgggacgggtccgtatttccaacctacgttctaccgaagacgaaaccaactaaaccgtacgtacccttcctagtacttcctagactaacgtagaacctagtacgaggtaaagaaggtacgaccgacgtacgggtccgttactttacgttatttaggttagtacggaaacgtaaaagggtaaggaacgggtacgtaagggttacctaacgggttaagggtccgggtttaccggttcggtttaaccgg

SEQ ID NO: 94385 - DNA, 568 bp, Homo sapiens
  misc_feature: GYAE6OF02HX844.29.85.H08.1.454.CMB.1.raw
  modified_base (290)..(290): a, c, t, g, unknown or other
  misc_feature (290)..(290): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (499)..(499): a, c, t, g, unknown or other
  misc_feature (499)..(499): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcacatctcctgcactggaaccagcagcgatgtcggtggttatactttgtctctgtaccaacacaccaggcgacgccccgatcatattangatgtcataagcgcctgacgggtcctgattcgcttctcgtgcctcaagtcgtgacacacgtcnccttccngaccnctctcgtcgccgtccaggtctacggacgagtacgacggttacaacgtttattaacgcgtaccgtgccgttactacgttttcgacgtacggaccctacccggataccgttgtaccgtacgtttccggtaccgggngggtaaccgggaacctaacggtcgtaccggtacccgttacgtacgggtcacggtcttacggaacccggg

SEQ ID NO: 94386 - DNA, 701 bp, Homo sapiens
  misc_feature: GYAE6OF02IK2SG.29.85.H08.1.454.CMB.1.raw
  modified_base (176)..(176): a, c, t, g, unknown or other
  misc_feature (176)..(176): n is a, c, g, or t
  modified_base (236)..(236): a, c, t, g, unknown or other
  misc_feature (236)..(236): n is a, c, g, or t
  modified_base (448)..(448): a, c, t, g, unknown or other
  misc_feature (448)..(448): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatcctgggctcagtctgccctgactcagcctcgctcngttcggtccgggtctccgtggacagtcagtccacctattcctcctgacacgtaggaaccngacgacgcgtagtcggttcggttaggtttaacttaacgttttcgtccttccgttacggtaaccaaaccgaacctaccccgaggaccggacccggaccccccgtacgtacctaactttaacttttacgtagtactacgttacgtaacgttacgaccggtcccttacggaccgggtcctacgtactcgtacttctcgtcgtactactacgttcncggaccaactacgtccgtcctacccgtacgacctatccgtcgtcggacctcgacggtcgtacgacgtagtacggacgttagtaactttagttacgtcgcgttgtccttagttacgttcgacgtaccgaccctacccggtctaccgttagtacgttaccgttacggttaccgggacggttaaccgggaccttaaccggtccgtaccggtacccgttaccggtacggtaccgaccgtaccgttaccgtaacccgg

SEQ ID NO: 94387 - DNA, 564 bp, Homo sapiens
  misc_feature: GYAE6OF02FNLUW.29.85.H08.1.454.CMB.1.raw
  modified_base (225)..(225): a, c, t, g, unknown or other
  misc_feature (225)..(225): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatcctgggctcagtctgccctgactcagcctcgctcagtcgtccggtctcctggacagtcagtcaccatctcctgcactggaaccngcagcgatgtcggtgttataacttgtctctgtaccaacaacaccaggccgacggcccccgactcataattatgtatgtcatagcgcctcgacggggtcctgactcgtcttctctcgctcagtcngacacnctcgcctccagacctntctcgtcggtctcgagctgacgtagtcggacgtgtattcttactgtctgtctcttacttcgacgtacgtccacccgtctacgtcgtacgttacgttccggtaccggggtccggggaacggtacccgtaacgggtccgttaccgggtacccggttaccgtaccgggttacaccggtaccgtacggtaacccggg

SEQ ID NO: 94388 - DNA, 741 bp, Homo sapiens
  misc_feature: GYAE6OF02IQH6G.29.85.H08.1.454.CMB.1.raw
  modified_base (246)..(246): a, c, t, g, unknown or other
  misc_feature (246)..(246): n is a, c, g, or t
tcagatagagtactcacgaccggtgctcgatttagtatcactcagtcgcgggggggggtctcaggaggcagcactctcggggacgtctccaccatggcctgggctctgctcctcctcagcctcctcactcgagggcacaggactccgtgggctcagtctcgccctgactcgacgcctcgctcgagtcggtccgggtctccgtaggacagtcagtccacctatcctcctgcctaactacgggaaccngacacggcgtagtcggttcggtaggttaacttaacgttttcgtcttccgtacggtaaccaaaccaaacctacccgacgggtccggacccggaccccccgtacgtacctaaacgttaactttagtaggtacttacggtactaacgttaaacgggccggtaccctcgggtaacggggttcccgtaggtacgtccgtccgtttccgtccgttcggtaccttaccgaacggttcgtacggacctaaaccgtaccgttccggtcccttacccgtacggaacccttacgttccgtttaccgggtccgggtacccttccggaacggtccgtaacggacggtacggtcggttaacggttgtaactttacgtacgtcggccttgtcttcttagttcgcgtacgcccgaccgtctacgtcgtacgtacgttcggtaccggggacggaaccgggtactcggtaccgtacggtaccgtcggtacgtacgacgttccgtacgtcccgg

SEQ ID NO: 94389 - DNA, 545 bp, Homo sapiens
  misc_feature: GYAE6OF02FX8WW.29.85.H08.1.454.CMB.1.raw
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
  modified_base (276)..(277): a, c, t, g, unknown or other
  misc_feature (276)..(277): n is a, c, g, or t
  modified_base (281)..(281): a, c, t, g, unknown or other
  misc_feature (281)..(281): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctgctcagtgtccggtctcctggacngtcagtcacatcctctgcacgtgaaccngcagcgatcgtgtgtatacttgtctctgtacacacacagcacgcccatcatatgnntgtnatagcgtcctgacggtcctgactcgtctctctcgctcagtctagacacncgtcncctcgtanacctatcgtcgacggtcctaccgagtcgtcgaccgtagtcggtacggtagttactttacgtactcgtacttcggtaacctcgttaacgtttcgacctacgggtaccctacccgtacgtacgttagtcgttacgtcggtaccgggacggacggtaaccacggtcctaccggtaccgtacggtcgactacggtctacgtaccgg

SEQ ID NO: 94390 - DNA, 751 bp, Homo sapiens
  misc_feature: GYAE6OF02HPVSS.29.85.H08.1.454.CMB.1.raw
  modified_base (189)..(189): a, c, t, g, unknown or other
  misc_feature (189)..(189): n is a, c, g, or t
  modified_base (212)..(212): a, c, t, g, unknown or other
  misc_feature (212)..(212): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacgaggatccgtgggctcagtctgccctgactcacgcctcgctcagtgtccgggtntcctggacagtcagtcaccatcncctgcatggaaccagcagcgatgtcggtgtactattgtctcgtgtaccaacaacaccgaggcgaccggcccccgactacaacttaaatttacgaggtacttacgtctaaagttacggccggtacccgtacgaaccgggggttccctaggtactaccggtccttccgtgtacggtcctacgtaaacggtcgttacgggacctaaaccgtacgtccggtacccttcccgtacgaaccgtaacgttccgttaccggttcgggacccttaccggtacgggtaccgtacggtaaccgtaacgttcgggtaacccggtttaagttaaactttaaccgttaacggttcgtaaccgtcgttaccgttaccgttacgttttaccgtcggaaccggtacccgtccccgtaacgtaccggttacgtacgttaccgtttccgggtttaccggggaaccgggtaaaccgggtaacgtaaccggttacccggtaccggttacccggttacccggttacggtaccgtaacgtacccggttaacgtaacccgggg

SEQ ID NO: 94391 - DNA, 578 bp, Homo sapiens
  misc_feature: GYAE6OF02GJHGG.29.85.H08.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
  modified_base (293)..(294): a, c, t, g, unknown or other
  misc_feature (293)..(294): n is a, c, g, or t
  modified_base (359)..(359): a, c, t, g, unknown or other
  misc_feature (359)..(359): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtcccggtctccgtggacngtcagtccaccatctcctgacacgtggaaccngcagcatgtcggtgttatacttgtctctgtaccaacacaccagcacggccccatcataacttannatgtacatagccgcctcgacggtcctgactctctctctcgctacagtctgacacgctcgcctacncgacctactcgtcgcgtctcgacgctacgacgtacgtagtacggtagttaacttacgttacgtcgtacgtcgtcctattagtttcgacgtacgtccacccgtctacgtgtcgtacgtccggttaccgggacgggtaaccggtaccgtaaacggtccgttaaccgggtacccggttacccggttaggacccgtaaccggttacccgtaacggtaacccgg

SEQ ID NO: 94392 - DNA, 770 bp, Homo sapiens
  misc_feature: GYAE6OF02HH8Q7.29.85.H08.1.454.CMB.1.raw
  modified_base (177)..(177): a, c, t, g, unknown or other
  misc_feature (177)..(177): n is a, c, g, or t
  modified_base (558)..(558): a, c, t, g, unknown or other
  misc_feature (558)..(558): n is a, c, g, or t
tcagatagagtactcacgaccggtgctcgatttagtatcactcagtcgcggggagctctgggagaggagccccagcccctgagattcccaggtgttccattcggtgatcagcactgaacacagagaacgcaccatggagtttggactgagctggtttccttgtgctatttaaaggtntcctagtgtgaagtgtcagtctggtggtagtcgtggggagtcgtggtacacgcgtgggggtccctggacgtactctccgtggtcgcacgtccgtcgtggattaccgtaagttttaagtcgttaactttttccgaacttactacggttaggtcccgttacgaaacggtccggtaccggggtaagggttctaggggtacgggtcgggtttcctacgttaccgtttaattacggttacggaacgtcgggttcgtacttaaacctaacgtattacctagttcgacgtattacgtactgggacgtaacggggtccctaagttccaacctattccaccgtagaacgtaacctaaacaacggtaaccgttactcccggttaattaccncgttaccgaaacttaaacgtataacccgtacggttacgtacgtaaaccgggtaagtacccgtaaacgaaccggtaacggtccgttacgttttaaccaggttttcgttaaggtaaccggtaaaccgtaaaaggggtaaccgaagggttaacccgtaagggtaacgtttaccggttaacgggggttccggttacggttaaccggtttacccggg

SEQ ID NO: 94393 - DNA, 579 bp, Homo sapiens
  misc_feature: GYAE6OF02HVUFN.29.85.H08.1.454.CMB.1.raw
  modified_base (185)..(185): a, c, t, g, unknown or other
  misc_feature (185)..(185): n is a, c, g, or t
  modified_base (229)..(229): a, c, t, g, unknown or other
  misc_feature (229)..(229): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
  modified_base (562)..(562): a, c, t, g, unknown or other
  misc_feature (562)..(562): n is a, c, g, or t
  modified_base (564)..(565): a, c, t, g, unknown or other
  misc_feature (564)..(565): n is a, c, g, or t
  modified_base (567)..(568): a, c, t, g, unknown or other
  misc_feature (567)..(568): n is a, c, g, or t
  modified_base (570)..(574): a, c, t, g, unknown or other
  misc_feature (570)..(574): n is a, c, g, or t
  modified_base (576)..(579): a, c, t, g, unknown or other
  misc_feature (576)..(579): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtgttatacttgtctcctgtaccaacacaccagcgacgcccccgatcataattangatgtcattaacgcggccctgaggggtccctgactcgcttctcnggtctacaagtctcggcaaaccgctccgcccttccgacgaccctattccgtcgttgggcctaccgaaggtcgacgacgtacttcggaacggtgtaattactttacgngtcntacgtctnttgaccgcggacctacccgctatcggtatacgtcgttcgggaacggaggaccctagccgtcgaccgtactagtaccagtcgcgaacggtccgtcccgtaccccgtggtaaccacgttccttcccgtacccctaccctcgtacctacgtaccttacttaacgtcgtaacgcgggccggtcgtacgggtacggaaacggcccgtagaacgtcgacncnncnncnnnnngnnnn

SEQ ID NO: 94394 - DNA, 557 bp, Homo sapiens
  misc_feature: GYAE6OF02IH80A.29.85.H08.1.454.CMB.1.raw
  modified_base (297)..(297): a, c, t, g, unknown or other
  misc_feature (297)..(297): n is a, c, g, or t
  modified_base (433)..(433): a, c, t, g, unknown or other
  misc_feature (433)..(433): n is a, c, g, or t
  modified_base (468)..(468): a, c, t, g, unknown or other
  misc_feature (468)..(468): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcgtgttataactttgtctctggtaccaacaacacccaggcgacgcccccgatcattaattangatgtcattaacgcgcctcgacggggtcctgatcgcttctcgtcgctaccaagtctggacaactacgtcgtcctccctagaccctatccgtcgtcgggcctccgaggctggacgatcggacgtatatttattacgngactgctactagtttcgacgtacggaccacccgtnaccgttgtagacgttccgttcgggacgggaccggtaaccaacgtccgttacgcccggttacgtacggttaccacgtcctacgtaaccgg

SEQ ID NO: 94395 - DNA, 582 bp, Homo sapiens
  misc_feature: GYAE6OF02GJ6RQ.29.85.H08.1.454.CMB.1.raw
  modified_base (231)..(231): a, c, t, g, unknown or other
  misc_feature (231)..(231): n is a, c, g, or t
  modified_base (373)..(373): a, c, t, g, unknown or other
  misc_feature (373)..(373): n is a, c, g, or t
  modified_base (470)..(470): a, c, t, g, unknown or other
  misc_feature (470)..(470): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctcgccctgactcagcctcgctcagtcgtccgggtctccgtggactagtcagtcacctatctctgctacgtcggaaccngcagcgatggtcgtgttatacttgtctcgtacgtaccaacaacacctaggcgaccggcccccatcaattacttatcgatgtcaatacgccgcctcgacgggtcctgactcgtctctcgtcgctcgaacgtctacggacaacncgtactcctctcgtacctacgtcgtcggcggtcctaccgacgtccgtagtacgagtcggtaacggtattacttacgttacgtcgtacgcgttacgtnttaacgttcggctaccgggacctaccgtctaccgtggtactccgtcgttaccgggacggacgaaccgacgtccgtacgacccgttcggaccgtcgacgtcctacgtacccgg

SEQ ID NO: 94396 - DNA, 154 bp, Homo sapiens; identical to SEQ ID NO: 93449
  misc_feature: GYAE6OF02FMLMD.29.85.H08.1.454.CMB.1.raw
  modified_base (150)..(154): a, c, t, g, unknown or other
  misc_feature (150)..(154): n is a, c, g, or t

SEQ ID NO: 94397 - DNA, 570 bp, Homo sapiens
  misc_feature: GYAE6OF02GKOUZ.29.85.H08.1.454.CMB.1.raw
  modified_base (389)..(389): a, c, t, g, unknown or other
  misc_feature (389)..(389): n is a, c, g, or t
  modified_base (418)..(418): a, c, t, g, unknown or other
  misc_feature (418)..(418): n is a, c, g, or t
  modified_base (522)..(522): a, c, t, g, unknown or other
  misc_feature (522)..(522): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagccgtggggggtcccctggacgactctcctgtgcagcctctggattcaagttttaatgtatttttccattacacttgggtccgtcaagctccgggggaaggtctgggagtgggtctctacttattaagtcgagacggtgctactacattctatgcagactntgtgaagggcgattcgactatctccaagnaacaaacaacaagtactcctgtactctagactaaatgaactagtactagagtaagtcggaacaacgagccgtcttacgtattattggttacgaactaaaaaggnggaacgacggtaggacttacggtaaggtggggttacgtcggtttaacg

SEQ ID NO: 94398 - DNA, 623 bp, Homo sapiens
  misc_feature: GYAE6OF02HVPEQ.29.85.H08.1.454.CMB.1.raw
  modified_base (224)..(224): a, c, t, g, unknown or other
  misc_feature (224)..(224): n is a, c, g, or t
  modified_base (266)..(266): a, c, t, g, unknown or other
  misc_feature (266)..(266): n is a, c, g, or t
  modified_base (291)..(291): a, c, t, g, unknown or other
  misc_feature (291)..(291): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctccgtggacagtcagtcaccatctcctgcactggaaccngcagcatggtcgtagttataacttgtctcgtgaccaacaacnccagcgacgccccgatcataattangatgtctagttaagccgtccttacgacggggttccctgactcgtcttctcgtaggcctacgaacgtcgtacggaactaaccacgttccgcccttacccgtagacctaacgttccgtaccgttcgggacctccgtaggtcgtacgtaccgtagtaccggtacgggttagtacgtttaacgttcgtacgtcgtacggtccttcgtacgtttcggacgtaaccggtcctacccgactaccgttgtaacggttgttccgtaccggggcggtaaccggaccgaacgttccggaccgtaccgttacggtaccgttacgcgttacgacgttaacccggg

SEQ ID NO: 94399 - DNA, 583 bp, Homo sapiens
  misc_feature: GYAE6OF02H1SF8.29.85.H08.1.454.CMB.1.raw
  modified_base (513)..(513): a, c, t, g, unknown or other
  misc_feature (513)..(513): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttatactttgtctcctggtaccaacaacaccaggcgacggcccccgactcaacttaatttactgatgtactaattaagccggtaccctcggacggggtccctagactcgcttcctctggctccaagtcctggacaactctcgccctccctgaccactctacgtcggctccgagtctcgaacgtagtacggacggtagtaatttacgttactgtctcgtcttatacgtttcgacgtacgcccaccgctacgtgtacgtacgttacgtccgggnggtaaccggacgtaacgccgtaccggtaccgtacccggttaggtaccgtacggtaccgtcgtaacccggg

SEQ ID NO: 94400 - DNA, 719 bp, Homo sapiens
  misc_feature: GYAE6OF02ICJDF.29.85.H08.1.454.CMB.1.raw
  modified_base (541)..(541): a, c, t, g, unknown or other
  misc_feature (541)..(541): n is a, c, g, or t
  modified_base (590)..(590): a, c, t, g, unknown or other
  misc_feature (590)..(590): n is a, c, g, or t
tcagatagagtactcacgaccggtgctcgatttagtatcactcagtcgcgggggggggtctcaggaggcagcactctcgggacgtctccaccatggcctgggctctgcttcctcctcagcctcctcactcagggcacaggatcctgggctcagtctcgccctgactcacgcctcgctcagtcgtccgggtctccgtggacagtcagtcaccatctcctgcactagggaaccagcagacgtattggtcggtggttaattaactttgtactccttacggtaccaaacaaacaacccgaggacggaccggacccccgacttacaacttaagttttatagtactcgtactaagttaacggccggtccctacggtacgggggttaccctggtacgtccgtctttccgtcgttcggaccgtaccctaaggttccgtcgggaacctaacaccgttccggacctttccccgagtacctacttccgtcgttcgggcccttacgacggtctacggtactagtacggtacggtagtaacttttaacgttacnggtaccttcgacttactacgtttcggacgtaacgggccaacccggtaanaccggtttgtaacgttcgttacccgggtttacgggaccgggggaaacggacccgtaaacggtccggtttacccggtaaccggtttacccggtaagggttaaccacggttacccgtaccggtaacccggg

SEQ ID NO: 94401 - DNA, 696 bp, Homo sapiens
  misc_feature: GYAE6OF02HDUZK.29.85.H08.1.454.CMB.1.raw
  modified_base (559)..(559): a, c, t, g, unknown or other
  misc_feature (559)..(559): n is a, c, g, or t
  modified_base (634)..(634): a, c, t, g, unknown or other
  misc_feature (634)..(634): n is a, c, g, or t
tcagatagagtactcacgaccggtgctcgatttagtatcactcagtcgcggggagctctgggagaggagccccagccctgagacttcccaggttgtttccattcggtgatcagcactgaacacagagaacgcaccatggagtttggactgagcgttgggtttttccttgttgtcttaagttttaaaggtcgtaccagtgtgaagtgcagcgtgggtggagtcggtggggggtagttcgggtggtacgacggccgggttcgggggggtcccctaggacgtaccttccgtccgttggtcggcctacgtcccttcgtaggtactttaacttaaagttttaattcgtttacttttttaccaacgttaacctacggttcgggttccccgtagaacggtcccggttaccggggggtaaggtccggtaggtagggttcgggttcttactttattaattaacgtcggagtacggtctacctaactacatttacatcgatacgtctcgtggtacggacgggtctcttaccacctactccgaacagacaacaaacataacctctacctntacagtacaaatacagtactagtacaagagtaacgagaaccgactacggtcgtacttcgttattagtacggtaanaaacggtaaagcggtaaagcgtaaggtacgtaagggttcggttcggttacgtcggttaccgg

SEQ ID NO: 94402 - DNA, 673 bp, Homo sapiens
  misc_feature: GYAE6OF02G84IN.29.85.H08.1.454.CMB.1.raw
  modified_base (225)..(225): a, c, t, g, unknown or other
  misc_feature (225)..(225): n is a, c, g, or t
tcagatagagtactcacgaccggtgctcgatttagtatcactcagtcgcggggggggtctcaggaggcagcgctctggggacgtctccaccatggcctgggctctgctcctcctcacctcctcactcagggcacaggctcttgggcccagtctgccctgattcagcctccctcgtgtccggtctctggacagtcagtcgccatctctgcactggaaccagcagtnatgtgagtatatgactgtctcctgaccaacaacgaccagacacacgtaccaacaaacacatagataataacaatcgtacaatactccgcctacggaccgggtcctagtacttcgttttcctacgttcggtccttaccgtaagtcgttacgggactaacgtacggccggtccctacgacgtaccgtaaccctacttacgtccgtacggtacctacgacggtctaacgggacggtacgaggtcgttagtacgtttaagttacggtcgacgtcgtacgttactaattaagtaagttaacgtacgtaacggttagttaaccggtaacgtttacgggggttcggttaccggggaacggggtaacgggtaccgtaaaggtcccggttaaccggaaccccggtttccgggtaacgggttacccgaacccgggacccgttaaccgggtacccccgg

SEQ ID NO: 94403 - DNA, 805 bp, Homo sapiens
  misc_feature: GYAE6OF02I4W1C.29.85.H08.1.454.CMB.1.raw
  modified_base (145)..(145): a, c, t, g, unknown or other
  misc_feature (145)..(145): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacgaggatccgngggctcagtctgccctgactcagcctcgctcagtcgtccgggtctccgtggacacgtcacgtcaacctatcctcctgccactacggaaccagcagcgtatcggtcggtagttactaacgtttgtctccgtacggtaaccaaacaaacctaccgaacggaccggaccggaccccccgtatacctaacgttaaactttactacgtaactagttactaacgttaaacggccggtacccgtacggtaccggggttacccgtacgacgtaccgtcgttacctcggtcggtacctacgtaaacgttcgtacgggaacctaaaccgtaccgtaccgtcccgttaccccgtacgtaacctacctaccggtccggttaaccgggtcccgttaaccggtacggaccgtttacgggaaccgttaagggtaccgggtaaacggtttacgtaaacgttttaacgttaacccgtacggttccgttcgtaaccgtttaccgttacgttttcggaacccggtcgttaacccgaaccccgtacgtaacggttacggtacttacggtttaccgggtttaaccggggaaccgggggtaacggtaaacccgaaccggttaccggtaccgttaacccggttaccggtaccggtaactaccggtaccgtaacgtaacccggg

SEQ ID NO: 94404 - DNA, 631 bp, Homo sapiens
  misc_feature: GYAE6OF02G7CZ2.29.85.H08.1.454.CMB.1.raw
  modified_base (225)..(225): a, c, t, g, unknown or other
  misc_feature (225)..(225): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcacctcagggcacaggatcctgggctcagtcctgccctgactcagcctcgctcagtcgtccggtctccgtggacagtcagtcacatcctctgcactggaaccngcagcatcgtcggtgttactactttcgctaccgtgtaaccaactaaccacccgaggccgaccggacccccactcgtaattaacgtttatacgatcgttcctaagttaacgccgtacccgtacggaacgggttccctagacctcgtcctccgtcgtcgtcctaccgtaagtcgtcggacacacgtcgccctcctcgtacctacgtctcgttacggccttaccgacggtcgtacgaacgtcgtacggtacggttacgtaacttactaacgttcgcgttactcgttacgtacgtttcgaactacggtcccaaccgtccgtaagtcgacgttactcggttccggaacggtacgaaccggtaagtcccgtaacgtccgtaccggtacgtccgtacggtcctaacgtaccgg

SEQ ID NO: 94405 - DNA, 606 bp, Homo sapiens
  misc_feature: GYAE6OF02GFGSV.29.85.H08.1.454.CMB.1.raw
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
  modified_base (463)..(463): a, c, t, g, unknown or other
  misc_feature (463)..(463): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggactcctgggctcagtctcgccctgactcacgcctcgctcagtcgtccggtctcctggacagtcagtcaccatcctcctgacacgtgaaccagcagcgagtcggtcggtgttatactttgtctctagtaccaacaaccaccaggcgaccgccccgatcattattancgatcgtacagtaacgcgtcccgtcgacggtccngactctcttctctgcctacgacgtcgagacctaactcgtcctcctcctcgtacctacttccgtacgtcggtactccgaggtctacgtacgtagtaccggtagtacgttacttaacgttcgtacgtnttccgtcgttacgttacgttcggcctacgggccctaaccgtcccgtagttacgtaccgttcgtacccgtacgggaacgggaccgtaccgaagtccggtaaccgtccggttaaccggtcgtacggtaccacgtaccggtaccgg

SEQ ID NO: 94406 - DNA, 542 bp, Homo sapiens
  misc_feature: GYAE6OF02JDPZD.29.85.H08.1.454.CMB.1.raw
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
  modified_base (294)..(294): a, c, t, g, unknown or other
  misc_feature (294)..(294): n is a, c, g, or t
  modified_base (349)..(349): a, c, t, g, unknown or other
  misc_feature (349)..(349): n is a, c, g, or t
  modified_base (480)..(480): a, c, t, g, unknown or other
  misc_feature (480)..(480): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtgttatacttgtctctgtaccacaacaccagcgacgccccgatcatattatgatgtcattaagcgcctgacgggtccngatcgcttctctcggctccgaagtccnggacacactcgcctccgcgaccatctcgtcggctccgagctcgacgtagtggacggtntatttacttactcgtcgtgactactaggttcgccggtaccacccgctacgttcgngttactcggttcggacggacgaccgaagcctacgaccgtcgtacgtcgacgtcacgaacggccgttccgcccgtacggtctaccgtcgttccgtcccctacccgttccgactctactcgcgtcgggaccgngtacggacgtacggcacgtaagtcncgtagngctgacgtncncncncgcgacgngngcngng

SEQ ID NO: 94407 - DNA, 716 bp, Homo sapiens
  misc_feature: GYAE6OF02INTKY.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgcttattttaaaggtgtccagtgtgaagtgcagctggtggagtcgtgggggagtcggtggtacaggccgtgggggtccctggacgacctctcctgtcgcacgcctcgtggtacttcgtaagtttaatagtactttttaccaattacctacggttcgggtcccgtacacggtccggtaccgggggtagggttcgtagggtaggttcgggttccttcgttactttagttaacgtcggaggtacggtgtacctactactacttctagtcgacacgtactcgtaggtcggaacgggtcctattaccgacctactcccgtacgaacgaacgaaccaaaccgaacgtaaacgtacccttaccgttaggtacctacgttacgaacctaaagtacggaaactaggttaccgtagggaaagtaacgggtcgaaccgacggacggtaccggttacctttacgtttattaggttacggtacgtaaacggaaaaggtaacggaacggtaagacgggttaactaccggttaagggtccgggtttaccggttacggttaaccgg

SEQ ID NO: 94408 - DNA, 604 bp, Homo sapiens
  misc_feature: GYAE6OF02GZ4V3.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctgggtggagtcgtgggggagtcggtggtacagccgtggggggtcccctgagactctcctgtgcagcctcgtggtattcaagtttaatgtatttttccatactacgtgggtccgtacaacgcgtccgggggaagggtcgtggaggtggtctctcttataagtcgagtacggtcgctactactattctatcgacagtactcgtaggtacggtaacgggccgtactcacctactctcccgaagaacgaacaaacaactaacgtacctcctagtatctagactaaatgaacgtagtacgtagaaggtaagtacgaacgaacgaggccggtacttactatttacgttggtaacgaacgtaaaagacggaacgagaaggtagtacgttagggtcggtcggtaggttacgg

SEQ ID NO: 94409 - DNA, 664 bp, Homo sapiens
  misc_feature: GYAE6OF02HG3RD.29.85.H08.1.454.CMB.1.raw
  modified_base (192)..(192): a, c, t, g, unknown or other
  misc_feature (192)..(192): n is a, c, g, or t
  modified_base (650)..(650): a, c, t, g, unknown or other
  misc_feature (650)..(650): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtgttatacttgtctctggtaccaacacaccgaggcgacggcccccgatcaagttaatttangtatgtactagttaacgccggcctcgacgggtccctgactcgtcttctcgtcgctcgaaggtctacggcaactcgtcgtccctcctagacctatctcgtcgggcctccgagctaggacgtagtcggtacggttataagtttacttacgtcgtactccgtcgtctacgttttggccacggtacccgaacccggcttaccgtggtacgtacgttcggtcgggaacggacgggtaacctaggtcccgtacgttacccgtcgtacgtacgtacgtacgtacgaacggtccgtccggtccccgtcggtaccgtccgttacccgttcccgttcccgtccccgttacgttaccgtaccgttaccgttacctacgttccggtacggtaccggtcgggtcgtaccgggtacgaaccgggtactaccgtacggtaacgcggtacgactcgtacgacgcgtacgtccgngtgtacgcgtgacg

SEQ ID NO: 94410 - DNA, 735 bp, Homo sapiens
  misc_feature: GYAE6OF02JKIH3.29.85.H08.1.454.CMB.1.raw
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggactccgtgggctcgagtctgccctgactcacgcctcgctcagtcgtccggtctccgtggacagtcagtccacntctccngcacgtacggaaccngacagcgagtcgtacggttagttacttaactttcgttccgttccgttacggtaacctaaacgtaacccaccgacggtaccggtaccggaccccccgtaacgtaccgtaacttaacgttacgtacgtacgttacgtacgttaagttaacggtccggtcccgtaccggtaaccggggttccgtacggtaaccgtccggttcgttccgtttaccgtcggtaccgttaccgtaaacgttccggtaacggtccgtaaaccgtccgttacggtccctacccgttccgtaaccctacgttccgtccggtcggtacccgttaccgtacggtacgtaccggtacgtacggtacggtacggtacgttacgtttacttaacgtcgttcgtcgtacttacgtacgttcgacgaccgtccgtaccgcgtacgtacgtcgtacgttcggtacggtcggacgacgtaccgtacgtaccgtaccgttaccggtacgtcgtaccgtcgtacggtacccg

SEQ ID NO: 94411 - DNA, 705 bp, Homo sapiens
  misc_feature: GYAE6OF02FV2XK.29.85.H08.1.454.CMB.1.raw
  modified_base (273)..(273): a, c, t, g, unknown or other
  misc_feature (273)..(273): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaaggtgtccagtgtgaagtgcagctggtggagtcgtgggggagtcggtggtacaggccgtcggggggtccctggacgactctcctgtcgcacgcctntggattctaagttttaatgtatttttccattacacgtcgggtcctacgaaggccgtaccggggaaggttcgtgggtacggtggggttcctcgttactttaagttaacgtccggaaggtaccggttgtaccttaacttaaccgtactttacctaagtcggactaacgtacttcgtaggtacggtaacgggtccgtaactttcaacccgtagttccctaccgaaagtacgaaaaccgaaaccgtaaaactaacccggtacccttaccggtagttaaccgtctacggaacctaaaagtccgaaactaggtactaggaaacgtaggtacggaaccgacacggtacgttcgttacttagtttatacggtaacaacgtaaagggactaaagggcgtaacggtataccggttaagggtcgggttacggttagtttacgg

SEQ ID NO: 94412 - DNA, 711 bp, Homo sapiens
  misc_feature: GYAE6OF02HQ1HX.29.85.H08.1.454.CMB.1.raw
tcagatagagtactcacgaccggtgctcgatttagtatcactcagtcgcgggggggggtctcaggaggcagcactctcgggacggggtctccaccatggcctgggctctgcctcctcctcagcctcctcactcagggcacgaggatccgtgggctcagtctcgcccctgacctcacgcctcgctcagtcggtccgggttctccgtggacagtcacgtccaccatcctcctcgctacgtacggaaccagccgagcgtagtcggtacggttaggttaacttactttcgttcctcgtacggtaaccaactaaccgaccgaggccgacccggcccccgtactactaagtttaactttagtacgtacttcgtactaacgttaacggcccggtcccgttaccggtaccggggttcctaggtactccgtccttctcggtcgtcctaccgtagtccgtcgacctacacctccgtaccgtcctcgtaacctctcgtaccgttcggtccgtaccgtaggtctacggtacgtacggttacggtaacggttctaacgtttaaccttcgtcgtaccgttcgttaccgtttacgtttacgtttcgacggtaacccgcccgtaaccgtctacgttacggtgttaccgtcggtaccggggaacggcggtaaccgtaacggttcccgtacgttacccggtcgtaaccggtcgacgtacgaccgtacgg

SEQ ID NO: 94413 - DNA, 553 bp, Homo sapiens
  misc_feature: GYAE6OF02G6RK3.29.85.H08.1.454.CMB.1.raw
  modified_base (162)..(162): a, c, t, g, unknown or other
  misc_feature (162)..(162): n is a, c, g, or t
  modified_base (186)..(186): a, c, t, g, unknown or other
  misc_feature (186)..(186): n is a, c, g, or t
  modified_base (412)..(412): a, c, t, g, unknown or other
  misc_feature (412)..(412): n is a, c, g, or t
  modified_base (533)..(533): a, c, t, g, unknown or other
  misc_feature (533)..(533): n is a, c, g, or t
  modified_base (540)..(553): a, c, t, g, unknown or other
  misc_feature (540)..(553): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggtataacttgtctctgtaccaacacaccnggcgacggcccccgatcataattngattgtactagttagccggtcctcgtacggggtcctgacttccgtcttcctcgtggcctaccgaagtcgtcggacaactctcgcccctcctacgacctatcctcgtcggaccttcgacggtctacggacgtagtggacgtgtattacgttactgtctgccttcgtattcgacgtaaccggccaccgtaccacggtgttcgacgttcgtcgggtaccggacgaccgntccggaccgtaccgtccgtagtcacgtcacgtacggtcctacctcccgttacgccacgttccgtccgtcccctcctcttacgctacctcgtaactgtccgaggtccgggctggactacggnccagtgnnnnnnnnnnnnnn

SEQ ID NO: 94414 - DNA, 646 bp, Homo sapiens
  misc_feature: GYAE6OF02H8NHV.29.85.H08.1.454.CMB.1.raw
  modified_base (222)..(222): a, c, t, g, unknown or other
  misc_feature (222)..(222): n is a, c, g, or t
  modified_base (225)..(225): a, c, t, g, unknown or other
  misc_feature (225)..(225): n is a, c, g, or t
  modified_base (286)..(286): a, c, t, g, unknown or other
  misc_feature (286)..(286): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcacatctcctgcactggaaccngcngcgatgtcgtagttataacttgctctgtaccaacaacaccagcgacgccccatcatattangatgtcaattaacgccgtcctacgacggggtccctagacgtcgtccttctacgtggaccttacgtaaagtccgttacggaccaaaccgtaccgtaccgccctttacccgacgtaaccctacttccgtaccgttcggggtaccctacgtacgggtcctagggtaccgtaacgtacggtaaccggttagttaaactttaagttaccgtagtccgttacgccttacgttagttttcgaccgtacggtacccacccgtcgtaacgttgtacgtaccgttcgtaccggggacgggaacggtaccgaacggtaccgtacggttaaccggtccgttaacggtaccgtacggtaccgtacggaaccgg

SEQ ID NO: 94415 - DNA, 614 bp, Homo sapiens
  misc_feature: GYAE6OF02G3LBB.29.85.H08.1.454.CMB.1.raw
  modified_base (583)..(585): a, c, t, g, unknown or other
  misc_feature (583)..(585): n is a, c, g, or t
  modified_base (588)..(614): a, c, t, g, unknown or other
  misc_feature (588)..(614): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctggctccaggctgacatgacggtgaatttattactgctgccttactattttcgctaacgggccacccccgctaaccgttggtacgtacgtttccggtttccggggaccggggtaacggggaacccaacgggtccgtacggtaacccccgttccgtacggggttccaacggtccttaccgaaacggtccctcccggtcccccccgttcgggtacctacccgttccgtttcccgttcccccccggtccccttacccgttactaccggttaccttaccgttaacgttccggtacggtaccgggtccggggtaccgttcgggaccgtaacgggccgttaccgagttacggcactcgnnngcnnnnnnnnnnnnnnnnnnnnnnnnnnn

SEQ ID NO: 94416 - DNA, 555 bp, Homo sapiens
  misc_feature: GYAE6OF02JZ3ZA.29.85.H08.1.454.CMB.1.raw
  modified_base (168)..(169): a, c, t, g, unknown or other
  misc_feature (168)..(169): n is a, c, g, or t
  modified_base (219)..(219): a, c, t, g, unknown or other
  misc_feature (219)..(219): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
  modified_base (441)..(441): a, c, t, g, unknown or other
  misc_feature (441)..(441): n is a, c, g, or t
  modified_base (453)..(453): a, c, t, g, unknown or other
  misc_feature (453)..(453): n is a, c, g, or t
  modified_base (463)..(463): a, c, t, g, unknown or other
  misc_feature (463)..(463): n is a, c, g, or t
  modified_base (498)..(498): a, c, t, g, unknown or other
  misc_feature (498)..(498): n is a, c, g, or t
  modified_base (508)..(508): a, c, t, g, unknown or other
  misc_feature (508)..(508): n is a, c, g, or t
tcagatagagtactcacgaccggtgctcgatttagtatcactcagtcgcgggggggtctcgaggaggcagcactcgtcgggacgtctccaccatggcctgggctctgctcctcctcagcctcctcacttcagggcacaggatcctgggctcagtctgccctgaactcnncctcgctcagtcgtccgggtctcctggaccaggtcacgtcaccagttccncctgaccactcggaactgccatggatggtaacgtgttatacttgtctctcgtacacatacccaggcgtacaccccgtncattatatgntcacagttagccggtcctcgtaacggtccncgtatccggtcttcgacgttcgntcctaagttcgngactaacncgtcgcctcctagcctatcgtcgtcggccnccggntaccgtnccgtagacggtcgtacgtnttaccgtgtacncgttgacctntacgttcgctacgcacccgtcaagggttcatggtnttacccgggngggtaccggactacgtcgcgtccgttacgacgcgatcccgatcccgg

SEQ ID NO: 94417 - DNA, 823 bp, Homo sapiens
  misc_feature: GYAE6OF02GF8SE.29.85.H08.1.454.CMB.1.raw
tcagatagagtactcacgaccggtgctcgatttagtatcactcagtcgcggggggggtctcgaggaggcagcactctcgggacgtctccaccatggcctgggctctgctcctcctcagcctcctcactcgaggcacgaggactccgtgggctcgagtctcgccctgacctcgcgcctcgctcgagttcggtccggtctccgtggactagtaccagtccaacctattccgtcccgtgacctacgttaccgggaacctagccgaggccgtaaggttcggttaccgggttaggtttaactttaaccgttttcgttacccgttccgtttaaccggttaaaccctaaaaccgtaaccccgacccggaacggacccggaaccccgggacccccccggtacgttacccgttaacgtttaaacgttttaacgtacggtacgttaccgttaacgttaacgtttaaaccgggtccccggttacccgttaccgggtaacccggggtttcccgtacgtaaccgttcccggttacctttccgttccgttcggtaccttaccggtaacgtcgttacggaacctaccgtacctcgtccctccgtacacctacgttcctacggtcgtaccgtaccgtcggtacgtcggtacgtacgttggtaccggtagtttaacgtttacgttccgtacgtccgtacggttctacgttacgttcgaccggtacgtacccgtaccgtacgtacgttacgtacgttacgttacggtccggaacgggtacggtaccgtaacgtcgtacccggtacggtccggtacgtaccggagttaccgtaccgtaccgg

SEQ ID NO: 94418 - DNA, 152 bp, Homo sapiens
  misc_feature: GYAE6OF02G39NR.29.85.H08.1.454.CMB.1.raw
  modified_base (149)..(152): a, c, t, g, unknown or other
  misc_feature (149)..(152): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcggctggcaaggcgcatagnnnn

SEQ ID NO: 94419 - DNA, 636 bp, Homo sapiens
  misc_feature: GYAE6OF02GDR34.29.85.H08.1.454.CMB.1.raw
  modified_base (197)..(197): a, c, t, g, unknown or other
  misc_feature (197)..(197): n is a, c, g, or t
  modified_base (340)..(340): a, c, t, g, unknown or other
  misc_feature (340)..(340): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtcccggtctccgtggacngtcagtccaccatcctcctgcacgtacggaaccagcagcgatcggtcggtgttatacgttgtcctctagtaccaacaccaccgaggccgaccgccccgatcattaacttagtgatcgtactagttacgcgtcctgacggtccngactcgtcttcctcgtcgcctacgtacgtcgtcggtacctaacgtccgtccgtaccccttcccgtacgtacccttacgtccgtacgtcggtcctccggacgtcgtacggtaccgtgtacggtaacggtagttacgttacgtcgtctcgtcgtcttacgttacgttcgaccgtacgtaccctaccgcgttaccgtgtacgttaccgttcggttaccgggaccggtaaccggaaccgtacgtacccggtaccggtaccgttacggtaccggtacctacggtaccgtaccggtacccgg

SEQ ID NO: 94420 - DNA, 872 bp, Homo sapiens
  misc_feature: GYAE6OF02JPWW9.29.85.H08.1.454.CMB.1.raw
tcagatagagtactcacgaccggtgctcgatttagtatcactcagtcgcgggagctctgggagaggagcccagccctgagattcccaggtgtttccattcggtgatcagcactgaacacagagaacgcaccatcggagtttggactgagtctgggttttcctgttgcttatttaaaggtgtccagtgtagaagtgtcagtctggtggtagtcgtggggggattcggtgggtacaggccgtggggggtcccctgacgtacctcgttccgtggtcgccgtacggtcccttccggtgggtacttttaccggaaaaggtttttaactggttaacttttttacccaattaaccggttacgtttccggggggtacccttaacgaacggttcccggttaccgggggggtaaagggtttccgtaggggtacgggtttcggggttcctttacccgttacgttttaaacgtttaacgtccggggtaaggtacccggggttgtacccgttaaccttacgtaaccgttttacgtaaggtccggtagtaaccgtaacctttcgttcggggtaacggaaacggggggttccccttaagttacctaaccgtacgttaccgttaccgtaccggtaacgtaaccgtaaacgtaaaccgtaaaccgttaacccgtaaccgttaccgttaaccttaccgtaccgtaacgtaacgtaacgtaacgtaacgttacgtacgtaacgtaacggtacgaacgtaacgtacggtaaccgtacgttaccgttacgttacgttacggttaacggtaactaaacggggggggtaactaacgggtaacgtacggtaacgttacggttaaggtacgggtttaccggttacggtttaaccggg

SEQ ID NO: 94421 - DNA, 640 bp, Homo sapiens
  misc_feature: GYAE6OF02IO6BX.29.85.H08.1.454.CMB.1.raw
  modified_base (356)..(356): a, c, t, g, unknown or other
  misc_feature (356)..(356): n is a, c, g, or t
  modified_base (439)..(439): a, c, t, g, unknown or other
  misc_feature (439)..(439): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttggtgtctatttaaaggtgtccagtgtgaagtgcagctggtggagtcgtgggggagtcgtggtacgagccgtgggggtcctgagactcgctgtgcagcctctggattctaagttaatgtattttcaatacactggtcctcaagcgtccgggaaggtctagggagtgggtctctcgtttatagtcgagtacggtntcgtaactacgtattcttagcgtactacgtacttcgtcggtaggaacgggccgtacttaccgacctaagttcctacgacgtanaaaccgaaacgaaacctaacgtaaccttcccgttagtaacctacgttagaacctaaaatcgaaacgtacgtactaagtaaggaagttacgacgaaagtacggcggtaccttattacgttaagttcgtaaggtaaccaaaggtaaccggaaggtaacgacggtaactaggtaaccggtaacgggttccggtagttttaacgg

SEQ ID NO: 94422 - DNA, 670 bp, Homo sapiens
  misc_feature: GYAE6OF02HN9DJ.29.85.H08.1.454.CMB.1.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (465)..(465): a, c, t, g, unknown or other
  misc_feature (465)..(465): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatccgtgggctcagtctgccctgactcagcctcgctcagtcgtccggtctccgtggacagtcagtcacntctctgctacgtgaaccngcagcgatggtcgtaggttactacttcgtctctcgtaccaacacaccagcgaccgccccgatcattaattatgtatcgtactagttaacgccgcctcggtacggtcctgtacgtcgtcttcctcgtcggtctaccgtagtcgtacgacctacctacgtccgtccctacccgtacgtaccctacgttcctcggtccggtcctaccgtcggtccgtacgacgtagtacggtaaccgggtttnaacgttttaacgtcgtacgtccgttacgtccttacgttacggtttaccgacgtaaccgggtcccgaaccccggtactacgttaccggtacgttaccggttccgggtttaccgggaaccggggtaaccggtacccggtaacgttacccggtccggttacccgttaccgggtacggtacccgtaccggttaccgtaccggtacccgg

SEQ ID NO: 94423 - DNA, 586 bp, Homo sapiens
  misc_feature: GYAE6OF02HCVFB.29.85.H08.1.454.CMB.1.raw
  modified_base (215)..(215): a, c, t, g, unknown or other
  misc_feature (215)..(215): n is a, c, g, or t
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
  modified_base (362)..(362): a, c, t, g, unknown or other
  misc_feature (362)..(362): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcaagggcacaggatccgtgggctcagtctgccctgactcagcctcgctcagtgtccgggtctcctggacagtcagtcaccatcctcgngcacgtggaccagcagcgatggtcggtgttatacttgctctgtaccaacacnccaggcgacgccccatcatattagnatgtcattacgcgtccctgacgggtcctgactcgtcttctcgtcggcctactacggtactggacctaacnctcgccctcctagacactctcgtcggcgtccgcgtcgcgacgacgtgtacggtagtagttacttacgtcgtcgtcgtcgtactacgttcgtcgtacgtaccgaccgtccgtaaaaaaacgttcgtacgtacgttaccggttcgggaccgggtaaccggtaccgtaaccggtaccgtaccggtaccgttaccggtaccggtacgtacgtaccgtacgtaacccgg

SEQ ID NO: 94424 - DNA, 804 bp, Homo sapiens
  misc_feature: GYAE6OF02H1NZP.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcacgcctcctcactcgagggcacgaggactccgtgggctctagtctcggccctgacctcacgtcctcgctcgtagtcggtccggtctccgtggactagtcacgtcactatcctcctagcacgtacggaaccagcacggcgtacgtggttacggttaggtttaacttaacgtttcggttacctaccggttacgtaaaccgtaaaccaaacccgtacccggaacgggtacccgaaccccgggacccccgtaacttaccgtaaacgtttaactttacgtacggtaacttcggtaacgttaacggttaccgggtccggtaccgttaccgggacgggttccgtagtaccgttccgtccgtttaccgtccgtacggttaccgtacgtaacggtccgtaacggtacccaaaccgttccgttacccgtacccgttacccggtactacccgtttacgtaccggttccggttcgggtaacccttccggtacgggtaccttaacgggacccggttaggtaccggttaacgggtttaacttacgtttaaccgttacgggtacttccgttaacgttccgtagtttacgtcgaacgggtcccgaacctcgacgtcgtgtacgtcggttaacggtccggggaacgaccggtacgtcggaccgttacggtaccgtacggtaccgtacgttctacggaccgtaccgg

SEQ ID NO: 94425 - DNA, 660 bp, Homo sapiens
  misc_feature: GYAE6OF02H5XDR.29.85.H08.1.454.CMB.1.raw
  modified_base (322)..(322): a, c, t, g, unknown or other
  misc_feature (322)..(322): n is a, c, g, or t
  modified_base (653)..(653): a, c, t, g, unknown or other
  misc_feature (653)..(653): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatccgtgggctcagtctcgccctgactcacgcctcgctcagtcgtccggtctcctggacagtcagtcaccatctcctgctacgtacggaaccagcgacgcgagtcggtacggtggttaacttactttcgtcctcgtacgtaccaacaacaccaggccgaccgccccgactaccattaacttangtacgtgtactattaacgccgtccgtcggacggtcctagctcgccttctacgtcgtcgtacctacgtcgtcgaaccacaccgtcgtcccctacccgtccgtaaccctacgtccgtaccgttcggggcccctaccggtacggtctacgggtacgtacgttacggacggttacgtacgtttacgttaccgtagtcccgttgtaccgttaccgttagttacgtaaccgccggttaccacccggtcccgtaaggtcgttcgtacgttccggtacgggtaacggtaccggaacgtaaccgtcgtcggtaccgtacgtaccgacggtacgtacggtntacccgg

SEQ ID NO: 94426 - DNA, 689 bp, Homo sapiens
  misc_feature: GYAE6OF02FJOAR.29.85.H08.1.454.CMB.1.raw
  modified_base (222)..(222): a, c, t, g, unknown or other
  misc_feature (222)..(222): n is a, c, g, or t
  modified_base (316)..(316): a, c, t, g, unknown or other
  misc_feature (316)..(316): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactgaaccngcagcgatgtcgtgttatacttgtctctgtaccaacacaccagccgacgccccgactcataattatgatgtacatacgcgcctgtacgggtccngtactcgtacttctcgtcgtacctacgtaacgttccgtacggacctaaaccaccgttccgtaccccgttacccgtacccgtaaccctacgttccccgtacggttccgggtacccttacccggtacgggtcccgttagggtaacccgtacggttaaccgggttaacggggttacttaacgttttaaccgtttaccgtccgtttccgttacggtacctttaccgttacgttttacgacccgtaccgggacccctacccggtactaccgttacgtacgttaccgttccggttacccgggaacgggtaccggtaacgaccggtccgtaccggtaccccgttacggtacgttaccgtacgtccgtaccggtaacccgg

SEQ ID NO: 94427 - DNA, 685 bp, Homo sapiens
  misc_feature: GYAE6OF02I2MIC.29.85.H08.1.454.CMB.1.raw
  modified_base (232)..(232): a, c, t, g, unknown or other
  misc_feature (232)..(232): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatcctgggctcagtctgccctgactcagcctcgctcagttcgtccggtctccgtggacagtcagtcaccatcctcctgactacgtcggaaccngacacgcgtatcggtcggttagttatactttgtctcgtacggtaccaactaaccaccgtaggccgtaccggccccccgtataccgtaattaagtttacagtactacgtactaacgtttaacggcccggtacccgtacgggtacccgggttcccgtacggtaacgtccgtccgttacctcggtcggtaccttaccgtaacgtcgtacggacctaacctacgtaccgtcccctacccgtacgacctacttccgtacgtccgggtcctccgacgtccgtacgtacgtacgtacggtacggttattacgtttacgtacgtcgtacgtcgtcctacgttacttcggaccgtacgcccgtaccgtctaacgttcgtcgtacttccgggtcgggtaaccgggacgtaccgtacgtcgtaccggaccttccgggtagaccggtactacggtaccgtaccgg

SEQ ID NO: 94428 - DNA, 584 bp, Homo sapiens
  misc_feature: GYAE6OF02GIYB4.29.85.H08.1.454.CMB.1.raw
  modified_base (239)..(239): a, c, t, g, unknown or other
  misc_feature (239)..(239): n is a, c, g, or t
  modified_base (291)..(291): a, c, t, g, unknown or other
  misc_feature (291)..(291): n is a, c, g, or t
  modified_base (338)..(338): a, c, t, g, unknown or other
  misc_feature (338)..(338): n is a, c, g, or t
  modified_base (366)..(366): a, c, t, g, unknown or other
  misc_feature (366)..(366): n is a, c, g, or t
  modified_base (567)..(567): a, c, t, g, unknown or other
  misc_feature (567)..(567): n is a, c, g, or t
  modified_base (571)..(572): a, c, t, g, unknown or other
  misc_feature (571)..(572): n is a, c, g, or t
  modified_base (574)..(574): a, c, t, g, unknown or other
  misc_feature (574)..(574): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (583)..(584): a, c, t, g, unknown or other
  misc_feature (583)..(584): n is a, c, g, or t
tcagatagagtactcacgaccggtgctcgatttagtatcactcagtcgtgccctgactcagcctcgctcagtgtccgggtctcctggacagtcagtcaccatctcctgcactggaaccagcagcgatgtcggtggttataactttgtctcctggtaccaacacacccaggcgacgcccccgactcaatatttatgatgtcattaacgcggccctgacggggtccctagactcgtcttcnctgctccaagtctggcacactcgcctcctcaccactctcgtcggtccgtccncggtctacgacgtacgtaggtacggttgtaacttacttacgtagctntctctacgtttcgcgtacggaccaccgntaccccccgtagtcgtacgtcgtcggtacggtacggtaccgaacgtcgtacgtaccgtccgtacgtacgacgacctacgtacgtcgtccgtacccgtcgtcgtaccttcgtaccgttcccgtccctccgtccgtacgttactacttactcgtacgtacggtaccggtcgtcgacgacgacgtacgtagtgacgtagcacgngacnncncgncncncnn

SEQ ID NO: 94429 - DNA, 762 bp, Homo sapiens
  misc_feature: GYAE6OF02FGJ45.29.85.H08.1.454.CMB.1.raw
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
tcagatagagtactcacgaccggtgctcgatttagtatcactcagtcgcgggggggtctcaggaggcagcactctcgggacgtctccaccatggcctgggctctgcctcctcctcacgcctccctcactcacgggcacgaggactcctggctcacgtctcgccctgactcagcctcgctcgagtcgtccgggtctccgtggacagtcagtccaccntcctccgtgccacgtacgaaccngtacacggccgtagttcggtacggttacgttacttaacctttcggtacccttccgacggttaaaccccaaaccgtaacccgaacccgaccgggtccgacccgaccccccggtaatacgtaattaaactttacgtagtacgtacgttacgtaacgttaaccggcccggttacccgtacggtaaccggggttcctaacggttctcccgttcgttaccgtcgttaccgggtacctaacccgtaacggtcctaaccgggtaaccctaaccgttcccgtacccgtaccctcccgtaacgaacccgtttcgtcccgttacggttccggtacccgtacggaccggtcgtaacggtaccgtacggttcggttaacggtacttaacgttacctcggtactccgtacgttctacgtacgttaccgaccgaccgtccaccgttgcgtcgtacgtccgtaccggtacggaaccgacggtaccttaccgcggttaccgtaccgacggttaacgcctacgtaccgtccggtaacccg

SEQ ID NO: 94430 - DNA, 565 bp, Homo sapiens
  misc_feature: GYAE6OF02F3NXT.29.85.H08.1.454.CMB.1.raw
  modified_base (257)..(257): a, c, t, g, unknown or other
  misc_feature (257)..(257): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (362)..(362): a, c, t, g, unknown or other
  misc_feature (362)..(362): n is a, c, g, or t
  modified_base (408)..(408): a, c, t, g, unknown or other
  misc_feature (408)..(408): n is a, c, g, or t
  modified_base (438)..(438): a, c, t, g, unknown or other
  misc_feature (438)..(438): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtcagtccaccatctcctgcacctggaaccagcagcgatgtcggtgttatacttgtctcngtacacaacaccagcgacgccccgactcataattatnatcgtnattagcgtcccgtcgacgggtcctgatcgtccttcgtctcggcctaccaagtctcggcaacnccgtcgccctccctcgacctactctcgtcggcctcgacgctgacgntcggtcgtagtattacgtactgctgtactntacttgcacgtccacccgtcacgtgtagtacgtcggttaccgggcgggaaccgggtaacccgaagtcccgtaccggtaacccggttaccggttaccggttaccgacggtaccgtaccgtaacccggg

SEQ ID NO: 94431 - DNA, 834 bp, Homo sapiens
  misc_feature: GYAE6OF02G1YOJ.29.85.H08.1.454.CMB.1.raw
tcagatagagtactcacgaccggtgctcgatttagtatcactcagtcgcggggggggtctcaggaggcagcgctctggggacgtctccaccatggcctgggcctctgctcctcctccacctcctctactacgaggacacgacggtccttcggttccgggccctagtcgtccgtcccgtagtacttcgaccgtccccttccccgttccggttcgggttccccgggttccttaccggtacggacgtacgtaccgtacggtccgacctacttccctccgtcgacctacgtacggaaccgagctagtagtagttggtagaagtaattagacgtacgttccgttcccttacccggtttaacggtaaacccaaaccaaccccgaacccgtaagaacccaacgtaccgtaacccaaaaccaaaccaacgtaagttacgtaaacttaactaacgtaaacgttcgtaaacttaaacgttacccggtcccgtaccctaacgggggtaccgggttcctaagttacgtttccgtttcctcggtcgaccttaaccgagttccgacgtactaacggtccggcccgtacctacgtacgtaccgtacctacgtccgttaccggaacgggtaccctacgggtaccggtacggtacggaaccgggaggtacgtaccgtttaagttaattttaagggttcgcgttacgtcgttactacgtaattaagttaacgactaggtagttaccgtaacggtttaacggggtttagggtcggtacggggacgggaactaaccgtacgtccgtacggtacccgttgggtccgtaaccgacccggtaccggacgtcccccgg

SEQ ID NO: 94432 - DNA, 636 bp, Homo sapiens
  misc_feature: GYAE6OF02JAFST.29.85.H08.1.454.CMB.1.raw
  modified_base (225)..(225): a, c, t, g, unknown or other
  misc_feature (225)..(225): n is a, c, g, or t
  modified_base (394)..(394): a, c, t, g, unknown or other
  misc_feature (394)..(394): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtcagtcactatctctgcactggaaccngcagcgagtcgtcggtgttactacttcgtctcgtagtaccaacaaccaccgaggaccgaccgacccccgtactacctacttaacttactcggtactcgtactattaacggccgtcctacgtacgggtcctgtactcgtcttctctcgtcctcgacgtcgtacgctaacncgtcgtcctccgtacgtacctacttccgtcgtcgggtccctaccggtggtacctacgggaaccgtacggtcggttaacggttacttaacgttacgttccgtcgtagtaccgtcttaccgttagtcgccggtaacccgtaccgtaaccgccgtagtacggttacgtacgttccggtacgggacggtaccggaaccgtcgtacgtccggtacccgtggtaccgactacgtcgtacggtacccgg

SEQ ID NO: 94433 - DNA, 760 bp, Homo sapiens
  misc_feature: GYAE6OF02JMESY.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgtgcttatttaaaaggttgtccagtgtgtaagtgcagcgtgggtggtaggtcgttaggggggtacgttcggtacggttaacgacggtccggtcggggggggttcccctggacggtaccttccgttccgtgtaggccacggtcccttcgtcggatttaccggtaaagttttaacgttcggttattttttacccaacttaccgaagtttccggggttacccgttaccaaggtccgggttaccccgggggtaaagggttctggggttaacgggttcggggtacctttcgttacgtttaagttacgtaccggagtacggttacgcttaaccttagtacgtttctagtcgactagtacccttgtggtacggaaccgggtctatctaccgacttctaccgagtacaactaacgaaaccgaacgttaccctaccgtcgtttaacttacctacgtaactaacgtacgaacgtcgttaactcgaaagtaacgggtagaacgacgtaacggtcgttacctttaacgtagttttacgcgttaggaaacaaagggtaggaaccgtcggaaacggtcgttaggtaacggttcgggtacttcggttaacgg

SEQ ID NO: 94434 - DNA, 863 bp, Homo sapiens
  misc_feature: GYAE6OF02JLYVQ.29.85.H08.1.454.CMB.1.raw
  modified_base (164)..(164): a, c, t, g, unknown or other
  misc_feature (164)..(164): n is a, c, g, or t
  modified_base (193)..(193): a, c, t, g, unknown or other
  misc_feature (193)..(193): n is a, c, g, or t
  modified_base (225)..(225): a, c, t, g, unknown or other
  misc_feature (225)..(225): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggtactaactttgtctctggtaccaacgaacnccaggcgacggcccccgatcataacttangatgtcatacgccggcctcgacggggttcccngtactccgcttctctcggcctccaacgcgtcggacaactactcgcctccctagaccactcgtacctcgggtctaccgtacggtctcggaccgtagttcggacgggtagtacgtttaacgtttcgtacgtcgttacgtccgttacgtaagttttccggacggtaccggtaccccgtaaaccccgggtcgtaacccggttaggttttcccgggaacggttttccccgggtttaaccggggggacccggggtaaaaaccggggggttaccccgtaaaaacgggggttccccctaacccggggttaaaccccgggtttaaccccggtaaccgggtttacccggtacggttaaccccggttaaacccggttaaacccggggttaacccggttccccgggttaccccccggtttacccgggttaccccggttaaccggtttacccggttttcccccgggttccccccggttacccccgtttaccccggttacccttaccgggttaacctttaacccgttaacgtttacccgtaccggggttaacgggtacccgggttcggtaccggggtaccgaaccgggtaccggtaccgtgtaacgcgtaagccgtacgcgtccgtacgtacgacgtcgcgacgacgtcgcg

SEQ ID NO: 94435 - DNA, 597 bp, Homo sapiens
  misc_feature: GYAE6OF02F4FE9.29.85.H08.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (284)..(284): a, c, t, g, unknown or other
  misc_feature (284)..(284): n is a, c, g, or t
  modified_base (354)..(354): a, c, t, g, unknown or other
  misc_feature (354)..(354): n is a, c, g, or t
tcagatagagtactcacgaccggtgctcgatttagtatcactcagtcgcggggggggtctcaggaggcagcactctcgggacgtctccaccatggcctggctctgctcctcctcagcctcctcactcagggcacaggatcctgggctcgagtctgccctgactcgagcctcgctcagtcgtccgggtctcctggacngtcagtcacntctccngcacgtggaaccngcagcgatcgtcggtgtatacttntctctgtacacacaccagcacgcccatcatatangatgtacataacgccgtaccgtcgtacggtccagtactccgtacttcgtcgtcgtcctacgtagttaccncgggtaccaacgtcgtaccggtccctccgacgtacctacgtcgtccgtagggtcctaccgtacggctagggacctgtacggacgttagtacgttacgttcgtacgtacgttccgtactacgttacgttcggaccgtaccggtacccaaccgtccttaacgattcggtactcggtacgggaacggcggtaaccgacgtcgttaccggcccgtacgttaccggactaccggtactacgtacccgg

SEQ ID NO: 94436 - DNA, 644 bp, Homo sapiens
  misc_feature: GYAE6OF02IHS8F.29.85.H08.1.454.CMB.1.raw
  modified_base (190)..(190): a, c, t, g, unknown or other
  misc_feature (190)..(190): n is a, c, g, or t
  modified_base (233)..(233): a, c, t, g, unknown or other
  misc_feature (233)..(233): n is a, c, g, or t
tcagatagagtactcacgaccggtgctcgatttagtatcactcagtcggcggggggggtctcaggaggcagcactctcgggacgtctccaccactggcctgggctctgctcctcctcagcctcctcactcagggcacaggatcctgggctcagtctgccctgactcacgcctcgctcagtggtaccggtntcctaggactagtcagtcaccatcctacctgcactaggaaccngcacgcgagtacggtcggtggttaactactttcgctctcggtaccaacacacctaggcgaccggccccgactacacttaacttatgtactacgtcaattacgcggtcctacgtacggggtcctgtacgtcgtcgttctccgtggtacctacgtaacgtcgtacggtaactaaccgtacgtcctcccgttcccgttacgacctacgttccgtacggttcgggtcctacgtacggtacgtcgtaggtacgtcggtacgttagtacgttaacttacgtcggacttgtaccttgtacgttcggcgaacggtcctaccggtactaccgtagttcgacgttacgggtcggaacggtaccggtaccgacgtccgttacggcccgttacggtacggtacctacggtcctacggtaccgg

SEQ ID NO: 94437 - DNA, 644 bp, Homo sapiens
  misc_feature: GYAE6OF02J054Y.29.85.H08.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (321)..(321): a, c, t, g, unknown or other
  misc_feature (321)..(321): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacgaggatccgtgggctcagtctcgccctgactcacgtcctcgctcagtcggtccggtctccgtggacngtcagtccacntctcngcacgtgaccngcagcgtagtcggtcggtagttactacgttgtcttccgtaggtaccaacgaaccgtaccgaggccggaaccgcccctatactattaagttangtatctgtacgttacgcgtccctcggtacggtcctagtactcgtctcgtcgtacgtccgtactacgtgtacgtccgactaccggtcctacctccgtcgaccttacgctcgttcggcctcgtcgcgtacgacgtcgtcgttagtacgtagtttactcgtaggtcctcgttcctaggttaccgtcgtaccgacccgtaccgtaccaccgttacgtacgtccggtacgtcggttaccgggacgggttaacccgagttacccggtaccggtaaccggtaacccggtaggtcccggtaactacccgggttcgtaacccggttcccggg

SEQ ID NO: 94438 - DNA, 631 bp, Homo sapiens
  misc_feature: GYAE6OF02IYRY4.29.85.H08.1.454.CMB.1.raw
  modified_base (281)..(281): a, c, t, g, unknown or other
  misc_feature (281)..(281): n is a, c, g, or t
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
tcagatagagtactcacgaccggtgctcgatttagtatcactcagtcgcggggggggtctcaggaggcagcactctcgggacgtctccaccatgcctgggctctgctcctcctcagcctcctcactcgagggcacgaggatccgtgggctcagtctcgccctgactcagcctcgctcaggtcgtccgggtctccgtggactagtcagtcaccatctcctgccacgtcggaaccagcagcgattggtcggtgttataactttgctcctaggtaccaacaacnccaggcgaccggcccccatacattaagtttngatcgtactataacgccgcctcggacgggtccngactccgtcttcctcgtgcctaccgaagttcacggacaactcgtactccctactcgacctattacctcgtcggtcctccgacggtctacgacgtagtcggttagtcttaacttactacgtcgtacgttcgtacgttcgttaagttcggacgaccggccgtaccccgagttcccgtaggttactacgtttaccggttccggggaaccggtaacgggacccgtaacgtacccggtacggttaccccggtacggttaccgggcctaaccgggtcgtacggtaacccggg

SEQ ID NO: 94439 - DNA, 745 bp, Homo sapiens
  misc_feature: GYAE6OF02I5ZBQ.29.85.H08.1.454.CMB.1.raw
  modified_base (367)..(367): a, c, t, g, unknown or other
  misc_feature (367)..(367): n is a, c, g, or t
  modified_base (535)..(535): a, c, t, g, unknown or other
  misc_feature (535)..(535): n is a, c, g, or t
tcagatagagtactcacgaccggtgctcgatttagtatcactcagtcggcggggagctctgggagaggagccccagccctgagattcccaggtgtttccattcggtgatcagcactgaacacagagaacgcaccatggagtttggactgagctgggtttttccttgttgcttaattttaaaaggtgtccagtgtgaagtgcagctggtggagtcgtgggggagtcgtggtacagccgtgggggtccctgacgactctcctgtgcagcctctggattcaaagtttatgtattttccaatacacgttgggtccgtacgtaagcgtaccggggtaagggtctggggagttgggtactctcttaattaacncgtaaggacggtgactaactactattactatagccagtactccgtagtaaggaacggggtacctaagttcctaacccgaacgttaccttacccaaggtaaccgaaacgaaaaccaaaactaaaccgtaccttacccgttagtaacgttacgttacgaaccttaaaaanaggtaaaccgagttaaccgtaagggtaacgtaaaggttacggaaaccgtaaggtaaccggtacgggttaccttttaacgttattttaaacgtttacggtaaacgtaaaccggtaaaaacgggaacgggtaaaagggttaccgtaaaggggtaactttaaaccgggttaaaagggtaccgggggttaacccggtttaggtttaaacccggg

SEQ ID NO: 94440 - DNA, 699 bp, Homo sapiens
  misc_feature: GYAE6OF02IQNCC.29.85.H08.1.454.CMB.1.raw
  modified_base (219)..(219): a, c, t, g, unknown or other
  misc_feature (219)..(219): n is a, c, g, or t
  modified_base (262)..(262): a, c, t, g, unknown or other
  misc_feature (262)..(262): n is a, c, g, or t
  modified_base (411)..(411): a, c, t, g, unknown or other
  misc_feature (411)..(411): n is a, c, g, or t
  modified_base (587)..(587): a, c, t, g, unknown or other
  misc_feature (587)..(587): n is a, c, g, or t
tcagatagagtactcacgaccggtgctcgatttagtatcactcagtcgcggggagctctgggagaggagccccagccctgagattccccaggtgtttccattcggtgatcagcactgaacacagagaacgcaccatggagtttggactgagctgggttttccttgttgtctattttaaaggtgtccagtgtgaagtgcagcgtggtggagtcgtggggngtcgtggtacacgccgttgggggtcctgagactctcgtgtgcngcctgtggacttacgtaagtttaagtgttactttttccaattaccgtacgttcggggtaccgtacgaacggtccgtaccgggggtaaggtcgtgggtaggtcgggtcctcttactttaattaagtcggagtcggtgtacctacgtactnttctagtcgtactagacttgtagtacggaacgggtcctacgttacccaaccctattacccgtaccgtagaactaaccgaaacctaaacgtaaccgtaccttacccgtagttacttccgtacgtaacaaacttaacgggaactacggttctaaggaataacgggtacgacgtaacgnggaccgttacgttattacgttaatttcggaacgtaaccgtaaaaggtaaggaaaccggcgtaacggtaacgttaaccggttaaggggtccggttaccggttacggtttacgg

SEQ ID NO: 94441 - DNA, 155 bp, Homo sapiens
  misc_feature: GYAE6OF02HFPCO.29.85.H08.1.454.CMB.1.raw
  modified_base (148)..(155): a, c, t, g, unknown or other
  misc_feature (148)..(155): n is a, c, g, or t
tcagatagagtactcacgaccggtgctcgatttagtatcactcagtcgcgggacacgactggagattaaacgaactgtggctgcaccatctgtcttcatcttcccgcatctgaatagcgtactctgagcggctggcaaggcgcatagnnnnnnnn

SEQ ID NO: 94442 - DNA, 735 bp, Homo sapiens
  misc_feature: GYAE6OF02GHZN5.29.85.H08.1.454.CMB.1.raw
  modified_base (185)..(185): a, c, t, g, unknown or other
  misc_feature (185)..(185): n is a, c, g, or t
  modified_base (220)..(220): a, c, t, g, unknown or other
  misc_feature (220)..(220): n is a, c, g, or t
  modified_base (243)..(243): a, c, t, g, unknown or other
  misc_feature (243)..(243): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacgaggtatccgtgggctcagttctcgccctgactcacgccctcgctacgngtcggtccggtctccgtggactgtcagtccacctntcctccagctacgtacggaaccngacagcgtatacggtcggtagttactacgttgtctcctacgtaccaacaacgaccgacggaccgaccggaccccgtactcgaattattacgtagtactcgtactacgtaacggccggtaccgtacggtccgggtcctagtactcgtctccgtcgtcgtaccgtacgacgtccgtacggaacctaaccgtccgttccgtccccttaccgtaggttaccccgtaactttcccggttaccggttccgggtaccgttaccccggtaacggtaccttaccgggaaccgttaacgttacgggtaacccggttaagtttaaccgtttaacgttccgtacggtccttaacgtccgttaacgttagttacccggacgtaccgacccgtccgttacgtacgttccgtacgtcgttaccgggtcgggtaaccgggacggtaacgtaaccggtaccgtaccgtacccggttacggacgtacgtaccggtacctcggtaacccgg

SEQ ID NO: 94443 - DNA, 579 bp, Homo sapiens
  misc_feature: GYAE6OF02I42RK.29.85.H08.1.454.CMB.1.raw
  modified_base (228)..(228): a, c, t, g, unknown or other
  misc_feature (228)..(228): n is a, c, g, or t
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (311)..(311): a, c, t, g, unknown or other
  misc_feature (311)..(311): n is a, c, g, or t
  modified_base (481)..(481): a, c, t, g, unknown or other
  misc_feature (481)..(481): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggatcctgggctcagtctgccctgactcagcctcgctcagtcggtccgggtctcgtggacagtcagtcaccatcctctgcactcggaaccngcagcgatgtcggtgtatacttgtctctgtacacacaccngcgacgcccntcatatngatgctatacgcgacctcgcggtccngctcgtcttctcgtcggtctacgagtcgtcgaccaactcgtccgtccctcctagaccctagttccgtacggtcggtcctccggacggtctacgaaccgtggtacggtacggttattacgttacttacgtgtcgtacgtcgttacgtacgttcgcgtaccgccctaccggnttacgtcgtagttcgaccggttacgggacggtaaccggctaaccggtcggtacccggtaccgtaccgttacggacaccgggtaccctaggtaccccgg

SEQ ID NO: 94444 - DNA, 575 bp, Homo sapiens
  misc_feature: GYAE6OF02JVS13.29.85.H08.1.454.CMB.1.raw
  modified_base (136)..(136): a, c, t, g, unknown or other
  misc_feature (136)..(136): n is a, c, g, or t
  modified_base (143)..(143): a, c, t, g, unknown or other
  misc_feature (143)..(143): n is a, c, g, or t
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (365)..(365): a, c, t, g, unknown or other
  misc_feature (365)..(365): n is a, c, g, or t
  modified_base (407)..(407): a, c, t, g, unknown or other
  misc_feature (407)..(407): n is a, c, g, or t
  modified_base (454)..(454): a, c, t, g, unknown or other
  misc_feature (454)..(454): n is a, c, g, or t
  modified_base (497)..(497): a, c, t, g, unknown or other
  misc_feature (497)..(497): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacnggatccngggctacagtcctgcccctagacctcagccctccgtccggtgtcccgggtctcctggaccagtcagtccaccgtctcctgacngtcggaaccngcagtcgtacgttggcgtcttagtaaccgtgtacctccgtcgtaccagcaccgccccagccacgaccgaccccaaactcatcgtagttttcgacgtacagtactccgcccgtacgtacggtcctgtacncgtcttcgcgtcggtacagtcgcgcagccgacgtcctccgtntacgtactcgtacgtcggctccgtagacgtgacggtagcgtcgttanaattgtatcgactacgtctacatacgtaacgaacggcaacgtnttagtcgtacgtacgacgtagaccgaagtccgcgtacgtacggaccaccgacgaccgccaccgcgtactccgactccg

SEQ ID NO: 94445 - DNA, 158 bp, Homo sapiens
  misc_feature: GYAE6OF02FGUTS.29.85.H08.1.454.CMB.1.raw
  modified_base (150)..(158): a, c, t, g, unknown or other
  misc_feature (150)..(158): n is a, c, g, or t
tcagatagagtactcacgaccggtgctcgatttagtatcactcagtcgcgggacacgactggagattaaacgaactgtggctgcaccatctgtcttcatcttcccgccatctgaatagcgtactctgagcgggctggcaaggcgcatagnnnnnnnnn

SEQ ID NO: 94446 - DNA, 799 bp, Homo sapiens
  misc_feature: GYAE6OF02IIJK7.29.85.H08.1.454.CMB.1.raw
tcagatagagtactcacgaccggtgctcgatttagtatcactcagtcgcgggagctctgggagaggagccccagccctgagattcccaggtgtttccattcggtgatcagcactgaacacagagaacgcaccatggagtttggactgagtcgttgggttttccttgttgcttaagttttaaaaggtgtccagtgtgaagtgacagtcgtggtggagtcggtgggggtagtcgtggtacagccggttcggggggtccctggacgtactcctcctggtacgccagtcctcgtggtaactttcgtaaagttttaatcgttatttttcccaatacctacgtcgggttcccgtaccgtaacggtccggttacccggggggaagttcggttacgggtaggttcggggttccttccgttaacttttaacgtttaaacgtacggtacggtaacgggttctaacccgttaacttacctaagtttctagttcgacgtacgtaacttccgtagggtaggtaaccgggtcccgtaactttacccgaacccgtactccgtaccgtaaagacgtaaaccgtaaacaaaccgtaacgttacctacccgttagttacctcggtaacaacgtaaacgtaccgaacgtagttacgtaggtaacggaaacgttacgggaaccgaacggtaccggtaccgttaccgttttacgtttacgtttagtttccgaaggtaaaacgaaaaggtaaccgggtaaggaacgttacggtaacgttttaacggaacgggtttccggggttccgtacggtttaaccggg

SEQ ID NO: 94447 - DNA, 830 bp, Homo sapiens
  misc_feature: GYAE6OF02IGZTV.29.85.H08.1.454.CMB.1.raw
tcagatagagtactcacgaccggtgctcgatttagtatcactcagtcgcggggagctctgggagaggagccccagcccctgagattccccaggtgtttccattcggtgatcagcactagaacacagagaacgaccaccagtggtagtttggacgtggagtcgttgggttttttccgttgtttgtacttttaagtttttaaaaagggttcggttaccgtaaggttggttagtaaggtgaccgagtcgtggggtgggtaggtcgggtgggggtacggttcgttagggtaccgacggtccgggttccggggggtcccctaggtacgtacccgttccgtccgttacggtcgaccgtaccggtccgttagttacggtaacgtttacgttaaaaggttttaacttcgtttaccgtttttaccaacgttaaccgtaccggttacgggttcccggtacggtaacggtccggggtaccgggggtaagggttccggtagggtcggttcgggttcgttcgttaacgtttaagttaacgtcgtaacggtacggtactaccgtacttacgttattacgtagtacgtacgtaacgtaccttgtacggtacggtaccgggtctacgttccaacctactaccgacgaacgaacaaccgaaactaactaacccgtacctccttacgtactacgaaccgtactaacgtaacaacgtaagtacgttaagacgtaaggtacgaacgtacggtaccgtacgtttacttaacgtttattaccgtaggaacgtaaacggaagtaacggaggtacgagttaggtacgttaagggtcggttacgttcggttacgg

SEQ ID NO: 94448 - DNA, 747 bp, Homo sapiens
  misc_feature: GYAE6OF02I5T5I.29.85.H08.1.454.CMB.1.raw
  modified_base (148)..(148): a, c, t, g, unknown or other
  misc_feature (148)..(148): n is a, c, g, or t
  modified_base (159)..(159): a, c, t, g, unknown or other
  misc_feature (159)..(159): n is a, c, g, or t
  modified_base (181)..(181): a, c, t, g, unknown or other
  misc_feature (181)..(181): n is a, c, g, or t
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (328)..(328): a, c, t, g, unknown or other
  misc_feature (328)..(328): n is a, c, g, or t
  modified_base (343)..(343): a, c, t, g, unknown or other
  misc_feature (343)..(343): n is a, c, g, or t
tcagatagagtactcacgaccggtgctcgatttagtatcactcagtcggcggggggggtctcaggaggcagcactctcgggacgtctccaccatggcctgggctctgcctcctcctacagcctcctcactcagggcacaggtactccngggctcagtcnggccctgacttcgagcctgctntagtcgtccggtctcgtgactagtcagtccacatcctcctgacaccggtcgaaccngaccgagacgntcggtcggtacgttatacgtttcgtacttccgtacgtaaccaactaccgaccgtacggccggaaccggtccccccgtacncgtaactaacttacncggtacttacgtctaaggtttaaccgccggtaccgtcggtaccggtaccgtaggtaaccttcgtccttcgttaccgtggtaccgttacgaacgttcgttaggaaccctacgaccttcccgtacgtttaccccgcgtaccctagttccttcgtacccgggtacttaccggcgttacggttaccggaactacgtccggtacggttaagttactttagggtaacttggtccttaggcctacgtttcgtacgacgaccggtaacctccccgtaacgtcgtttacgaccggtttacgtaacgggttcccggggaaccttaaaccgggtacgaaccccgggttaggttaacccccgtaccggggttaccttaaccggggactttaccggaccgttaacccgggtacccgg

SEQ ID NO: 94449 - DNA, 680 bp, Homo sapiens
  misc_feature: GYAE6OF02GYYKC.29.85.H08.1.454.CMB.1.raw
  modified_base (230)..(230): a, c, t, g, unknown or other
  misc_feature (230)..(230): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggatcctgggctcagtctgccctgactcacgcctcgctcagtcgtccgggtctcctggacagtcagtccacatcctctgcacgtacggaaccngcacgcgatcggtcggtggttaataacgtttcgtctaccgtcggtaaccaacaaccaccgacggccggaccggaccccccgtactccgtaacttaactttacgtgatcgtactaagttaacgccggtcctacggtacggggtccctgactccgtcttctcgtcggctacgacgtcgtgacctaacacgtcgtcctccctacgtacctacgtccgtcgtcggtccgtccgtacggtcgtacggacgtacgtacggtacggtacgttacgtttaacgttacgtcgtacgttcgtaccgtacgttcgtttacgcgtaccgccgtacccgtcgtaccgtcgttacgtacgttccggttacgggaccgggtaacgggtaacccgtacggtacccgtacggtaacccggttcggttaaccggtacccgtaccggtaccggttacccgtaacccggg

SEQ ID NO: 94450 - DNA, 658 bp, Homo sapiens
  misc_feature: GYAE6OF02IO2L5.29.85.H08.1.454.CMB.1.raw
  modified_base (240)..(240): a, c, t, g, unknown or other
  misc_feature (240)..(240): n is a, c, g, or t
  modified_base (496)..(496): a, c, t, g, unknown or other
  misc_feature (496)..(496): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggactccgtgggctcagtctcgccctgacctcagccctcgcctcaggtcgtccgggtctccgtggacaggtcagtccaccatcctctgccacgtacggaaccngcagcgatcggtcggtggttacttaacttgtctccgtacgtaccaacaaccacccaggtccgaccggaccccccgatacctaataatttacgtagtatagtactattaacggcccggtccctgtacgggtccctagactcgtctctctcggtctactagtccgtgacacactcgacctccgcgacctactcgtaccgtgggcctccgaggtcctagacgtacgtcgtacgggtatagttaactcgtgtacgtcgtntaccgttattcgaccgacggtaccctcccggactacggttcgttacgtacgtttaccggttcggggaccgggttaaccggaacccggtaacgggtcccgtttaacgggacccggtttaccgggtaacggttacccgaccggttacccggtacgtaacccggg

SEQ ID NO: 94451 - DNA, 768 bp, Homo sapiens
  misc_feature: GYAE6OF02HGBWK.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcgagggcacaggactccgtgggctcgagtctcgccctgactcagcctcgctcagtcggtccgggtctccgtaggacagtcagtccacctactcctccgtgacctacgtacggaacctacgcacggacgtagttcggtcgggttaggttaacttacgttttcgtccttccgtaacggtaaccaaacctaaccgtaacccgacgggtacccggacccgggaccccctacgtacgtaactttaacgttactagatcgtactaacgttaacggcccggtccgtcggtaccggggttcctaggtaccgtccgttccgttacgtcgttacgtaccttaccgtaggttccgtacgacctaaacgtccgtcccgtacccttccgtacctaccgtacgttcccgtcggtccggtaccgaccgtcgggtacctacggtaccgtacggtaacggttacggttagttaacttacgttacgtcggtactacgttcgttacgttacgttacggccgtaccgtaccctaccggtctacggtcgtaccgttaccggttcgggtacccgggtaacggtacgggtaacccgtacggttaccgtcccggttaccgtaccgggttaccgtaccggtacgttaaccggtaccgttacccggg

SEQ ID NO: 94452 - DNA, 719 bp, Homo sapiens
  misc_feature: GYAE6OF02HMGRI.29.85.H08.1.454.CMB.1.raw
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacgaggatcctgggctcagtctcgccctgactcagcctcgctcagtcgtccgggtctccgtggacagtcacgtcaccatctcctgcactggaaccngcagnagtgtggtgttaatactttgtcctcgtgtaccaacaaccacccgaggccgacccggaccccccgtataccgtaattaagtttacgagtacgttcgtactaacgttaacggcccggtacccgtacggacggggttccctagtactccggtcctttcctcgtacggaccgttacctaaggccttacggaacctaacgtaccgttccgtcccgttacccgtacgaccctacgttccgtccgggtcggtccctccgaggtacctacggaacgacgttacggacggttagttaactttacgttaacgtcggtccttacggtactttacgtacgtttcggaaaccgtccgggtaacccgtccccgtaagtcgttacgggtccgtaccgttaaccggggttcgggaacccggggaacgggttaccaaccgggttccgaacccggttacccgttccggtaacggtcccgtaacgaccggttaccgaacccgg

SEQ ID NO: 94453 - DNA, 170 bp, Homo sapiens
  misc_feature: GYAE6OF02H39EF.29.85.H08.1.454.CMB.1.raw
  modified_base (142)..(170): a, c, t, g, unknown or other
  misc_feature (142)..(170): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggacnnnnnnnnnnnnnnnnnnnnnnnnnnnnn

SEQ ID NO: 94454 - DNA, 763 bp, Homo sapiens
  misc_feature: GYAE6OF02II375.29.85.H08.1.454.CMB.1.raw
  modified_base (661)..(661): a, c, t, g, unknown or other
  misc_feature (661)..(661): n is a, c, g, or t
  modified_base (749)..(749): a, c, t, g, unknown or other
  misc_feature (749)..(749): n is a, c, g, or t
tcagatagagtactcacgaccggtgctcgatttagtatcactcagtcgcggggagctctgggagaggagccccagccctgagacttcccaggttgtttccattcggtgatcagcactgaacacagagaacgcacagtggtagtttggactgagtcttgggttttccttgttgtcttagttttaaaaggtgtcagtgtgaagtgcagcgtggtggagttcgtagggggagtggtggtacgtcggccggttgggggtccctggacgtacctcgtccgtggtgccagtccccgtgtggtacttacgttaaagttttacgtagtttactttttaccaattaccgtacggttcgggtacccgtacgtaacggtccggtaccgggggtaaggttcggtaggtacggtcggttcctacgttacgtttaactaacgtcggtaacgtcggtcgtactacgtacgttattaacgtcgtcgactacgtcgttagtcggacggtaacggtccgtaacttaccacgtactaccgtacgaagactaaacctaacaaacgtaacgtacctccgtagtttacacgtagtaaactaatacgaacgtagtaccgaggaaacgtaaccgagttaaacccggacgtcggacccgttacgtttaacgttacgttaacggttntaaaacgggtaaccgtaaaagggtaaccgggttaaacgacgggtaacgttaaggttacccgggtttaaagggaccggggttttaaccnccgggttttaacgg

SEQ ID NO: 94455 - DNA, 759 bp, Homo sapiens
  misc_feature: GYAE6OF02JWGFX.29.85.H08.1.454.CMB.1.raw
  modified_base (197)..(197): a, c, t, g, unknown or other
  misc_feature (197)..(197): n is a, c, g, or t
  modified_base (341)..(341): a, c, t, g, unknown or other
  misc_feature (341)..(341): n is a, c, g, or t
  modified_base (491)..(491): a, c, t, g, unknown or other
  misc_feature (491)..(491): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggatccgtgggctcagtctcgccctgactcagcctcgctcagtcgtccggtctctggacngtcagtcactatctcctacacgtcggaaccagcgacgcgagttcggtaccggttaggttactaacgtttgtcgttccgtacggtaaccaaactaccaaccgacggaccgtaccggaccccccgacgtactaacgttaatttacncgtacttacggtactaacgtttaacgcccggtacccgtacggtaccggggttcctcgaacgttccgtcctttaccgtcgtcgtcctacgtaacgtcgtcgacgtaacacgtcctccctaccgtcaccctacgttcgtacctcgggtaccncgtacggtcctacggtaaccggtagttaccgggtacggtttaacgtacgttttaacgtttaccgtcggtaccgttacgggttcctttaacgttccggttttacggacccgtacccgggttacccacccgttaccgtaaccgttggttaaccgttacggtttaccgttccggggtaacggggttaccgggtaaccaacggttccccggttaggtaaccccggtttacggtaccggttacgaacgtacccgtacggtacccgttccccgg

SEQ ID NO: 94456 - DNA, 885 bp, Homo sapiens
  misc_feature: GYAE6OF02IBIA2.29.85.H08.1.454.CMB.1.raw
tcagatagagtactcacgaccggtgctcgatttagtatcactcagtcggcggggggggtctcaggaggcagcactctcgggacgtccccaccatcggcctgggctctgctcctcctcagcctcctcactcagggcacaggatccgtgggctcagtctgccctgactcacgtcctcgctcagtcggtccgggtctccgtggactacgtcacgtccacctatccttccgtgtacctaccgtacgggaaccacggacctaggaccgtaagttcggttacgggttacggtttaacttaaccgttttcgtaccttaccgtacggtaacctaaaccgaaccgtaacccgacggaccggaccggaccccccgtagtaccgtaaacgttaactttacgtacgtacttacgttacctaagttaaccggtccggtacccgtaccgggtaaccgggttccctacggtaccgttccgtaccgtttccgtcgttaccggtccgttaccgtacggttaccgtaccggtacctaaccgtaccgtaccgtacccgttaccgtaccgtaaccgtacgttccgttacccggtacgggtacccgtcccggtaacggtccgttaccggaaacggtacggttaaccgggttaaccggttacgtttaaaccgtttacgttaccgttcggtaccgtacgttaccgtttacgtacggtttccgacggtaacccggtaccctaaccgtacgtaccggtaggttacgttaacccggttccgggttaaccgggtaccgggtaaaccggtaacccggtaacgggtaccccggttaacccggttacccgggttaccgttaacggggttacccggtaaccgggtacccgttaaccgggtacccggttaccccggg

SEQ ID NO: 94457 - DNA, 944 bp, Homo sapiens
  misc_feature: GYAE6OF02G20YD.29.85.H08.1.454.CMB.1.raw
tcagatagagtactcacgaccggtgctcgatttagtatcactcagtcgcggggagctctgggagaggagccccagccctgagattcccaggtgtttccattaggtgatcagcactgaacacagagaacgcaccatggagtttggactgagctgggttttccttgttgctattttaaaaggtgtccagtgtgaagtgcagctgggtggagtcgtgggggagtcgtggtacagccgtggggggtccctgagactctcctgtgcacgcctcgtggtattactaagtttaatgtactttttccattacacgttcgggtacccgtacgaacggtccggtaccggggggaagggttccggtagggtagggttcggggttccttccgtttacgtttaacgtttaaacgttaccggtaagggtaccggggttacggtaccctttaaccgttaacctaacgttttaccttaagttacggtaccgtaaacggtaccctttccggtttagggttacggggaaaacccgggggtacccgttaacgttttaccccgaaacccttaaccgtttacccgttaaaccccgaacgggtaaaccggaaaaccctaaaaacccgtaaaacccgtaaaccggttaccccctttaaccccgtttaggtttaaaccttaccgttaacgaaaccttaaaaaggtaccgggaaaaccttacgggtttaacgttaacgggtaaaacgggtaaacgggtttaccgggaaaacccgtaaacggtaaccgggttacccggttaaccgtttttaacgtttaacgtttttacgtttacggggttaacgtaaaaccggtaaaaaacggggtaacgggttaaaacggggtaaccgtaaaggggttaaccgtttaaaccgggtttaaacgggggtttaccggggggtttaccggtttacggggttttaaacccgggg

SEQ ID NO: 94458 - DNA, 733 bp, Homo sapiens
  misc_feature: GYAE6OF02HZD80.29.85.H08.1.454.CMB.1.raw
  modified_base (251)..(251): a, c, t, g, unknown or other
  misc_feature (251)..(251): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcgagggcacaggatcctgggctcagtctcgccctgactcacgcctcgctcaggtcggttcccgggtctccgtacggactacgtcacgtccacctatccgtccgtcgaccacgtacggaaaccngcgacgcgtagtggtcggttaggttattacgtttcgtctccgttacgtaaccaactaaccgaccgaggaccggacccggccccgactacctaattaacttagtagtattcgtactacgttaacggccgtccgtacggccggttcgtacgtacgtcgtaccttcgttccgtcggtaccttacgtaacggttcgtaccggactaaaccgtcgtaccgtcccgttcccgaacgttacccgtcgtttcccgtacggggttccggtacctaccggtacgggccgtaacgtacgtacggtcggtaaacggttacttagtttaaccgttacgtgtaccgtgtaccgttacgtcgttaccgtacgaccgtcccgtaaccgcgtacgtgggttaccttacgttccggacggggtaccggtaaccggtacctaaccggttcgtaccggtaccgttaaccggaccggttacgcgttaccgtacgtaacccggg

SEQ ID NO: 94459 - DNA, 751 bp, Homo sapiens
  misc_feature: GYAE6OF02H9K38.29.85.H08.1.454.CMB.1.raw
  modified_base (183)..(183): a, c, t, g, unknown or other
  misc_feature (183)..(183): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggtttccttgttgcttaattttaaaaggtntccagtgtagaagtgcagctgggtgggagtcggtggggggagttcggtggtacacggtccggttcgggggggtccctggacggtacttccgtccgtgtcgcacgtccctacgtggtacttacgtaaagtttaattgttacttttttaccaacttactaccgttacgggtcccgtcaaacggtccggtaccggggggtaacggtcgtagggtagggttcgggttcctcttacgtttaagttaactacggacggtacggttcgactacttaacacttacgtactgactacgtacttgtaggtacggaacggggtccgttaactaccgtaccgtacttaccgtaccaacgtaacgaaacaaaccgtaaacgtaaacgttacccttcccgttacgttacttccgtaagaactaaacgtacgtaacgtaacgttacgtagtaaagggacggttagaaccggtaacgacggtcgttaccttacttagtttacgttacggaagtaacggtaaaaaggaggtaaacggacgtagggtacttaacggtaaggggttcggttacggtaggtttaccgg

SEQ ID NO: 94460 - DNA, 170 bp, Homo sapiens
  misc_feature: GYAE6OF02IZSPA.29.85.H08.1.454.CMB.1.raw
  modified_base (146)..(170): a, c, t, g, unknown or other
  misc_feature (146)..(170): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggatccgtnnnnnnnnnnnnnnnnnnnnnnnnn

SEQ ID NO: 94461 - DNA, 751 bp, Homo sapiens
  misc_feature: GYAE6OF02H67VR.29.85.H08.1.454.CMB.1.raw
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctctggtaccaacaacacccaggcgacggcccccgactcataatttatgatgtactattaacgcggtcctcgacggggtccctgactcgtcttctctggtcctcgaagtcgtcggacaacactcgcctccctnacctatcgtcgtcggccttacgnggctgacgtagtcggacggtagtattacttaacgtgtacgtcgtctacgttagttcgacgtacggacccgtacccgtataccgttggttacggtacgtttccggttaccgggggtacgggtaacggtacccggtaaacgtccgttaaccgggtccgtttaccggtaacggtcccgtaacggtacccgttaaacgtacccgggttccgtcccccggtacccccgggtttcgttacccgttaacccgttcccggttttccccgggttacccccgtaccccgtttacccgttaccgtaaacccgttttcccggttaaactttaccgttaccggtacgggcccgggttcccggggttaacgtaccggaaacgggttaaaggtcccccgggaatttacgggccggtttaagaccggctcgtagcgtacgtactcgtacgtagtcgtcgtagtcg

SEQ ID NO: 94462 - DNA, 804 bp, Homo sapiens
  misc_feature: GYAE6OF02JXKPI.29.85.H08.1.454.CMB.1.raw
  modified_base (236)..(236): a, c, t, g, unknown or other
  misc_feature (236)..(236): n is a, c, g, or t
tcagatagagtactcacgaccggtgctcgatttagtatcactcagtcgcgggggggtctcaggaggcagcactctcggacgtctccaccatggcctgggctctgctcctcctcagcctcctcactcagggcacaggactcctggctcagttctgccctgactcagcctcgctcagtcgccggttctcctggactagtcagtccacctgtctaccgtgcctaacgtcgggaaacccngtaccgagccggtaattgggttccggttcggtttaacttaaccgttttacgttccgttacccgttacgggttaaaccccaaacctaaacccgtacccggaacggtacccgtaaccccggcccccccggtaacctaccgaactttaaaactttacgacgtacttacgttacgtaacgtttaacggaccggccccgtttacggtaccgggggttaccctaggtaaccgtcgtccttttccgtaccgttcgtaccgtacccgttaacggttcctacgggacctaacccgaacgttccgtaccctttacccggttacaacccttacgtcccgttacgtccgggtacctaccggtacggtaccttagggaacccgttaggtacccgggttaaggttcgtaagtttaccggttaacctggtaaccgttacttcctacgttttacgttacggccgtaacgttaccgacccctagtaccgtgttaccgtacgttccggtaccgggaaggtaccggtacgaaccgtaccggtaccgtacggttacccgaaggttcccacggtacgttaccgaaccgg

SEQ ID NO: 94463 - DNA, 535 bp, Homo sapiens
  misc_feature: GYAE6OF02JF4EY.29.85.H08.1.454.CMB.1.raw
  modified_base (185)..(185): a, c, t, g, unknown or other
  misc_feature (185)..(185): n is a, c, g, or t
  modified_base (223)..(223): a, c, t, g, unknown or other
  misc_feature (223)..(223): n is a, c, g, or t
  modified_base (302)..(302): a, c, t, g, unknown or other
  misc_feature (302)..(302): n is a, c, g, or t
  modified_base (376)..(376): a, c, t, g, unknown or other
  misc_feature (376)..(376): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
tcagatagagtactcacgaccggtgctcgatttagtatcactcagtcgcggggggtctcaggaggcagcactctcgggacgtctccaccatggcctgggctctgctcctcctcagcctcctcactcagggcacaggatcctgggctcagtctgccctgactcagcctcgctcagtgtccgggtcncctggacagtcagtcaccatctactgcactggaaaccngcagcgatcggtcgtgttatacttgtctctacgtacaacacaccgagacgaccggcccactactacttaattactagtntctactagttaacgccgtacctcgacggtcctagtactcgtctctcgtcgtactactagtcgtacgacctaacnctcgtcctcgtataccatctcncggtcncgagtctgacagtcgtacggtataattctactcgtctgtctcgtagtcgctacgcctaccgctcgtgtacgtactcgtcggcggtacggactacgtctacggaccttcgtaggtctacgaccgtagtaccg

SEQ ID NO: 94464 - DNA, 709 bp, Homo sapiens
  misc_feature: GYAE6OF02JLV4Z.29.85.H08.1.454.CMB.1.raw
  modified_base (300)..(300): a, c, t, g, unknown or other
  misc_feature (300)..(300): n is a, c, g, or t
  modified_base (472)..(472): a, c, t, g, unknown or other
  misc_feature (472)..(472): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcacgggcacaggatcctgggcctcagtctgccctgctcgagcctcgctcagtcgtccgggtctccgtaggacagtcagtcacatctctgcactcggaaccagcagcgtatcgtcggtgttatacttgtctctacgtactacaacaccagcgacgccccgatacattactagtntactgtctacgtacgcgtaccctcgtacggtctcgtatccgtcgttctcggtcgtactcgtaacgtcgtacgactaacaccgtcgtccctcccgcgtaccctacgtttccctccggtccgggtccctaccggtacgtaccgtacgaaccgtacggtacgggttaacgggttntaaccgtttaaagttccggttacggttccgtacgttccggttacttacggttttacgacccggtaacggtaaccccttcccggtagttaacccgtttgggttacgtacccgtttcggggtacccgggtaaccggggtaaggtacccggtaaaccggtcccggttaacgggttaacccccggttaacgggtcccgggttaaccggtaccccggttaccggttacccggtaaccccggg

SEQ ID NO: 94465 - DNA, 764 bp, Homo sapiens
  misc_feature: GYAE6OF02FUVA5.29.85.H08.1.454.CMB.1.raw
  modified_base (144)..(144): a, c, t, g, unknown or other
  misc_feature (144)..(144): n is a, c, g, or t
  modified_base (199)..(199): a, c, t, g, unknown or other
  misc_feature (199)..(199): n is a, c, g, or t
  modified_base (229)..(230): a, c, t, g, unknown or other
  misc_feature (229)..(230): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatccgngggctcagtctgccctgacctcacgcctcgctcagtcgtccggtctccgtggacngtcagtcaccatctcctgcactcggaaccnncagcgattcggtcggttgttactaactttcgtctcgtcgtaaccaactaaccaccgacggcgaccggcccccgacgtacctaattaactttagtacgtacgtcgtactaacgtttaacggcccggtccccgttacggtaccgggggttccctacggtacttaccggtcctttaccgtcgttacgggtaccctttaccggtaacgttccgtacgggaacctaaaccgtaccgttaccgtaccccttcccgtacggtaaccctacgttaccgtccgggtagggtcccttaccggtacggtctaccgggaacgtacgttaacggtacggttacgttaacttttaccgtaaccgttcgtaccgttacgttccttaacgtttcgttacgtccgtaccgggtaccctacccgtacgtaacgtttcgacgttaccgttccgggtccggggtaacgggtaaccgggtaaccccgtacggttacccgtccggttaaccggttaccggttaacggtaccgtaccgtaccgtaccgtaacccggg

SEQ ID NO: 94466 - DNA, 624 bp, Homo sapiens
  misc_feature: GYAE6OF02HEKCD.29.85.H08.1.454.CMB.1.raw
  modified_base (263)..(263): a, c, t, g, unknown or other
  misc_feature (263)..(263): n is a, c, g, or t
  modified_base (537)..(537): a, c, t, g, unknown or other
  misc_feature (537)..(537): n is a, c, g, or t
  modified_base (612)..(624): a, c, t, g, unknown or other
  misc_feature (612)..(624): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacaccaggcgacggccccccgatcataatttatgatgtctattaagccggccctcgaggggtccctggatcgcttctcgtggctccaagtcgtggccaaacnctcgccctcctgaccctatcctcgtgggcctccgtaacgtccttagaacgagtggaccgggttataactttattaccgtgccgttgtccttacgtagtttcgaccgtacggcccaacccgtcgtacgttgttggtaccgttcccggttacggggaccgggaacgggtaacccgtaacggccggttacgggtaccccgtaccggtcggtaccgacggtccgtacgaacgtcccgtacccgccccgtcggtacctccgttccgttcccgttccccncccgttacctcgtaactcttcgtcgtacgtcgacgggtccgtaccggtcggtaccggacggcgatagtcgatcgnnnnnnnnnnnnn

SEQ ID NO: 94467 - DNA, 767 bp, Homo sapiens
  misc_feature: GYAE6OF02IWH8E.29.85.H08.1.454.CMB.1.raw
  modified_base (148)..(148): a, c, t, g, unknown or other
  misc_feature (148)..(148): n is a, c, g, or t
  modified_base (659)..(659): a, c, t, g, unknown or other
  misc_feature (659)..(659): n is a, c, g, or t
  modified_base (747)..(747): a, c, t, g, unknown or other
  misc_feature (747)..(747): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgatcataatttntgatgtcattaagcggccctcgaggggtccctgatcgtcttctctggctccaagtctggacaactacgtgccctcccgtagacctattcgtccgtcgggccttaccgaggtcctgacgtatacggtacggtattaactttacgttaccgtgtccttcggtccttaccgttagtttcggaccgtaaccgggtccctaccccggtacgtacggttggtacgtaccgttcggtaccggggacggtaacggacctaacgtccgtacgtacccgttccgtaggtccgagtaccgttacggaacgttcccgtaccccggtaccccgttaggtacccttaccgttacccggttccccggttaccccccgtacccccttttaccgtaccggtttaacccgttaccgtttaccgtttaacccggtaccgtttaccggggtacccgggttacccggggtaccgggttaccgggtaacccggtaacgggtacccggttaaccgtaacgttaccgagttacgngtacgtaccgtcgacttaccgctaccgggacttacgtaacgacgcgttacgtagtccgttacgatacggacgccggaactggtaccgngtacacgtgactagcgtaag

SEQ ID NO: 94468 - DNA, 619 bp, Homo sapiens
  misc_feature: GYAE6OF02FNEVM.29.85.H08.1.454.CMB.1.raw
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
  modified_base (413)..(413): a, c, t, g, unknown or other
  misc_feature (413)..(413): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggactccgtggctcagtctcgccctgactcgacgcctcgctcagtcgtccggtctccgtgacagtcagtccacnctcctctgacacgtacgaaccngcagcgagtcgtcggtgttatacttntctctgtaccaacacacgngcgaccgcccatctatattatgtatgtacatacgccgtcctacggtcggtcctgctcgtcgttctcgtcgactctacgtcgtcgactacgtccgtcgccctccacgtacctacgtccgtcgccggtacctaccgnggtactacggtacgacgttacggtacggtacgttaactttacgtaccgtcgtcgtacgttcgttacttagttaccgaccggtacgaccctccggtactaaccgttgtaccgttacggttaccggtacgggtaccgggaacggtaaccgtacggtacccgtaccgggtacccgttccgttacggacacggttaccctacggtacccg

SEQ ID NO: 94469 - DNA, 824 bp, Homo sapiens
  misc_feature: GYAE6OF02FVZ4I.29.85.H08.1.454.CMB.1.raw
  modified_base (165)..(165): a, c, t, g, unknown or other
  misc_feature (165)..(165): n is a, c, g, or t
tcagatagagtactcacgaccggtgctcgatttagtatcactcagtcggcggggagctctgggagaggagccccagccctgagattcccaggtgtttccattcggtgatcagcactgaacacagagaacgcaccatggagtttggactgagctggtttcctgttncttatttaaaggtgtccagtgtgaagtgcagctggtggagtcgtgggggagtcggtggtacagtccgtggggggtccctgagacctcgtcctgtcgctacgtccgtctaggtattactaaacgttttaagtgttaacttttttcccaattacctaacggttgggttacccgtacgtaaacggtccgtaccgggggaacggttcgtgggtaacggttcggggttccttcgttaccgtttaagtttaacgtccggtaggtaccggtgtaccttaacttaacgtactttacctagttacgacgtaacggtaccttacggtaggttaacgggaaccgggtaccggttaacttaccctaacccgtacttacccgtaacccgaaagggtaactaaacccgaaaaccgtaaaccctaaaccggttaacccgttaccccgttagttaaccgttaccgtacgtaaacctaaagtaccgaaacttacggttaaccgtaggaaccgtaaaggttacggaaaccgtaacgacgggttaccggttaccgttttacgtttacgttagtttacgggttaacgaaacgttaaaagggtaaccggtaacgggacgtaaacgggttaacttaccgggttaaacgggttcgggttaccggttacggttttaacccggg

SEQ ID NO: 94470 - DNA, 843 bp, Homo sapiens
  misc_feature: GYAE6OF02IRA1F.29.85.H08.1.454.CMB.1.raw
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatccgtgggctcgagtctcgccctgactcacgtcctcgctcagtcgtccggtctcctggactagtcacgtccaccatcctcctgcctacgtacggaacccagtcacggcgtagttcggttcggttacggttaacttaacgttttcgtaccgttccgtacgtaaccaaccaccgaacccgtacggcccggaacccggacccccgtactactaacgttaagtttacacggtatcgttacgtaagttaccggccggtaccgttaccgggaccggggttacccgtagtaccgtccgttcccttcgttccgtcggtacccttacgtaacggttccgtacggaacctaaccggtaccgtcccggtaccccttaccgtacgtacccgttactttaccgttccgggttccgtacccggttaccgacgggtacccgttacgggaaccggtacgttacggggttaaccggtttaacgtttacgtttaaccgttaccgttcggtaccgttacgttaccgtttaccgttacgtttccggaccggtacccggtaacccgtccccgtacgttaccgggttaccgttaccgggttaccggttacccgggttaccggggtaacccggggaaccggtaacccggtacgttacccgggttaccgtcccggttaaccggttaaccccggtcggtaaccccggtccggttaaccggtaccccgg

SEQ ID NO: 94471 - DNA, 676 bp, Homo sapiens
  misc_feature: GYAE6OF02GR2BC.29.85.H08.1.454.CMB.1.raw
  modified_base (148)..(148): a, c, t, g, unknown or other
  misc_feature (148)..(148): n is a, c, g, or t
  modified_base (216)..(216): a, c, t, g, unknown or other
  misc_feature (216)..(216): n is a, c, g, or t
  modified_base (612)..(612): a, c, t, g, unknown or other
  misc_feature (612)..(612): n is a, c, g, or t
  modified_base (619)..(620): a, c, t, g, unknown or other
  misc_feature (619)..(620): n is a, c, g, or t
  modified_base (625)..(625): a, c, t, g, unknown or other
  misc_feature (625)..(625): n is a, c, g, or t
  modified_base (628)..(628): a, c, t, g, unknown or other
  misc_feature (628)..(628): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (650)..(650): a, c, t, g, unknown or other
  misc_feature (650)..(650): n is a, c, g, or t
  modified_base (669)..(669): a, c, t, g, unknown or other
  misc_feature (669)..(669): n is a, c, g, or t
  modified_base (672)..(674): a, c, t, g, unknown or other
  misc_feature (672)..(674): n is a, c, g, or t
tcagatagagtactcacgaccggtgctcgatttagtatcactcagtcagtcaccatctcctgcactggaaccagcagcgatgtcggtggttataactttgtctcctggtaccaacaacaccaggcgacgccccccgatcataatttangatgtcattaagccggccctcgacggggtccctggactcgcttctctggctccaagtctggaccaacnctcgcctcctcgacctattcctcgtcgggcccttccgacggctgaacgagtacggtacgtaggttaactttaacgttccgttggtacctcggtccttacgttacgttttcggaccaacgggccccaacccggacgttaccggttaggttaccggtacgtttaccggttccggggtaaccggggtaacgggaaaccgtaacggtccgtaccggtacccgttaccggtacgggtactaaccgggtctaacgggacggtcccgtcccgtccccgtacggtcctaccgtttcccgtccgtttacccctacccgttacctacgttaaccgttacccttataccgttcgtacgggtccgggccgggtccggacgggaccgagggtaccgacgtaacgtacgncgtcacnngtacncgntctgngngctcgagtcgctctngatgacgtgtcgtcgtgtnagnnntg

SEQ ID NO: 94472 - DNA, 738 bp, Homo sapiens
  misc_feature: GYAE6OF02HLVH3.29.85.H08.1.454.CMB.1.raw
  modified_base (240)..(240): a, c, t, g, unknown or other
  misc_feature (240)..(240): n is a, c, g, or t
tcagatagagtactcacgaccggtgctcgatttagtatcactcagtcggcggggggggtctcaggaggcagcactctcgggacgtcgtccaccatggcctgggctctgctcctcctcagcctcctcactcagggcacaggatcctgggctcagtctgccctgactcagcctcgctcagtcgtccggtctccgtgacacgtcagtccgcctatcctccgtagccacgttacgggaaacccngacctgtacgtagttgttagtaagtaaattagtcgtacttacgtccttacccgtttacggtaaccaaaccaacccaacccagacctaacgaccgttaccaaacgaaaacacctagtacgtaactaactaactaagtacgtactaactccgtaccgtccgtaccggtacggggttccctaagtaccgttcgttttacccgtcgtcggtacctacctaacgtcgtacggtaactacgtcgaccgtacccgtcgtaactaccgtaccgtaacgttcctacgtacggtaccttaccgacggtaccgtcggaacggtaccggtacgtccgtaagttacgtttagtacggtcgtaccgttggttaccttacccgttaggttacccgacggtacccggtacccacccggttaaccgtacgtcgtacggttaccttacccgggtttaccgggaacgggtaccggaacgtaccggtaccccgtacgggtacccgtacggttaaccgg

SEQ ID NO: 94473 - DNA, 738 bp, Homo sapiens
  misc_feature: GYAE6OF02HU4OO.29.85.H08.1.454.CMB.1.raw
  modified_base (577)..(577): a, c, t, g, unknown or other
  misc_feature (577)..(577): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggactccgtgggctcagtctgccctgactcagcctgcctcagtcgtccgggtctccgtggacagtcacgtcacctatctcctcgcacgtacggaacctgacacggcgtagtcggtacggttagtttaacttactttcgtcctccgtacggtaaccaaccaaccgaaccgacggtacccggacccggccccccgtataccgtaattaacgtttagtcggtacttgtacctaacgttaacggtcccggtacccgttccgggtacgggttccctaggtaccgttccgttaccgtttccgtcgtccggtcctaccgtaacggtccgtacgacctaacgtaccgtccgtccctcccgtacgacctacgtccgtcggtcggtcctaccggacggtcacggtacgtacgtgggtaacgtacttacgttaacgtccgtagtcccgttnttcccgtaattcgttacgacctaccggacccgtcctacgtacgttggtaccttaaccggttcggtaccgggggaaccggaacgggttacccgaaccgttacccggttccggtaaccccgttacggtacggtaaccgttcggtaccgtaccggttaccccgg

SEQ ID NO: 94474 - DNA, 694 bp, Homo sapiens
  misc_feature: GYAE6OF02G7A2P.29.85.H08.1.454.CMB.1.raw
  modified_base (366)..(366): a, c, t, g, unknown or other
  misc_feature (366)..(366): n is a, c, g, or t
  modified_base (660)..(660): a, c, t, g, unknown or other
  misc_feature (660)..(660): n is a, c, g, or t
  modified_base (672)..(672): a, c, t, g, unknown or other
  misc_feature (672)..(672): n is a, c, g, or t
  modified_base (683)..(684): a, c, t, g, unknown or other
  misc_feature (683)..(684): n is a, c, g, or t
  modified_base (689)..(689): a, c, t, g, unknown or other
  misc_feature (689)..(689): n is a, c, g, or t
  modified_base (692)..(692): a, c, t, g, unknown or other
  misc_feature (692)..(692): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtgttataactttgtctcctggtaccaacaacacccaggcgacgcccccgatcataatttactgatgtctacttaacgcggcccttgacggggttccctgactcgtactttcgctcggcctccgaagtcgtcggacacacttcgacctaccgtgacctaagtctcgtacgggcctaccgagtcgtacgacgagtcgacgtagtactttaacgtacgcgacttggacctgtagttcncggtaaccgcctaccgtacacggttgacgtcgttaccgttccggggagggaaacggtaccgttaaggccctttaacgggtaacccgttacggttaacggtacgtacggtaaacccgtcggtaaaccggtccgtttacccgaccccgggtttacccgttcgttaacccgttcccggtttacccgttacccccggcctttaaccggtccttaaacgggtttaccttaccttaaccggtacttacggggaacgtccggggttaccttaccgggaacgttacgggaacgtgtttacgngactgctaacgngtctagactcnngtacnganac

SEQ ID NO: 94475 - DNA, 664 bp, Homo sapiens
  misc_feature: GYAE6OF02IQRH7.29.85.H08.1.454.CMB.1.raw
  modified_base (641)..(641): a, c, t, g, unknown or other
  misc_feature (641)..(641): n is a, c, g, or t
  modified_base (647)..(647): a, c, t, g, unknown or other
  misc_feature (647)..(647): n is a, c, g, or t
  modified_base (649)..(650): a, c, t, g, unknown or other
  misc_feature (649)..(650): n is a, c, g, or t
  modified_base (652)..(652): a, c, t, g, unknown or other
  misc_feature (652)..(652): n is a, c, g, or t
  modified_base (662)..(663): a, c, t, g, unknown or other
  misc_feature (662)..(663): n is a, c, g, or t
tcagatagagtactcacgaccggtgctcgatttagtatcactcagtatgccctgactcagcctcgctcagtgtccgggtctcctggacagtcagtcaccatctcctgcactggaaccagcagcgatgtcggtggttatactttgtctctggtaccaacaacaccaggcgacggcccccgatcataatttatgatgtctagttaacgccgcctgcgggtcctgactcgtcttcgtcgtacggcctacgtacgtctggaccaaactcgtccgcccttaccccgtcaaccgtacttcgttccggtcgggtcctaccggagggtccgttaaggaaccggtaaggttcgggtaaccggttcgtttaaacttttaacgttacgttaccggtcgttcgggtccctttacggttagttttccggacgtaaccggaccgtaccccgtactacggttcgtcgtaacgtttccggttcggggacgggacggtaaccgaacgtacgtccggtaccgtccgtacgtacgacgtcgtacgacgtccgtccgtccccgtcgtacctcttccgttcccttaccccgaccttcctcgtaccttacctacttcgtacgtggaccggtcggtacgtcggaacgacggctaacgagtacgntgtcgngnngncgcgctgcgnnc

SEQ ID NO: 94476 - DNA, 726 bp, Homo sapiens
  misc_feature: GYAE6OF02FR5HM.29.85.H08.1.454.CMB.1.raw
tcagatagagtactcacgaccggtgctcgatttagtatcactcagtcgcgggggagctctgggagaggagccccagccctgagattcccaggtgtttccattcggtgatcagcactgaacacagagaacgcaccatggagtttggactgagctgggttttccttgttgctatttaaaggtgtccagtgtgaagtgcagcgtggtggagtcgtgggggagtcggtggtacaggccggttcgggggtccctgagactcctccgtgtcgcacgcctcgtggactttactaaagtttaatgttactttttccaacttacctacgtcgggttaccgtacgtaacgtccggtaccggggggtaagggtcgttaggggtaggtcggggttccttaccgtttcgtttaatttaacggtcggtaacggtaccgggtagttaccgtaacttaccttaagtttctaagtgtacaacgtaccttacgtggtacgggtaacgggtcccgatttaccgaccctactcctaccgaagacgaacaaacgaaccgtaacgtacccttccgtattacttcgacgtactaaatacgaacgacttacgtagtaaaggagtacggaacgacggtacggacgttccttaagttattgttaaggtacgaaaccggaaaaggaacgggtaaacggaggtaacggtagttaaccggtaagggtttcggggttacccgttaggttaacccgg

SEQ ID NO: 94477 - DNA, 580 bp, Homo sapiens
  misc_feature: GYAE6OF02F9O92.29.85.H08.1.454.CMB.1.raw
  modified_base (242)..(242): a, c, t, g, unknown or other
  misc_feature (242)..(242): n is a, c, g, or t
  modified_base (393)..(393): a, c, t, g, unknown or other
  misc_feature (393)..(393): n is a, c, g, or t
  modified_base (498)..(498): a, c, t, g, unknown or other
  misc_feature (498)..(498): n is a, c, g, or t
tcagatagagtactcacgaccggtgctcgatttagtatcactcagtcgcggggggggtctcaggaggcagcgctctggggacgtctccaccatggcctgggctctgctcctcctcacctcctcactcagggcacaggctcttgggcccagtctgccctgattcagcctcctcgtgtccggtctcctggacagtcagtcgccatctcctgcactggaaccagcagtgatgttagagtaattangtactcgtcctcccgttcggtaaccaaactaaccacccaagaccacacgtaccaacaaacacgatagactaataacaatacgtacaagtactccggcctacgacgggtcctacgtattcgttctctcggactactaagtcgtacgactagngccgtcctcatcaactatctcgtcgacctcgacggtctagggacggaacgtggacgttacgtaatttaagttcggtacggtcttgctatactattaacgtaacgntagtcgtacgtacgttagggacggttcggaacggaggaccaagtacgtcgtaccgtacgtcggactacggaccgacggtccg

SEQ ID NO: 94478 - DNA, 853 bp, Homo sapiens
  misc_feature: GYAE6OF02JU54A.29.85.H08.1.454.CMB.1.raw
  modified_base (329)..(329): a, c, t, g, unknown or other
  misc_feature (329)..(329): n is a, c, g, or t
  modified_base (363)..(363): a, c, t, g, unknown or other
  misc_feature (363)..(363): n is a, c, g, or t
tcagatagagtactcacgaccggtgctcgatttagtatcactcagtcgcggggggggtctcaggaggcagcgctcgtggggacgtctccaccatggcctgggctctgctcctcctcacctcctcactcagggcacaggctcgttgggcccagttctgcccttagattcacgccctcccgtccgtggtcccgggtctcccgtgggaactacggttcacggtccgcccattccctccgtgacctactcgggaaacctgcgaacgttggattggtttaggaataaatttgcgacgttctcctccgttaggtaaccaacaaccaccgtagacncgacgtaccaacaaccgacactgtaataacgtanaacgtacgtactaaaacgtccgtacccggtaccgttaccgaaccggggttccctacgtaacgtttcccgtttcgttaccgtacggtccttaacccggtaacgttccgggtacgttacgtaaacgtcccgggtacccggttccgttaacccgtaacgttacccggtaaacctccgttttacccgtacggttacccggtaccgttaccgtaaacgggtccctttaagggacccggttaaccggaacgggttcttaacggtacggtttaaacgttcgggtaacggttcgtcggtaaccttacaacggtttataaaggttaactaccggttacggtttacccgggtaactttaacggggtttaccggggttacggtttaacccgggggtacgggtaaaccgggtacccgtaacggtaacccggtttaccggtaccccgggttacggggtaccgggtaacccgttaccgggttacccggtaaccgtcccccgggg

SEQ ID NO: 94479 - DNA, 732 bp, Homo sapiens
  misc_feature: GYAE6OF02G54PA.29.85.H08.1.454.CMB.1.raw
  modified_base (238)..(238): a, c, t, g, unknown or other
  misc_feature (238)..(238): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacgaggactccgtgggctcagtctcgccctagactcagcctcgctcgagtcgtccggtctccgtggactagtcagtccactatctacctgctacgtcggaaccngcgacgcgacgttggtaccggttaggtttaacttaacgtttcgtccttaccgtacggtaacctaaaccaaccgacccgacgggaccgaccggtaccccccgaacgttacaaacgtttaactttacgtacgtacgttacgtacgtaacgttaaacggcccggtacccgttacggtaccgggtacctagacttccgtcttcgtcgtacggtaccgtacgaacgttcgtacggtaactaacgtacctcgtcccttaccgtacgacctacctccggttacgtccgggtcccttacggacggtcgttaacggacgtacgtacgggtaacgtcgttaattaccgtagttccgtcgtacgttccttacgttagtccgtacgaccggttccaaaccgtcgttacgttacgttcgtacgttccgggttcgggaacggtaccggtaaacgcggttacccgtacgtaccggtcgttaccgacgtacgtaccgtacggtaacccgg

SEQ ID NO: 94480 - DNA, 629 bp, Homo sapiens
  misc_feature: GYAE6OF02F9J3E.29.85.H08.1.454.CMB.1.raw
  modified_base (362)..(362): a, c, t, g, unknown or other
  misc_feature (362)..(362): n is a, c, g, or t
  modified_base (410)..(410): a, c, t, g, unknown or other
  misc_feature (410)..(410): n is a, c, g, or t
  modified_base (489)..(489): a, c, t, g, unknown or other
  misc_feature (489)..(489): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcgtgggttttccttgttgctatttaaaaggtgtccagtgtgaagtgcagctggtggagtcgtgggggagtcgtggtacagccgtggggggtccctggagactcgtcctgtgcacgcctgtggattctaagtttaatgtatttttccaattacctacgtcgggtccgtacaacgtcgtaccgggggaggtcgtagggtggtgggtcttacgtntttaagttaatcgaggtcggtagtctactactattctagtgcagtctntggtaggaacggtccgtattcctactacgtcctaccgagacaacaacaaacgtaactaccttcctacgtaacttcgtanactaaatcgtaacgtacgtacgtagaacgtaaggacgtacgaacacggtaccgtactttacgtatttagttacgtaacgaactaaaaggacggttaaggagtaagtacgtaacggttaaggtcgggttacgtagttacgg

SEQ ID NO: 94481 - DNA, 654 bp, Homo sapiens
  misc_feature: GYAE6OF02GZGP9.29.85.H08.1.454.CMB.1.raw
  modified_base (378)..(378): a, c, t, g, unknown or other
  misc_feature (378)..(378): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatccgtgggctcagtctgccctgactcagcctgctcagtcggtccggtctccgtggactagtcagtccaccatcctcctcgcacgtacggaaccagctagcgtatcggtcggtagtatacttgctccgtagtaaccaacaaccaccgaggccgaccggcccccatacaacgttaattagtagtatcgtactaagttacggccgtacctcggtaccgggtcctagtacgtccgtcttccncgtcgacttacgtaacgtcgtcgaccaaactcctacgtcccctccgaccgtactaccgttccgttacgtcgggtcctaccggtacgcgtacggacgtacgtacggtcggtttacgtaacttacgtacgtcgtcgttacgtcgtactttcgtcgaccggtccggtaccgtaccgaccgttacgtacgtcgtaccgttcggttacccgggacgggtaaccggaccggtaagttcccggtaccgtcggtacggtacgtcgacgtaccgtaccgtaccgg

SEQ ID NO: 94482 - DNA, 883 bp, Homo sapiens
  misc_feature: GYAE6OF02JKCMF.29.85.H08.1.454.CMB.1.raw
  modified_base (227)..(227): a, c, t, g, unknown or other
  misc_feature (227)..(227): n is a, c, g, or t
tcagatagagtactcacgaccggtgctcgatttagtatcactcagtcgcggggagctctgggagaggagccccagccctgagattccccaggtgtttccattcggtgatcagcactgaacacagagaacgcaccatggagttggactgagtctgggtttccttgttgtctatttaaagtgtcagtgtgaagtgcagcgtggtggagtcgtgggggagtcgtggtacngccgtcgggggtcctgagactctcgtgtcgcgacgctcgtggtacttacgtaaagtttaacgtgttactttttacccgtaattaaccgtaccggtttcggggttacccgtacgtaacggtaccgggttaccccggggggtaaacggggttcggtacggggtaagggtttccgggttccctttcgttacgttttaaacgtttaacggttaccggtacgggtaccggtacggttaccgttaaccgttaccgttacgtttaccttaaggttacggtaccggttacgtaaccgtttacgttacgggtaacggggtaaccggggacccgttacttaaccgtaaccccttaacggttccctaacccgaaaggtaacccgaaaacctaaacccttaaaaccgtaacgtttaaccccttcccgttaacgttaccgttaccgtaaccgtaaaccgtaaacgttaccggaaacctaacgtacccggttaggaaaagttaaccgggtaacgaacggtaaccgacggtaccggttacgttttaacgtagtttaacgttcggtaaaacgggtaacgttaaaaagggaaccggtaacgggaacggttaaccggggttaacttaacgggttaaacggggtttccggggtaccggttttacggtaacccggg

SEQ ID NO: 94483 - DNA, 895 bp, Homo sapiens
  misc_feature: GYAE6OF02JZKQZ.29.85.H08.1.454.CMB.1.raw
  modified_base (138)..(138): a, c, t, g, unknown or other
  misc_feature (138)..(138): n is a, c, g, or t
  modified_base (805)..(805): a, c, t, g, unknown or other
  misc_feature (805)..(805): n is a, c, g, or t
  modified_base (837)..(837): a, c, t, g, unknown or other
  misc_feature (837)..(837): n is a, c, g, or t
tcagatagagtactcacgaccggtgctcgatttagtatcactcagtcgcggggggggtctcaggaggcagcactctcgggacgtctccaccatggcctgggctctgctcctcctcacgcctcctcacctcagggcacnggatcctgggctcagtctcgccctggactcgacgtcctcgtcctcgtacgtcggttcccggggtcttcccgtgggacctaacggtccgtaaggtccgaaccctacgttccttcccgttaggaccgtaacgttaccggggaaaccctcggaacctaacgggtaccgtaacgttcggttacggggttacgggtttaaacgttaaccgttttacgttacccgttaccgttaccgggttaaacccaaaccccgtaaaacctaacccgggtaacggacccgggtaaccccgggtaacccccccgtaaccgttacccgtaaacgtttaaacgtttaacgttacggtaacctttacgtaccgttaaccggttaaccggtccgggttaccccgtaccgggtaacgggggttccccgtaaggttaaccgtcccggttaaccttccggttaccgtaccggttacccgtacgttaaccgtacggttaccgtaaccgaaccggttaccgtccgtaacccgttccccgtaacgttcccgtaaacgtttcccgtcgggttacccggtacccgtttaccgggacgttcccgaaggttacccggtacggttacggtaacggttcgttaacgtttaacgttacgtcgtaccgtacttcggtactcggttacacgtccggtaccncgtacgtacgtcgacttcgtccggttaacggngggtaaccacggacgttacgtcgtaccgttcggacgtacgcgtaaccgtcgtaaccgg

SEQ ID NO: 94484 - DNA, 152 bp, Homo sapiens; identical to SEQ ID NO: 93475
  misc_feature: GYAE6OF02HTVGD.29.85.H08.1.454.CMB.1.raw
  modified_base (150)..(152): a, c, t, g, unknown or other
  misc_feature (150)..(152): n is a, c, g, or t

SEQ ID NO: 94485 - DNA, 195 bp, Homo sapiens
  misc_feature: GYAE6OF02GN5IW.29.85.H08.1.454.CMB.1.raw
  modified_base (159)..(195): a, c, t, g, unknown or other
  misc_feature (159)..(195): n is a, c, g, or t
tcagatagagtactcacgaccggtgctcgattttagtatcactcagtacgcgggacaacggacctaggagacttaaacgaactgtgcctgcaccatctgtcttcatcttcccgccatctagaatagcttactgtgagcgggctaggcaaggcgcatagnnnnnnnnnnnnnnnnnnnnnnnnnnnnnnnnnnnnn

SEQ ID NO: 94486 - DNA, 673 bp, Homo sapiens
  misc_feature: GYAE6OF02JHWMK.29.85.H08.1.454.CMB.1.raw
  modified_base (302)..(302): a, c, t, g, unknown or other
  misc_feature (302)..(302): n is a, c, g, or t
tcagatagagtactcacgaccggtgctcgatttagtatcactcagtcgcggggggggtctcaggaggcagcactctcgggacgtctccaccatggcctgggctctgctctcctcagcctcctcactcagggcacaggatcctgggctcagtctgccctgactcagcctgcttcagtcgtccgggtctccgtggacagtcagtccacctatctcctgctactggaacctagccaggcgtatcggtcggtggttatacttgtctcgtacgtacaacacaccagcgaccgccccgatcataattngtatgtactattaacggcgtcctacgacgggtcctgactacgtctcctcgtcgctacgtacgtctacggcctaaactcgttcgaccttcccgaggtacccacgttccctcggttaccggtcctacccgtcggtaccgttacggaaccggtaacgtcggtaacgggttacgtaagtttaccgttacgttaccgcgttacgtccgttactaacgtttcgaaccgtaccgggtaaccctacccggacttaacggtcgttaaccgcgttaaccggttccggggtaccggggtaaccgggttacaaccggggttccgttacccggttaacccgggttacctaccgggttcggaaccctacggttacccgaaaccgg

SEQ ID NO: 94487 - DNA, 723 bp, Homo sapiens
  misc_feature: GYAE6OF02H36HS.29.85.H08.1.454.CMB.1.raw
  modified_base (515)..(515): a, c, t, g, unknown or other
  misc_feature (515)..(515): n is a, c, g, or t
tcagatagagtactcacgaccggtgctcgatttagtatcactcagtcggcgggggggggtctcaggaggcagcactcgtcgggacgtctccaccatggcctgggctctgctcctcctcagcctcctcactcgagggtcacgagtactccgtggctcagtcctcgcctgactcgcgtccctcccgtccgccggaccggttctccgtaggactacgtactacgtccaacctacttctccgtcggccgtctaggaaccgagtcgtaggtcggtacggtttgggtacgttatacggtattacgtcgtctccggtattaacgtaccaaaccgtaccgaaccccggtactaaacctacccccgtaataccgtgtacgtttactacggacgtacgtaccgtacgtacccgtaccgtcggtaccgggtactcggtacttcgttacttcgttccgtactacgtacgtcgtacgtacacgtacgtccctacggtactccgtacttcggcgttccacggtacgtcncgtaacggtgtacgacgttcgtcgtaagtacgttcgtactccgttccaagttacctaagtcgtaaccgtgacccttaaaggttacgtttccggttacgttcgggtaaccgggaacgggtaaccgtaccgtacgtccggttcgtaacccggttacctgtaacctagtccgtactaacggtccgtaccggtccccgtccggtcttacccg

SEQ ID NO: 94488 - DNA, 837 bp, Homo sapiens
  misc_feature: GYAE6OF02IKSFN.29.85.H08.1.454.CMB.1.raw
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
tcagatagagtactcacgaccggtgctcgatttagtatcactcagtcgcgggggggtctcgaggaggcagcactctcgggacgtctccaccatggcctgggctctgctcctcctcagccctcctcactcagggcacaggactccgtgggctcagtcctgccctgactcagcctcgctcaggtcgtccggtctccgtggaactgtcagtccaccntcctccgtgctactggaaccnggcacggcagttggtcggtagttacgttaacttgtccttcgtacggtaaccaacgaaccgtacccgaacgggtccgaccgggccccccctaagtaccgtaatttaaacgtttacgactaagttcgtactaaagttaccgacggtccccttacggtaccggggtccttacgtaacgtccgttccgtttccgttcgtcgtaccgttacccgtaacggttccgttacgggtaccaaaacccgttcccggtaaccggttccctttaccccggttacggttaaacccgaaccgtttttacccgtccgggtttaacccgggtcccgtttaaaccccgccgggtttaccgttaccgggaacgttaccggtacgggttaaccgggtacggttaaacttttacccgggtactacggttccgttacgcccgttaacgttagttccgtaaccggtcgtaccccggtaccctacgtaccgttagtacccggttacgtttccgggttaccggggaccggttaaccggggaacccttaacggtcccggtaccgggttaaacccgtttcccggggtaaccgtaccggtaccgtacccggtttaaccgtaacccgggg

SEQ ID NO: 94489 - DNA, 621 bp, Homo sapiens
  misc_feature: GYAE6OF02I51RQ.29.85.H08.1.454.CMB.1.raw
  modified_base (229)..(229): a, c, t, g, unknown or other
  misc_feature (229)..(229): n is a, c, g, or t
  modified_base (294)..(294): a, c, t, g, unknown or other
  misc_feature (294)..(294): n is a, c, g, or t
  modified_base (326)..(326): a, c, t, g, unknown or other
  misc_feature (326)..(326): n is a, c, g, or t
tcagatagagtactcacgaccggtgctcgatttagtatcactcagtcgcgggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtcagtcaccatcctcctgccacgtaggaaccngcagcgatgtcggtgttatacttgtctctgtaccaacacaccaggcgaccgccccatcatattangatgtactagtacgccgtcctacgacggtccngactcgtcttctcgtcgtcctacgaacgtcgacgacaactcgtccgtacccttccgtactaacccgtacttcgtccgtacggtcctaccggtacggtccgtaggacccgtagtacggtaacggttacgttaacgttacgttaccgtacgtccgttacgttcttacgttagtttccgcgtaccggtacccaccgtcctagtacggtcgtacgtccggttacgggacccgggtaacggtaccgtaacgtcccgtacgtaccgttcccggtacgtaccgtcgtaccgtaccgtaccgg

SEQ ID NO: 94490 - DNA, 547 bp, Homo sapiens
  misc_feature: GYAE6OF02IL873.29.85.H08.1.454.CMB.1.raw
  modified_base (227)..(227): a, c, t, g, unknown or other
  misc_feature (227)..(227): n is a, c, g, or t
  modified_base (289)..(289): a, c, t, g, unknown or other
  misc_feature (289)..(289): n is a, c, g, or t
  modified_base (347)..(347): a, c, t, g, unknown or other
  misc_feature (347)..(347): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacaggatccgtgggctcagtctgccctgactcagcctcgctcagtgtccgggtctccgtggacagtcagtcaccatcctctgcactggaaccngcagcgatgtcggtgttatacttgtctctgaccaacacaccagcgacgccccatcatattangatgtcatacgcgcctcgacgggtcctgctcgtcttctctcggctcagtcgtgacacncgtcgcctcctcgacctactcnctcggtcctcgngctgacgagtcggacgtagtaattacttacgtcacgttgtcctacgtatttgccgtacggaccgacccgtcgtacgtacgttgtaccgttcggttaccgggcgggtaacgggaccaacggtccgtacgtacccgtccgtacgtaccgacgtaccgtacgtaaccgg

SEQ ID NO: 94491 - DNA, 677 bp, Homo sapiens
  misc_feature: GYAE6OF02H4H5C.29.85.H08.1.454.CMB.1.raw
  modified_base (230)..(230): a, c, t, g, unknown or other
  misc_feature (230)..(230): n is a, c, g, or t
  modified_base (406)..(406): a, c, t, g, unknown or other
  misc_feature (406)..(406): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatccgtgggctcagtctgccctgactcacgcctcgctcagtcgtccggtctccgtgacagtcagtccacctatctcctgcacgtggaaccngcagcgatggtcggtgttatacgttgtctcgtcgtaccaacacaccgaggcgaccggcccccactctaattaacgttatcggtatacgtactaacgtttaacgacccggtcccttaccgggacggggttccctagtacctccgtcttacctcgtcgcctacagtcgacgactaacncgtcgtcctcccgtacgacctctacctcgtaccggtcctacgagtcgtgacgtaagtcggaacggttagtaatttacgttacgtcgtacgttcgttacctagttcggtttaccgcggaaccggttacccgacccgtacgtaccgtacgggttaccttacgggtttcccggtacggggtaaacccggtacggggacccgtaaaccggtccggttacccgggttaccttcccggttaaccggtcggtaacccggtccgtaccgtaaccccggg

SEQ ID NO: 94492 - DNA, 721 bp, Homo sapiens
  misc_feature: GYAE6OF02GMDGR.29.85.H08.1.454.CMB.1.raw
  modified_base (198)..(198): a, c, t, g, unknown or other
  misc_feature (198)..(198): n is a, c, g, or t
  modified_base (552)..(552): a, c, t, g, unknown or other
  misc_feature (552)..(552): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcgttggttttccttgttgcttagtttaaaggtgtccagtgtagtaagngcagcgtgggtggagttggtgggggagtcggtggtacgaggtccggtcgggggtcctggacgtaccgttctccgtgtcgcgtacgccgtacgtggactttcgaaagttttaacttgttactttttccaattactacggttcggttacctacgtaaggtccgtaccgggggtaagtcgtacgggtaggttcggtacttacgttacgtttacgttaacgtcggacggtacggtgtaccttaacgtacttattacgtagtcgtactacgactccgttagcggtaacgcgtacttccgaacttcgaccgtcaacggagaaaccaacgtaaactaccgtcctcgttaagtcgttcgaanaacgttaacacgtaacgtagtacgacgtaaagaccggtagaaccgtaccgaggttcccgttacgttcgttaagttacgtaggtaacgtaaaccggtaaaggtacgtacgggtacaacgggtttacggtaaccgttaagggggttcgttaccgggtttacgttaacccgg

SEQ ID NO: 94493 - DNA, 695 bp, Homo sapiens
  misc_feature: GYAE6OF02HSD5B.29.85.H08.1.454.CMB.1.raw
  modified_base (124)..(124): a, c, t, g, unknown or other
  misc_feature (124)..(124): n is a, c, g, or t
  modified_base (213)..(213): a, c, t, g, unknown or other
  misc_feature (213)..(213): n is a, c, g, or t
  modified_base (233)..(233): a, c, t, g, unknown or other
  misc_feature (233)..(233): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctnactcagggcacaggatccgtgggctcagtctgccctgactcacgcctcgctcagttcgtccgggtctccgtggaccagtcagtccactntcctcctgcacgtggaaccngacagcgtatcggtcggtagtttactaacgtttcgtcctccgtacggtaaccaacctaacacccgaggtaccggaccggaccccccgtactcctaatttaacttacgtacgtacttctactaagttaacggccggtccctcggtacgggtccctgtacgtcgtccgttcttcgtcggtaccttaccgtaacgtccgtacgggacctaaacgtacctccgtacccgttcccgtacgtaccctaacgttccgtccggttacgggtccctacccggtacgggtccgtacggtaccggtagtaccgggtaccgggttacgttacgttttaacgttccgtcgttacgttacgtcctttacgttacgtttcgacgtaccggcctaacccgtctacgtcggttacgtcgttcgtaccgggacggaccgggtacacgtcgacgtaccgtcgtacgtcgacgtctacgtcg

SEQ ID NO: 94494 - DNA, 1084 bp, Homo sapiens
  misc_feature: GYAE6OF02GUVZO.29.85.H08.1.454.CMB.1.raw
tcagatagagtactcacgaccggtgctcgatttagtatcactcagtcggcggggggggtctcaggaggcagcactctcgggacgtctccaccagtggcctgggctctgctcctcctcagcctcctcactcgaggcacgaggtactccgtgggacctcgacgttccgtacgtcccgtagtaccgttaccgaaccggtcccgttaccgccgtacgtacggttccgggttccggggttacccttcccggtagggtaaccgtaacgttccgtaacgtaccccgtaaacctaccggtttcccttccggttacggacccgttaaccgggtaaccgggtaaaccccgaaggtccgtaaccggaccggttaaggttccgggttaccggggttaaccgtttaaacgtttaaccgtttcgttaccttaccggttacgtaacccaaaacctaaccggacccgtaaccgggacccggtaccccggacccccgtaacgtaaccgttaacgtttaacgtttaacggtacgttaccgtagttaccgtaaccgttacggtccgtaaccgtcccgggtacggtaccgtacggtacgtcccgttactccgtttacgtcgtccgttaaccgttacgtccggtaaccgtaccgtaaacgtcccggttacccgtacccgtacccgtaaccggtaaccgttaccggttaccgttacccggttacccgggttcccgttaaccgggtaccggtacccggttaccgggtaaaccgtaccgggttacgggttaacgggtttaccggttaaaccgttttaaccggttacggttaccgttccggttaccgggtttacccgtttaccggttaacccgggtttcggtaacccggtaacccgggttacccgtaaaccccgggttccttaaaccccggggttttcggtaacccgtttaccggttacccgggggtaaacccggggttaaccgggggaaacccggtaacccgggtttacccggtaaacccgggtttaccccggttaccccggggttaacccggtaacccgggttacccggtaacccgggtttaccggtaaccccgggttaccccgggg

SEQ ID NO: 94495 - DNA, 590 bp, Homo sapiens
  misc_feature: GYAE6OF02F567S.29.85.H08.1.454.CMB.1.raw
  modified_base (118)..(118): a, c, t, g, unknown or other
  misc_feature (118)..(118): n is a, c, g, or t
  modified_base (189)..(189): a, c, t, g, unknown or other
  misc_feature (189)..(189): n is a, c, g, or t
  modified_base (219)..(219): a, c, t, g, unknown or other
  misc_feature (219)..(219): n is a, c, g, or t
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
  modified_base (287)..(287): a, c, t, g, unknown or other
  misc_feature (287)..(287): n is a, c, g, or t
  modified_base (566)..(566): a, c, t, g, unknown or other
  misc_feature (566)..(566): n is a, c, g, or t
  modified_base (571)..(571): a, c, t, g, unknown or other
  misc_feature (571)..(571): n is a, c, g, or t
  modified_base (574)..(575): a, c, t, g, unknown or other
  misc_feature (574)..(575): n is a, c, g, or t
  modified_base (577)..(580): a, c, t, g, unknown or other
  misc_feature (577)..(580): n is a, c, g, or t
  modified_base (582)..(582): a, c, t, g, unknown or other
  misc_feature (582)..(582): n is a, c, g, or t
  modified_base (584)..(587): a, c, t, g, unknown or other
  misc_feature (584)..(587): n is a, c, g, or t
  modified_base (589)..(590): a, c, t, g, unknown or other
  misc_feature (589)..(590): n is a, c, g, or t
tcagatagagtactcacgaccggtgctcgatttagtatcactcagtcgtgccctgactcagcctcgctcagtgtccgggtctcctggacagtcagtcacatctcctgcactggaaccngcagcgatgtcggtgttataacttgctcctggtaccaacacacccaggcacggcccccgatcaataatttngatgtcaattagccgcctcgaggggtcccngactcgcttctctggctacaagtctggcaacnctacgcctccgtcgaccnctctcgtcggtcctacgnggtctgtacgtagtggtaccgtgtaactttactacgtgtctggaccttctacgttcgacgaacgtccacccgctacgtcggtagtcttaccggttaccgggacgggaaccggaaccaacggttccgtaacggtacccgtaccgttacggtccgtacgtacgtacgacgttccgtaccgtcccggtacggtccacgttccgtcccgttacccgcccttaccgtccgtaacgttcctacctcgtacgtacggtaccggcggtaccgtcgcgacgtccgtangtagngcnncnnnncncnnnntnn

SEQ ID NO: 94496 - DNA, 559 bp, Homo sapiens
  misc_feature: GYAE6OF02FHK3E.29.85.H08.1.454.CMB.1.raw
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (274)..(274): a, c, t, g, unknown or other
  misc_feature (274)..(274): n is a, c, g, or t
  modified_base (465)..(465): a, c, t, g, unknown or other
  misc_feature (465)..(465): n is a, c, g, or t
tcagatagagtactcacgaccggtgctcgatttagtatcactcagtcgcgggggggtctcaggaggcagcgctctggggacgtctccaccatggcctgggctctgctcctcctcacctcctcactcagggcacaggctcttgggcccagtctgccctgattcagcctccctccgtgtccgggtctcctggacagtccagtcgccatcctcctgccactcggaaccagcagtcgattggttnagattangactgtctccttggtaccaacaaccncccagacacacgtccacaaacacatgatatacaatgtacaatactccggcctcgaacggggtcccctgatcgttctctggcctcaagtctggctaatgcggccttcgatgaccatctacgtcgtcgtccaaggcctaggacggacggagtctagtacttattgtcgacgtcgactactattactataacgntacgttgtctaacggttagggttggtaccggcgggtaggtaccctaaggtctacggtaccgtccgtacgggtacacggaccccgtaaggtcccg

SEQ ID NO: 94497 - DNA, 638 bp, Homo sapiens
  misc_feature: GYAE6OF02GOI7V.29.85.H08.1.454.CMB.1.raw
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
  modified_base (322)..(322): a, c, t, g, unknown or other
  misc_feature (322)..(322): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (609)..(609): a, c, t, g, unknown or other
  misc_feature (609)..(609): n is a, c, g, or t
  modified_base (619)..(619): a, c, t, g, unknown or other
  misc_feature (619)..(619): n is a, c, g, or t
  modified_base (624)..(624): a, c, t, g, unknown or other
  misc_feature (624)..(624): n is a, c, g, or t
  modified_base (626)..(627): a, c, t, g, unknown or other
  misc_feature (626)..(627): n is a, c, g, or t
  modified_base (630)..(630): a, c, t, g, unknown or other
  misc_feature (630)..(630): n is a, c, g, or t
  modified_base (632)..(634): a, c, t, g, unknown or other
  misc_feature (632)..(634): n is a, c, g, or t
  modified_base (636)..(638): a, c, t, g, unknown or other
  misc_feature (636)..(638): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaaacaacacccaggcgacggccccccgatcataatttangatgtcaattaagcgccctcgaggggtccnggactcgccttctctcggcctccaagtctggcaacactcgcctccctgaccacgtcgtcgtgggtcctccgacggtctcgacgactagggacggtntaagtttactacgtgtcgtntccgtnttagttcgacgtacgggcctaccccggtctacgtcgttagtacgttcggttcgggacgggtacgggaacctacggtccgtaccggtacccgttaccggtacgggtccgtacggtaccgtccggtaaccggtccgtacccggtcccccgttcgggtacccttaccgttcccgttacccgttacccctaccccgttcctaccgtaaccgttaccttaccgtacttccgtacggtacggtcggacggttcggacgacggaccgngtactaggcntcgangnngcncnnncnnn

SEQ ID NO: 94498 - DNA, 902 bp, Homo sapiens
  misc_feature: GYAE6OF02F7ZH1.29.85.H08.1.454.CMB.1.raw
  modified_base (219)..(219): a, c, t, g, unknown or other
  misc_feature (219)..(219): n is a, c, g, or t
tcagatagagtactcacgaccggtgctcgatttagtatcactcagtcgcggggagctctgggagaggagccccagcccctgagacttcccgaggtgtttccattcggtgatcagcactgaacacagagacgcaccagtggagtttggactgagtcgttgggttttccttgttgtacttaagttttaaaaggtgtacctagtgtagaagtgcagcgtggnggtagtcggagggggtcgtcgtagggtacacggtccggtcgggggtcctaggacgtacgtcctccgtgtcgcacgtcctacgttaggtaacttttaaggttttaggacgttcatacgtccgtagtacggaacggttccggggtacccgaccggtacggtccgtaccgggaagggggaacggggtcggagggtaacgggtcgggttacggtaccggtacgttaaggttacggtcggtacgaacggggttcggtcgggtaccttaagtttaagttacgttaagttacggtcgtaacccggtaacggtaccccggtccgggttaacgggggtacccggggtttaccccgttaacctaaccgtttacggtttaacccgaaagggtaaaccggtaaacccttaaggttaccggaaaacgaacccgttacggttactaggtttaacgacgtaaagtacggaaaggttacgggaacgtacccgacgttaagaaccgggttaccaaccggggaaccctaccgggtaaccccggttacctttaaggtttacgttttaacggtaggggtttaaaaccgaaccgggggtcgtaaaccccgggttagggtaaacccggggttaacccggggttaaaccggggggtcccccggtaaccgttaacccgggttacccgggtaaccccgggaaccgggg

SEQ ID NO: 94499 - DNA, 720 bp, Homo sapiens
  misc_feature: GYAE6OF02JJO4C.29.85.H08.1.454.CMB.1.raw
  modified_base (428)..(428): a, c, t, g, unknown or other
  misc_feature (428)..(428): n is a, c, g, or t
  modified_base (674)..(674): a, c, t, g, unknown or other
  misc_feature (674)..(674): n is a, c, g, or t
tcagatagagtactcacgaccggtgctcgatttagtatcactcagtcgcggggagctctgggagaggagcccagccctgagattcccaggtgtttccattcggtgatcagcactgaacacagagaacgcaccatggagtttggactgagctcgggttttccttgttgtcttatttaaaaggtgtcagtgtgaagtgcagctggtggacgtcgtgggggagtcggtggtacaggtccggtgggggtccctggagtactccgtcctgtgcacgtcctctggattactaagtttaatggttacttttccaatacacgttcgggtaccgtacgaacgtccggtaccggggtaagggtcgtgggtaggtcggtctcgttcttaagttaacgtcggaggacggttgtctaacgtactacttactaatggactanacttcgtaggtagtaaccgggctaacgtttcccaacctctaccgttccgaaagtaccgtaaacctaaacgtaaacccgtaaacgttccccttaaccgtttagtaaccttacgttaaccaaacgttaaacgtaaccgtaataacgttaccgagttaaacggacgtacggaaccgttaacgaacggtcgttaacctttgtaatttacggtagtaaccggtaaaggaaaaagttacggagtaaacccgnggtaacttaacggttaacgggtcggttacggttaccggtttaacgg

SEQ ID NO: 94500 - DNA, 635 bp, Homo sapiens
  misc_feature: GYAE6OF02IN9J8.29.85.H08.1.454.CMB.1.raw
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggactcctgggctcagtctcgccctgactcacgcctcgctcagtcggtccgggtctccgtggacacgtcagtcaccatcctcctgcactgaaccagcagcgatggtcggtgttaattactttgtcctcgtacggtaaccaacaaccaccgacggccgaccggcccccgactctaacttaatttactagtacttcgtactaacttaacgcccggtccctacggtacgggtccctagactcgtcttctctcggtctacacgtctcgacaactactcgtcctcctacgtacctntcgtcgtcggctccgnggtacagaccggtgtacggtacggtattaacttagttacgcgtccgttcgtccttacgtttacgtttcgacgtaccggtcccgaccgtcgtaacgtgttaccgtacgtttccggtaccgggcggggaacggacctaacggtaccggtacccgtacggttaccgtaccggtacgactaccgacggtaacccgg

SEQ ID NO: 94501 - DNA, 589 bp, Homo sapiens
  misc_feature: GYAE6OF02GDE8N.29.85.H08.1.454.CMB.1.raw
  modified_base (120)..(120): a, c, t, g, unknown or other
  misc_feature (120)..(120): n is a, c, g, or t
  modified_base (149)..(149): a, c, t, g, unknown or other
  misc_feature (149)..(149): n is a, c, g, or t
  modified_base (216)..(216): a, c, t, g, unknown or other
  misc_feature (216)..(216): n is a, c, g, or t
  modified_base (233)..(233): a, c, t, g, unknown or other
  misc_feature (233)..(233): n is a, c, g, or t
  modified_base (257)..(257): a, c, t, g, unknown or other
  misc_feature (257)..(257): n is a, c, g, or t
  modified_base (278)..(278): a, c, t, g, unknown or other
  misc_feature (278)..(278): n is a, c, g, or t
  modified_base (532)..(532): a, c, t, g, unknown or other
  misc_feature (532)..(532): n is a, c, g, or t
  modified_base (534)..(536): a, c, t, g, unknown or other
  misc_feature (534)..(536): n is a, c, g, or t
  modified_base (542)..(542): a, c, t, g, unknown or other
  misc_feature (542)..(542): n is a, c, g, or t
  modified_base (551)..(551): a, c, t, g, unknown or other
  misc_feature (551)..(551): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (564)..(565): a, c, t, g, unknown or other
  misc_feature (564)..(565): n is a, c, g, or t
  modified_base (567)..(567): a, c, t, g, unknown or other
  misc_feature (567)..(567): n is a, c, g, or t
  modified_base (569)..(570): a, c, t, g, unknown or other
  misc_feature (569)..(570): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
  modified_base (582)..(583): a, c, t, g, unknown or other
  misc_feature (582)..(583): n is a, c, g, or t
  modified_base (585)..(585): a, c, t, g, unknown or other
  misc_feature (585)..(585): n is a, c, g, or t
  modified_base (588)..(588): a, c, t, g, unknown or other
  misc_feature (588)..(588): n is a, c, g, or t
tcagatagagtactcacgaccggtgctcgatttagtatcactcagtcagtcaccagtctcctgcactggaaccagcagcgatgtcggtggttataactttgtctcctggtaccaacaacncccaggcgaggcccccgatcataatttangatgtcattaagcggccctgaggggtccctgactcgtctttctctggctccgaagtcgtggacaacnctgcctcctgaccatcncgttgggcctccaggcctgaacgnttcggacgtgtattactacgngtcgtcgtcgtctagtttcgacgtacggcctaaccggcctagttggtcgtaacttccggttacggggaccgggtaacgggaacctaaggtccgtttaacggacccgttaccgttagggtccaagttccgtacgaaacggtcccgtaccgaccccgttggacctacgttccttaccgtcccctcctaccgtctacgtactcctatcgtacggacggtcgggcgttcggaccgtaaggtccgtaactaggttacgncnnngcgacncgactcgcncgcgcgcgngngnngngnngngncngcngcnncncgnc

SEQ ID NO: 94502 - DNA, 791 bp, Homo sapiens
  misc_feature: GYAE6OF02F35HW.29.85.H08.1.454.CMB.1.raw
  modified_base (184)..(184): a, c, t, g, unknown or other
  misc_feature (184)..(184): n is a, c, g, or t
  modified_base (380)..(380): a, c, t, g, unknown or other
  misc_feature (380)..(380): n is a, c, g, or t
tcagatagagtactcacgaccggtgctcgatttagtatcactcagtcgcgggggagctctgggagaggagccccagccctgagattcccaggtgtttccattcggtgatcagcactgaacacagagaacgcaccatggagtttggactgagcttgggttttccttgttgcttattttaaaggtntccagtgtgaagtgcagcgtggtggagtcgtggggggagtcggtaggtacaggccgttcggggggtcccctaggacgtacctctccgtggtcgcacgccgtctggtaactttacgtaaaggttttaattcggttaactttttccgaattacctacgttcgggtaccgtacgacgcggtaccgggggtaaggttcgngggtaggtcgggtaccttcgttacgtttattaagtccggtaggtacggtcgtactaaccttacgatttcacgtgtactagtacttcgttaagggtcggaaccggggtccttacgtaccaaccgtactacccttaccggaacgaagtaaaccaaacctaaactaaaccgttacccctccgttacgtattcccgtaagaacctaaaagttagaaacccgttaggtacctaggggtaaaccttaaagggcggtaaacccggttaaaccgcgggtttaaccccggtgtttttaaacccgtaggtttttaactggggttaaaacccgaaaaggaaaaagggttcggaaacggggaccgaaaggtttccggttaacggtaacgggggtttacgggtaccggtttacggtttaacggg

SEQ ID NO: 94503 - DNA, 634 bp, Homo sapiens
  misc_feature: GYAE6OF02FQ3DZ.29.85.H08.1.454.CMB.1.raw
  modified_base (225)..(225): a, c, t, g, unknown or other
  misc_feature (225)..(225): n is a, c, g, or t
  modified_base (254)..(254): a, c, t, g, unknown or other
  misc_feature (254)..(254): n is a, c, g, or t
  modified_base (427)..(427): a, c, t, g, unknown or other
  misc_feature (427)..(427): n is a, c, g, or t
  modified_base (457)..(457): a, c, t, g, unknown or other
  misc_feature (457)..(457): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagcgatgtcggtgttatacttgtctcngtaccacaacaccaggcgacgccccgactcataatttatgtatgtactagttaagccggtacccggtccggggtcctgactcgcttcgtctggcctcgagtctcggcaacactcgcctcctcgacctatcctcgtgggcctccgacggtcgtagacgtagtacggtacggttntacgtttaacttcgttcgcttcgtaccttntacgtttggaccgtacggccctacccgggacctacggttgttacgtaacggtttcccgtaccggggggtaccggaaacccggggtaacctaacgggtcccgttaccgggtaaccccggttaccgttaacgggggtaccctaacggttcccggtaaccggtacccggttccccccggg

SEQ ID NO: 94504 - DNA, 705 bp, Homo sapiens
  misc_feature: GYAE6OF02FFMQ6.29.85.H08.1.454.CMB.1.raw
  modified_base (119)..(119): a, c, t, g, unknown or other
  misc_feature (119)..(119): n is a, c, g, or t
  modified_base (350)..(350): a, c, t, g, unknown or other
  misc_feature (350)..(350): n is a, c, g, or t
  modified_base (683)..(683): a, c, t, g, unknown or other
  misc_feature (683)..(683): n is a, c, g, or t
  modified_base (690)..(691): a, c, t, g, unknown or other
  misc_feature (690)..(691): n is a, c, g, or t
  modified_base (693)..(695): a, c, t, g, unknown or other
  misc_feature (693)..(695): n is a, c, g, or t
  modified_base (697)..(697): a, c, t, g, unknown or other
  misc_feature (697)..(697): n is a, c, g, or t
  modified_base (699)..(699): a, c, t, g, unknown or other
  misc_feature (699)..(699): n is a, c, g, or t
  modified_base (701)..(704): a, c, t, g, unknown or other
  misc_feature (701)..(704): n is a, c, g, or t
tcagatagagtactcacgaccggtgctcgatttagtatcactcagtcgtgccctgactcagcctcgctcagtgtccgggtctcctggacagtcagtcaccatctcctgcactggaaccngcagcgatgtcggtggttataactttgtctcctggtaccaacaacacccaggccgacggccccccgatcaataactttatgatgtacctattaacgcggccctcgacgggggtccctggactccggtctttctcgttggccttcccgtaaagtccgttaggaccctaacaccttggcccctttaccacggtaaccctacgtttccgttccggtacggggtcccttacccgngggtaccttaaggaccgaacgtttcgggaaccgtggttaactttacgttaccttcggcttacggtcctaccgtttagttccggacgtacgggacccacccgggtcttaaccggttggtcgtaacgtttccgttaccgggggacggaacgggtacctaacgccgtttacggacccgttacccgttgggaacctcggtcctaccgtaaggccccgttaaccgtccccgtacgggtactaccgttccgttacccgttacccccacccttccgtaacggttaccttacgttaccgtaacgtccgtagacggttccggtcgacggacgaggcactcgngatcganncnnncncngnnnnc

SEQ ID NO: 94505 - DNA, 835 bp, Homo sapiens
  misc_feature: GYAE6OF02IP91L.29.85.H08.1.454.CMB.1.raw
  modified_base (120)..(120): a, c, t, g, unknown or other
  misc_feature (120)..(120): n is a, c, g, or t
tcagatagagtactcacgaccggtgctcgatttagtatcactcagtcgcggggggggtctcaggacggcagcactcgtcgggacgtctccaccatggcctgggctctgctcctcctcacncctcctctactcgacgggccaacgtacggtactccgtgggtctacgtacgtccgttcgccctagtacctcgtacgtcctcgtacctcgtaggttcggtaccggtcttccgtacgacgtacggtacacgttaccactactccgtcgttacgactacgggtaaccgtaaccggcggtaaccgaccgggtacttaccgggtttagggtccgggtttaacggtttaactttaaaccggtttacgttacccgtttaccgttaacccggttaaaccgaaaaccctaaacccggtaaccggtaccgggtacccggtaccccgggtaaccccgtaaccggtaccttaaagtttacgtttaacgtaccggtaggtttaccgttacgttaacgttacgtaccgggttcctaccggtacggttaccgtcgtacgtaccgttcgtactacgttccggacttcgactacggtcgtaacgtctaactccgtacgtacctcgtaccgtctacgtcgtacgtcgtacggtacgtcggtacctcgtacggtacggttacggtacgttaacgttaccgtacgttccgtacgtcgtaacgttcttaggtacgtaccgtacgtacccgtcgtaccgtaagttacgtaccgttaggtccgttacggccgggaacgtaccggtccgtacggtcccgtacggttaccgttggaccggtactaccggtaccggttacgg

SEQ ID NO: 94506 - DNA, 790 bp, Homo sapiens
  misc_feature: GYAE6OF02H9ORT.29.85.H08.1.454.CMB.1.raw
  modified_base (419)..(419): a, c, t, g, unknown or other
  misc_feature (419)..(419): n is a, c, g, or t
tcagatagagtactcacgaccggtgctcgatttagtatcactcagtcgcggggggggtctcaggaggcagcaactctcgggacgtctccaccatggcctgggctctgctcctcctcagcctcctcactcagggcacaggatccgtgggctcagtctcgccctgactcacgtcctcgctcagtcggtccggtctccgtgacagtcacgtccaccattcctcctgacctacgtacggaaacctacgacgacgacgtagttggttcgggttaggtttaacttaaccgttttcgtaccttaccgttacgtaacccaaactaaccgaccgacggaccggaacccggacccccacttactaactttaacgttacgtgtaacttcgtaactacgttaaccgccgtcccttacggaccggtaccgtntacgttccgacttcgtacgtcggtactacgtacgtcgtacgaacctagtccgccgtccttacccgacgtaccgtaaccgttcgtaaccgggttccgtacccgtaacggtccggtacgtaaccgtacggttaaccggttacgggtaaccgtttacgttaaacttaaccgtttcggtaaccgtccgttcgtttaccgtttacgtttaacgttccggtaaccgtacccggttacccaaccccggttacgttaacccgttcgtttaccggtaccgttaccgggttaccggggacccgggtaacggtacccgaacggttccgttaaccgtcccgtaacggtcccggtacgtaccggtacgttaacccgtacccggg

SEQ ID NO: 94507 - DNA, 757 bp, Homo sapiens
  misc_feature: GYAE6OF02G21U5.29.85.H08.1.454.CMB.1.raw
  modified_base (260)..(260): a, c, t, g, unknown or other
  misc_feature (260)..(260): n is a, c, g, or t
  modified_base (671)..(671): a, c, t, g, unknown or other
  misc_feature (671)..(671): n is a, c, g, or t
  modified_base (740)..(740): a, c, t, g, unknown or other
  misc_feature (740)..(740): n is a, c, g, or t
tcagatagagtactcacgaccggtgctcgatttagtatcactcagtcggcgggggggtctcgaggaggcagcactcgtcgggacgtctccaccatcggcctgggctctgctcctcctcacgcctcctcactcgacggcacgaggactccgtggctcgagttctcgcccgtagacctcagccctcgctacgtacgtcggtccgggttctaccgtggaacctgtaccagttaccacctctcctctcgctaacgacggaaccngcctagaccgtagtccggttaggttacggttacttaacgtttcgtcttaccgtacggtaacctaacgaaccctaaccggacggacccggtaccggtaccccccgtactccgtaaacttaacgtttacgtacgtacgtacgttacgtaacgtaaccgtccggtcccgttaccggtaccgggggttaccctaggtacctctaccggttctccggtccgtacctaccggttaacgtcgttccggaaaccgtaaccgttccgtccggttacccctcctaaccggtaaccctttactccgttaccgacgggtcccttccggtaacgtcggtacgtaaccggtcgtacggtacggtacttacggttacttacgtgttctcggtcttaagtcgttacacggccgtaccgccgtaaccncgttcgttcgtacgttccgacgggttaacgccgtaacgtcgtacgtccggtaccgttcgacggtacccnggtaccgtcgaacccgg

SEQ ID NO: 94508 - DNA, 777 bp, Homo sapiens
  misc_feature: GYAE6OF02HFP8L.29.85.H08.1.454.CMB.1.raw
  modified_base (184)..(184): a, c, t, g, unknown or other
  misc_feature (184)..(184): n is a, c, g, or t
tcagatagagtactcacgaccggtgctcgatttagtatcactcagtcggcgggggggggtctcaggaggcagcactctcgggacgtctccaccatggcctgggctctgctcctcctcagcctcctcactcgagggcacaggatccgtgggctcgagtctcgccctgacctcacgtcctacgctnacggttcggtccggtctccgtggaccagtcacgtcaccatcctccgtgacctacgtacgggaaccagccgacgacgagttacgggtcggtaggttaacttaacgtttcgtccgttaccgttacggtaacctaaaccgtaaacccgaaccgtaacgggcccgtaacccgggtacccccgaacgttaccgtaacttaaacgtttaacgtacgtaacgttacgtaacctaacgttaacggcccgggtaccgtacgggtacggggtacctagtacgtccgttactccgttcgtaccggtaccgttaccgtaacggttcgtacggtaacctaaacgtcgtaccgtcccgttaccctacgacccgtattccgtcggtaccggaccgttaccggacgtcgtacggagtacgttacgggaacggttacgttaacttacgtaccgttctcgttcggtacttaaccgtgttacccgacgggtacgcccgtaccgtctacggtcgttccgtacgttcgggtaccgggaacggtacggtaaccgaacggtacggttacccggaccggtttacggaccggtaacgtacccgagtaacccgtacggg

SEQ ID NO: 94509 - DNA, 625 bp, Homo sapiens
  misc_feature: GYAE6OF02GZYJ3.29.85.H08.1.454.CMB.1.raw
  modified_base (333)..(333): a, c, t, g, unknown or other
  misc_feature (333)..(333): n is a, c, g, or t
  modified_base (480)..(480): a, c, t, g, unknown or other
  misc_feature (480)..(480): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatccgtgggctcagtctgccctgactcagcctgctcagtcgtccggtctccgtggacagtcaggtccaacctattcctcctgccacgtacggaaccagtcaaggcgattcggtcggtaggttaattaacctttgtccttccgtaggtaaccaaacaaccaccgaggccgacggccccccgatcaattaatttagngtatgtactagttaacgccgcctacgtacggggtcctgatccgtcttcgtcgtcggcttacccgaagtccgtaggaccaactaccgcggtccctaccctacgaaccctctaccgtcggtggacctccgaggcctgacgagtcgagtnttactttactctcgtctacgtactcgtacgtttcgcgacgcctacccgctaacgttcggtacgtacgtttcggtacggggtacgggaacggtaaccaacggtcccgtcggtacccgttacgtaccggctacgcgtaactacccgg

SEQ ID NO: 94510 - DNA, 676 bp, Homo sapiens
  misc_feature: GYAE6OF02G071O.29.85.H08.1.454.CMB.1.raw
  modified_base (228)..(228): a, c, t, g, unknown or other
  misc_feature (228)..(228): n is a, c, g, or t
  modified_base (302)..(302): a, c, t, g, unknown or other
  misc_feature (302)..(302): n is a, c, g, or t
  modified_base (571)..(571): a, c, t, g, unknown or other
  misc_feature (571)..(571): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatcctcctgctactcggaaccngcagcgatgtcggtgttatacttgcctcgtgtaccaatacacctaggcgacgcccccgtatccattaatttacngtatcggtactagttaacggccggtaccctcggtaaccggggtcctacgtacgtccgtacttccgtcgtcggtaccttcccgtaaggtccgtacggaccctaaccacgtcccgtcctaccccgttacggacctacgttcctccggtaacgggttccctaccggacggtcgtacgggaccgtagtacgggtacggttacgttaactttacgttaaccgtgtaccgttcgtacctttcgtacgtttcgccggaaccggttccgaccccggngttaccgttagtcggtacttcccgggtacgggccgggaacggtaccgtaacgtcccggtacgtacccggttaccgtacggttaccgacgtccgttacggacccgg

SEQ ID NO: 94511 - DNA, 811 bp, Homo sapiens
  misc_feature: GYAE6OF02FQITX.29.85.H08.1.454.CMB.1.raw
tcagatagagtactcacgaccggtgctcgatttagtatcactcaggtacggcgggggggtctcaggagcagccacctctcgggacgtctccaccatggccgtgggctcgtgctcctcctacagcctcctcactcgagggcacaggatccgtgggctcagtctgccctgactcagcctcgctcagtcgtccggtctccgtgacagtcagtccacactctcgtgcacgtacggaaccagacagcgatcggtacggtgttaacgtaactttgtactccgtagtaaccaacaaccaccgaggccgtaccggacccccccgattaccgaagtttaaaacttttacgtagtaacgttacggtacctaacgtttaaaccggaccggttacccccgttcggtaaaccggggggttccctacgggtaaccgttcccggttccttaccggttcgtaccgggtcctaaccggtaacgttaccggtacgtaccgaaaacccgttcgtccctacccccgtttacccgacgtaaccgtaacttccgttccggtccggtacccgtacccgacggtaaccgtacggtacggtaacggtaccggttaacgggtcgtttaaacgtttaacgtttaacgtccgtaccgttcgttccgttacggttacgttttcgaaccggttaccggaccgtacccgtaccgtacgtaccgtttacgttacgttaacccgggtcgggtaacgggtaaccgggaaccgtaacggtacccggtttaaccggtaccggttacccgtacgggttaccggtaccgtaccggtaccgttaacccgg

SEQ ID NO: 94512 - DNA, 565 bp, Homo sapiens
  misc_feature: GYAE6OF02GC90K.29.85.H08.1.454.CMB.1.raw
  modified_base (228)..(228): a, c, t, g, unknown or other
  misc_feature (228)..(228): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (398)..(398): a, c, t, g, unknown or other
  misc_feature (398)..(398): n is a, c, g, or t
  modified_base (477)..(477): a, c, t, g, unknown or other
  misc_feature (477)..(477): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtccactatctctgcacgtacggaaccngcagcgatggtcggtgttatacttgtctctgtacaacacaccagcgacgccccgactcattattancatntctatacgcgcctcgacggtcctgactcgtcttctctcgacctacacgtctagacaactcgtcgtccctccgacgacctactccgtcggtcggctaccgngtacgtcggacgtagtcggtacggtagttagtttactacgtcgtacttcgtactcgttcgttgacgtacgtaccgtccncttgtcggttctacgttccggtcggggaacggtacgtaaccggtcgtccggtaccgtcgtaccgttacggctcgtcgtacgtacccgg

SEQ ID NO: 94513 - DNA, 582 bp, Homo sapiens
  misc_feature: GYAE6OF02IWYWG.29.85.H08.1.454.CMB.1.raw
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (295)..(296): a, c, t, g, unknown or other
  misc_feature (295)..(296): n is a, c, g, or t
  modified_base (475)..(475): a, c, t, g, unknown or other
  misc_feature (475)..(475): n is a, c, g, or t
  modified_base (503)..(503): a, c, t, g, unknown or other
  misc_feature (503)..(503): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggcacaggatccgtgggctcagtctgccctgactcagcctcgctcagtgtccggtctctaggacagtcagtcaccatccgtcctgcacgtcggaaccagcaggcagtcgtgtagtatacttgtctctcgacaacacaccgagcgaccgcccancatatangntnnatagcgcctagcggtctgactcgtcttctcgtcgtctacgtacgtcgacggtacaccgtacgtcccgtcccgttcctacgaccttacgtccgtacgtcgggtccctaccgtaggtacgtacggacgtaacgcgggttaacggtacgttaacgtttacgtacgtcctacgtacgtcgttnttaccgttgcccgtacgccctacccgtntaccgtgtaccgtcgtacgtacgggcgtaaccggacgtacgtcgtaccgtccgtcggtagccgtcggtacctggtaccg

SEQ ID NO: 94514 - DNA, 658 bp, Homo sapiens
  misc_feature: GYAE6OF02F3HHQ.29.85.H08.1.454.CMB.1.raw
  modified_base (195)..(195): a, c, t, g, unknown or other
  misc_feature (195)..(195): n is a, c, g, or t
  modified_base (637)..(638): a, c, t, g, unknown or other
  misc_feature (637)..(638): n is a, c, g, or t
  modified_base (640)..(640): a, c, t, g, unknown or other
  misc_feature (640)..(640): n is a, c, g, or t
  modified_base (644)..(645): a, c, t, g, unknown or other
  misc_feature (644)..(645): n is a, c, g, or t
  modified_base (647)..(647): a, c, t, g, unknown or other
  misc_feature (647)..(647): n is a, c, g, or t
  modified_base (652)..(653): a, c, t, g, unknown or other
  misc_feature (652)..(653): n is a, c, g, or t
  modified_base (655)..(655): a, c, t, g, unknown or other
  misc_feature (655)..(655): n is a, c, g, or t
  modified_base (657)..(658): a, c, t, g, unknown or other
  misc_feature (657)..(658): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgatcataatttangatgtcattaagccggccctcgacggggtccctgatccgtcttctctggcctaccgaagtctcggcaaacaccgttcgcccttccccgtacgaaccctacgttcttccggtcggggtcccttcccgaaggccgtaggaccgtacgttaggtacgggttgaattttagttaccgtggtccttgtccttcgtagttttcgggctacggcccacccggactacgttgttagacttccggtacggggtacgggacggacctaacggcgtcccggaacccgtctacgggtcacgtacgtacgaacggtcctcccggtccccgttccggtcccttaccgttaccgtccggttccccctacccttccgtaccttaccgttaccttacgttactcggtaccgtacgggcggtaccggtacggaccggtacggccgtacgtagttcggacnncncgcnngngtcgnncngnn

SEQ ID NO: 94515 - DNA, 874 bp, Homo sapiens
  misc_feature: GYAE6OF02FQ9DV.29.85.H08.1.454.CMB.1.raw
  modified_base (231)..(231): a, c, t, g, unknown or other
  misc_feature (231)..(231): n is a, c, g, or t
tcagatagagtactcacgaccggtgctcgatttagtatcactcagtcgcggggagctctgggagaggagcccccagcccctgagattcccaggtgtttccattcggtgatcagcactgaacacagagaacgcaccatggagtttggactgagctgggttttccttgttgcttattttaaaaggtgtccagtgtgagtgcagctggtggagtcgtgggggatcgtgggtacnggccggtgggggtccctgagactctccgtgtgcagcctcgtggtattacgtaaagttttaatgttaactttttccaattaccgtacgttcgggttcccgtacgaaggtcccggttaccggggggaacgggttccgtaggggtacggttcggggttccttaccgttttacgtttaaagtttaacgtaccggtaacggtaaccgggttcgtaccgtttaaaccgttaacgttacttttacgtaagttcggtacgaacgttccgtacgttaggtaacgggtaacggggtacccgtaacgtttcccgaaaccttacgttcccacgaacggtaaccgaaacccaaaaccgtaaacgtaaacccgttacccttaacccggttagttaaccgttcttaaccggtaaacttaaaacggtacccggtaaaaccgtaccgggttaacgttaacggggtaaacggtaaacggtttcccggggaaaacgaacccgggttaccgggttacccgggtttaaccttttcgttttaaacgttttacgtttacgggtaaacgtaaacgtaaaaaccgggaacggggtaaccggtaacggaagtttacccgggttaaggttaaacggggttccggggttttccgttaccgtttaaccgggg

SEQ ID NO: 94516 - DNA, 586 bp, Homo sapiens
  misc_feature: GYAE6OF02FTI5J.29.85.H08.1.454.CMB.1.raw
  modified_base (401)..(401): a, c, t, g, unknown or other
  misc_feature (401)..(401): n is a, c, g, or t
tcagatagagtactcacgaccggtgctcgatttagtatcactcagtcgcgggggagctctgggagaggagcccccagcccctgagattccccaggtgtttccattcggtgatcagcactgaacacagagaacgcaccatggagtttggactgagctgggttttccttgttgctattttaaaaggtgtccagtgtgaagtgcagctggtggagtcgtggggggagtcggtggtacagccgtggggggtccctgagactctcctgtgcacgcctctggattcaagtttaatgtactttttccattactacgtcgggtccgtcgaagcgtaccggggaggtcgtggaggtgggtctcttcttattaatcgagacggtgctactactattctatgcagtctctgnggaacgggccgtattccacctatctaccagagaaccaacaaactaacgtacctcccttagtactctgaacctaatacgaactacgtctagagaagtagaccgacacggcgtcttacttattagtgtagaacgaaaaggtaggaaggacgtaggtactaggtaacggtgggttacgtcggttacgg

SEQ ID NO: 94517 - DNA, 753 bp, Homo sapiens
  misc_feature: GYAE6OF02IECD9.29.85.H08.1.454.CMB.1.raw
tcagatagagtactcacgaccggtgctcgatttagtatcactcagtcgcggggggggtctcaggaggcagcactctcgggacgtctccaccatggcctgggctcctgctcctcctcagcctcctcactcaggcacaggatcctgggctcagtctcgcctgactcacgcctcgctcacgtcgtccggtctccgtaggacagtcacgtcaccattcctcgtcgctacgtacgaacctagccacggacgtagtcggttcgggttagttaacttaaccgttttcgtacttaccgttacggtaaaccctaaccaaaccgaacccgtaaccggaccggacccggacccccgtaccgtaccaactttaacgtttacgtacgtattacgtaccttaagtaacgtaccgtaccgtacggtaccggtaccgtcgtactccgtccttactcgtacgtcctacgtaacgtccgtacgacctaaaacgtccgtaccgtacccttaccccgtcgaaccctacgtttccgtacccggttcgggtaccctacggttaaccggtacgttaaccggaacgttacgtaccgggttaacgttaaccgttaaacttctttaacggtcgtacggtccgtaccgtttacgttagttaccgctaacggtcccgaccgtcacgtttcgacgtcgtaccggtacgggacggtaaccggacgaacgttccgaacggtccgtaaccgttacggtacccgtacgtaccgtacgtaacccggg

SEQ ID NO: 94518 - DNA, 764 bp, Homo sapiens
  misc_feature: GYAE6OF02HBV9B.29.85.H08.1.454.CMB.1.raw
  modified_base (169)..(169): a, c, t, g, unknown or other
  misc_feature (169)..(169): n is a, c, g, or t
  modified_base (188)..(188): a, c, t, g, unknown or other
  misc_feature (188)..(188): n is a, c, g, or t
  modified_base (226)..(226): a, c, t, g, unknown or other
  misc_feature (226)..(226): n is a, c, g, or t
  modified_base (312)..(312): a, c, t, g, unknown or other
  misc_feature (312)..(312): n is a, c, g, or t
  modified_base (660)..(660): a, c, t, g, unknown or other
  misc_feature (660)..(660): n is a, c, g, or t
  modified_base (675)..(675): a, c, t, g, unknown or other
  misc_feature (675)..(675): n is a, c, g, or t
tcagatagagtactcacgaccggtgctcgatttagtatcactcagtcagtcaccatctcctgcactggaaccagcagcgatgtcggtggttataactttgtctcctggtaccaacaacacccaggcgaggccccccgatcataatttatgatgtcattaagcggccctnagggtccctgatcgcttcnctggctccaagtcaggcaacactgcctcctgaccatcnctggctccaggctagacgtatcggacggtagatttaacttcgtgctggtacctctaagtttcacggtacggtacccaaccccggtnaaccggttaggtacgtaacgttccggtttaaccggggacggggtaaacgggtaaaccccgtaaaaggtcccgttaacgggaaccccggtttacccgtacggggtaccctaaaggtcccgttaacgtaaaaccggggtcccttaccccgggtacccccctttcggtaaaccccgtacctttcccggtttaacccggttccccccgtaccccgtttacccgttaaccgtaaccggtttaacccttaacccgtttacggtacccggttacgggaaaacccggttccggggttaccggttacgggaaccgtaacgggacccgttacgtaacgttaacggacttgacgttacngaaccgcggtaatcngtacacggaactacggccaagggtccaagttcgtaccggtgtacgtaggtcgacgtactactacgtacgtacgtacgtacgtacgtacg

SEQ ID NO: 94519 - DNA, 608 bp, Homo sapiens
  misc_feature: GYAE6OF02GHJ8U.29.85.H08.1.454.CMB.1.raw
  modified_base (234)..(234): a, c, t, g, unknown or other
  misc_feature (234)..(234): n is a, c, g, or t
  modified_base (523)..(523): a, c, t, g, unknown or other
  misc_feature (523)..(523): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatccgtgggctcagtctgccctgactcagcctcgctcagtcggtccggtctccgtggacagtcagtccaccatcctcctgctacgtacggaaccngccaggcgatggtcggtaggttataactttgtcctcgtacggtaaccaaacaaccaccgaggccgaccggcccccgactacattaattatcgtacttactaagttaacgccgtcctacggtacgggtccctgtactcgtcttcgtctcgtcctacgtacgtcgtacgacaacgtctcgtccctccgtcgactactcgtcgtcggcctccgagtcgagtacgacgtcggtacggtataactttacgtaccgtcgtacgttcgtcttacgtaagttcgacgacggtacccncgtacctcgtagtacgtcgtcggtcggacggtacggacgacgtcgtaccgtcgtactacggtcgaacgtcgtacggccgtaccgg

SEQ ID NO: 94520 - DNA, 694 bp, Homo sapiens
  misc_feature: GYAE6OF02HXAYZ.29.85.H08.1.454.CMB.1.raw
tcagatagagtactcacgaccggtgctcgatttagtatcactcagtcgcgggggggggtctcaggaggcagcactctcgggacgtctccaccatggcctgggctctgctcctcctcagcctcctcactcagggcacaggatccgtgggctcagtctgccctgactcagtcctcgctcagtgtccgggtctcctggacagtcagtcacatctcctgcactagaaccagcaggcagtcggtaggtggttaacttaacgtttcgtctccgtacggtaccaacaacctaccgaggccggaccggacccccgtactacgtactaagtttataggacttgactacgttaacgccggtacctacggacggggttcctagtactcgtcttacgtctcggctacccgtaagtccgtacggtacctaacgaccgtaccgtcccgtaccctacgtacctacgttccgtacggttcggcccttacggacggtacgtacggaccgtagttacgggtaacggttgttaaactttacgttaacgttccgacgttactaaccgttacttacgtttcggaaccgtaccggacctacccggtactacgtttacgttgtaaccgttccggttacggggacggtacgggaaccgtaacgtccggtaacccgttccggacgttaccggtacgaaccggttaccgaccggtaccgg

SEQ ID NO: 94521 - DNA, 694 bp, Homo sapiens
  misc_feature: GYAE6OF02G6TAX.29.85.H08.1.454.CMB.1.raw
  modified_base (674)..(674): a, c, t, g, unknown or other
  misc_feature (674)..(674): n is a, c, g, or t
  modified_base (677)..(677): a, c, t, g, unknown or other
  misc_feature (677)..(677): n is a, c, g, or t
  modified_base (680)..(680): a, c, t, g, unknown or other
  misc_feature (680)..(680): n is a, c, g, or t
  modified_base (682)..(683): a, c, t, g, unknown or other
  misc_feature (682)..(683): n is a, c, g, or t
  modified_base (686)..(686): a, c, t, g, unknown or other
  misc_feature (686)..(686): n is a, c, g, or t
  modified_base (690)..(691): a, c, t, g, unknown or other
  misc_feature (690)..(691): n is a, c, g, or t
  modified_base (693)..(693): a, c, t, g, unknown or other
  misc_feature (693)..(693): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataacttgtctcctagtaccaacaacaccgaggccgaccggccccccgactacattaatttactgactcgtactaagttaacgccggtccctacggtacgggtccctagactccgtccttctcgtcggccttacgacgtcgtacggaccaacctacgtccgtccctacccgtcgaaccttacgtcccgtcggttaccggtcctaccggtacgtccgtacgaacggtagtaccgggtaggtacttaacgttacgttactcgtcttcgtcgttacgtacgttcaccgggtaccgacccgtacccgtactacgttcggttacggtccggttacggttacccggggaacgggtaaccggtaacggtcgtacccgtccggtaacccgttacgtacgtcctaaccggcgttaaccggacggtcccgtacccgtcccgtcggtacccttaccgttccgtacccgttccctccgttcccgtactccgtactcgtacgccggtagaccggtcggtcgtaccggacgaacgtccgacgtaagtcgacnggntcngnncgncgcnngng

SEQ ID NO: 94522 - DNA, 888 bp, Homo sapiens
  misc_feature: GYAE6OF02HQNUB.29.85.H08.1.454.CMB.1.raw
  modified_base (229)..(229): a, c, t, g, unknown or other
  misc_feature (229)..(229): n is a, c, g, or t
  modified_base (488)..(488): a, c, t, g, unknown or other
  misc_feature (488)..(488): n is a, c, g, or t
tcagatagagtactcacgaccggtgctcgatttagtatcactcagtcgcgggggggggtctcaggaggcagcactctcgggacgtctccaccatggcctgggctctgctcctctcagcctcctcactcagggcacgaggatcctgggctcagtctgccctgactcagtcctcgctcgagtcgtccggtctccgtggacagtcagtcaccatctcctgctactcgaaccngcaggcgacgttcggtcggtggttaacttacttcgttctccgttacggtaaccaactaaccgacccgtacggccggtacccggtacccccgtacctaccgtaacgtttaacgtttacgtacggtattacgtaccgttaagttttaaccgggcccgtacccggttcggaacccgggggtttccctacggtaaccgttcccggtccgtttaccgtcctccggttacctacccgtaacggtttccgacgggtaccctaaacncccggtccgtacccttacccgtacggtaaccgtaaccgtttccgttacccgggttaccggtcccgaacccgggttacggtaacccggttccggtaaacgggttaaccgtttccggggtaaaccgggtttagttaaacccggttttagttacccggttaccgtacccgggttcggtttcctaaaccggtttacggtttcggaacccggtaccgggtaaccccttaccccgggtaacgtaacccggttttcgggtaacgttacccggttccggggttttaaccggggtccggggtaaacccggtaaccgggtaacccggtttaacggtacccccggttacgggttaaccccgggtaccgtttccccggtaaacccgttcccgggtaacccgtaaccccgggg

SEQ ID NO: 94523 - DNA, 755 bp, Homo sapiens
  misc_feature: GYAE6OF02I5JJN.29.85.H08.1.454.CMB.1.raw
  modified_base (177)..(177): a, c, t, g, unknown or other
  misc_feature (177)..(177): n is a, c, g, or t
tcagatagagtactcacgaccggtgctcgatttagtatcactcagtcgcggggagctctgggagaggagccccagccctgagattcccaggtgttccattcggtgatcagcactgaacacagagaacgcacatggagttgactgagctgggttttcctgtgacttagtttaaaggtntaccagtgagtaagtgcagcgtggtaggtagtcgtagggggatcggtcggtacaggtaccggtgggggtaccctgacgtacctctccgtagtgcacgtacctgtacggtacttacgtaaagtttaagtagttacttttaccaagttacgtaacgttcggtacccgtacaacggtccgggtaccggggaacgggttcgtagggtaggtcgggtctaccgttagttaacttaagtcggaagtacggtgtaccgtactacgtatttacgtactagtcgaatcgtacgtagtaggaacgggtaccacgttacctactacgtacctacgaacgttaacgaaccaaacgtaacgaaacgtaccctaccgttaacgttacttaccggtataaacgaaagtaccgtaacgtaacgttacggaaacggtaaggtaacgaggttaaacccacgggtaagtacccggtacgtttaacctttagttaacgttacggtaacggaaaccttaaaacggggaacgacgggtaaacagggttaaacccgttaacgggttaaggttaccgggttacggttaccggtttaaccggg

SEQ ID NO: 94524 - DNA, 676 bp, Homo sapiens
  misc_feature: GYAE6OF02HBTRH.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagctgggttttccttgttgctattttaaaagtgtccagtgtgaagtgcagctggtggagtcgtgggggagtcggtggtacagccgtgggggtccctggagacctctcctgtgcgagcctcgtggtacttacaagttttaactggttactttttcattacgtacgttcggggtccgtacaaggtcgtaccgggggtaacggtgtagggtacggtggggttcttcttacgtttattaacgtcggaggtacggtcgtacgtaactacgtacgttactagtggactacgtacttcgtggtaggaacgggtcgtacttaccacgtactcctacgagtaacgaaccaaacgaacgtaaacgttacccttacccgttagttaacgttcctagtaacctaaagttacgaaccgtaggtcgtacgaagtaagtacggaacgaacgacggtcggttacttacttagtttaactggtaacgaagtaaacggaggtaacgacgtacgtagttaccgtaacgggtggttaccgtgttaacg

SEQ ID NO: 94525 - DNA, 706 bp, Homo sapiens
  misc_feature: GYAE6OF02HXD4L.29.85.H08.1.454.CMB.1.raw
  modified_base (253)..(253): a, c, t, g, unknown or other
  misc_feature (253)..(253): n is a, c, g, or t
  modified_base (303)..(303): a, c, t, g, unknown or other
  misc_feature (303)..(303): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatccgtgggctcagtctcgccctgacctcagcctcgctcagtgtccgggtctcctggacagtcagtcaccatctcctgcactggaaccagcagcgatggtcggtgttatacgttntctctagtaccaacaccaccgaggccgaccggcccccactcaattaattnagtatgtacagttacgccggtcctcggacgggtccctgacttcgtcttctcgtcggtcctaccgtaagtcgtgtaccaactccgtccgtccctcccgtacgtaccctacgttccgtccgtaccgggtccctaccgacgggtccgtacggtaccggtagttccgggaaccggtttagttaaaccgtttttaacgttaaccgtcggttaccgttacgttacccgtttaccgttacgttttccggacccgttaccgggtaccctacccccgggtagtacccggttgttaccggttacgttacccgggttaccggggaaccggggtaaccgggtaacccggaagttcccggtaacgtacccgggttaccgttaccggtaccggtaccgttaccggtacgtacccggg

SEQ ID NO: 94526 - DNA, 666 bp, Homo sapiens
  misc_feature: GYAE6OF02IJCUU.29.85.H08.1.454.CMB.1.raw
  modified_base (196)..(196): a, c, t, g, unknown or other
  misc_feature (196)..(196): n is a, c, g, or t
  modified_base (627)..(627): a, c, t, g, unknown or other
  misc_feature (627)..(627): n is a, c, g, or t
  modified_base (637)..(637): a, c, t, g, unknown or other
  misc_feature (637)..(637): n is a, c, g, or t
  modified_base (651)..(651): a, c, t, g, unknown or other
  misc_feature (651)..(651): n is a, c, g, or t
tcagatagagtactcacgaccggtgctcgatttagtatcactcagtctgccctgactcagcctcgctcagtgtccgggtctccgtggacagtcagtcaccatctcctgcacgtggaaccagcagcgatgtcggtggttaataactttgtctcctggtaccaacaacaccaggcgacggcccccgatcataatttangatgtactattaacgccgcctgacgggtccctgactcgtcttcgtctggactacctaagtctacggactaacacgtcgtccttcccgtagaaccttagtccttacggtcgggtacctcccgtaaggtccgttacggaaccggtaagttcgggaacggttataacgtttaacttacgtcgtcttacgcttacgtacgttcgacgtaccggacccgaaccgtctacgtaggtacgtacttccggttacggggacggtaacggaacccgtaagtaccgtacgtacccggtactaacgggtaccgacgtcctaacggtacggtccgtccgtccccgtacgtcctaacttccgtacccgttccccgtccctaccgtactactaccgtgtaactcgtaacgtcggtaccggacgacggacgaacggacgtacgtaancgtagcgagngtacacgtgacgtnaactgacgactacga

SEQ ID NO: 94527 - DNA, 166 bp, Homo sapiens
  misc_feature: GYAE6OF02JZV3Y.29.85.H08.1.454.CMB.1.raw
  modified_base (150)..(166): a, c, t, g, unknown or other
  misc_feature (150)..(166): n is a, c, g, or t
tcagatagagtactcacgaccggtgctcgatttagtatcactcagtcgcgggacacgactggagattaaacgaactgtggctgcaccatctgtcttcatcttcccgccatctagaatgcgtactctgagcgggctggcaaggccgcatgnnnnnnnnnnnnnnnnn

SEQ ID NO: 94528 - DNA, 841 bp, Homo sapiens
  misc_feature: GYAE6OF02JV2G7.29.85.H08.1.454.CMB.1.raw
tcagatagagtactcacgaccggtgctcgatttagtatcactcagtcggcggggggggtctcaggaggcagcactctcgggacgtctccaccatggcctgggctctgctcctcctcagcctcctcacctcgagggccacgaggtactccgtgggcctacacgtcgtcgccctagtacctcgacgcccgttcgctacgagtcggtccggtactccgtacgacacgtacgacgtccgacctagtccttaccgagcctaccgtacggaaccctaggtaccaggtccgtatcgggttaacggttacggtttaactaccgtttgtaccgttccgtaacgggtaaccctaacgaaacccgtaccggtacggacccgggttaccccggaaccccccgttaacttacgaaaacttttaaccgttaacggttacgtaacggttaccttaacggtaccgtttaaaccggccccggtaaccgttccgggaaccggggtttcccctaggaaccggttccgtcgttaccgttacgtccggtacccgtaacgtaccggttcgtaacgggaacccttaaacgccgtttaccggcccttaacgtcccgtaccgtacgttccggtacgttccgggacttaccggtacgtcgtacgtacgtacgtacggtacgtacgtacttcgtacgttcgacgttcgtacgtccgttacgtcgtaaccggccgtaaccgccgtaaccgttacgtcgtacgtacccggttccgggtaaccgggaccgggtaacggtacccgacggttacccggttaacggccccgttaccgggtaactaccggtacccgtcggtaacccgttcccggg

SEQ ID NO: 94529 - DNA, 800 bp, Homo sapiens
  misc_feature: GYAE6OF02ILPQH.29.85.H08.1.454.CMB.1.raw
tcagatagagtactcacgaccggtgctcgatttagtatcactcagtcgcggggggggtctcaggaggcagcactctcgggacgtctccaccatggcctgggctctgctcctcctcagcctcctcactcagggcacaggatccgtgggctcagtctgccctgactcagcctcgctcagtcgtccgggtctcctggacagtcagtcaccatcctctgcactggaaccagcagcgatcggtcggtgttaactacgtttcgtctccgtacgtaaccaacaaccaccgacggtaccgaccggtaccccccgactccgtaactttaactttagtagtaacttcggtactaagtttaaccggcccggtaccccgttaccgggtaccgggggttacccttcggtacgttccgtaccgtttaccgttccggttacggggtcccttaccggttaaacggttccgttacggaaccgtaaaccgtaccgttaccgtaccccgtttcccgtaacggtacccttacgttcccgttaccggttaccgggtacccgttacccgtagggtacccttacgggaaccggttaacgttacggggtaaccggtttaggtttaacgttttaaaccgtttaccgtacggtaccgtttccgttaccgtttaccgttacggttttaccgaccggtaccggtaccccgtaacccgtcgttaccgtacgtcgttacgttccggttaccggggcggtaaccgggactaaccggtacctacggtaacccgttacggtacggtaccggacgttccgtaaccggtacccgg

SEQ ID NO: 94530 - DNA, 721 bp, Homo sapiens
  misc_feature: GYAE6OF02FYOA9.29.85.H08.1.454.CMB.1.raw
  modified_base (147)..(147): a, c, t, g, unknown or other
  misc_feature (147)..(147): n is a, c, g, or t
  modified_base (248)..(248): a, c, t, g, unknown or other
  misc_feature (248)..(248): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgagggcacgaggactccgngggctcgagtctcgccctgacctcacgcctcgctcgacgttcggtccggtctccgtggactagtcagtccacctagttcctccgtgactacgtacgaaccngcgagcgtatcgggtacggttagttactacgtttcgtccttaccgtacgtaacctaaccaaccgtaccgtacggccgacccgggtaccccctagtaccgtaattaacgtttctacgtagttcgtactaacgttaccggccggtaccccgtcggtaccggggttcctaggtaccgttccgtacgttccgtaccgtcgtaccgtacccgtagttaccgacgtacctaacgtcccgtacgtacccgttccgacgtcctacgtcgttacggtccggtcctaccggtacgtaccgacggtacggtcgtacgggttacgtaacgttagttacccgttgtaccgtcgttaccgtccgttacttcgtcggaccgtaccgcctaccgtctaccgtggtacttccggtacggcggggaacgtaccggtacgtaccgtcctaaccggtcccggtagtaaccgcgttaccgacgtaccggtccgg

SEQ ID NO: 94531 - DNA, 633 bp, Homo sapiens
  misc_feature: GYAE6OF02JMWNM.29.85.H08.1.454.CMB.1.raw
  modified_base (409)..(409): a, c, t, g, unknown or other
  misc_feature (409)..(409): n is a, c, g, or t
  modified_base (453)..(453): a, c, t, g, unknown or other
  misc_feature (453)..(453): n is a, c, g, or t
  modified_base (529)..(529): a, c, t, g, unknown or other
  misc_feature (529)..(529): n is a, c, g, or t
tcagatagagtactcacgaccggtgctcgatttagtatcactcagtcgcggggagctctgggagaggagccccagccctgagattcccaggtgttccattcggtgatcagcactgaacacagagaacgcaccatggagtttggactgagcttgggttttccttgttgcttatttaaaggtgtccagtgtgagtgcagtcgtggtggagtcgtgggggagtcggtaggtacgaggtccggtcgggggtccctggacgtacgtcctccgtgtcgcgacgcctcgtggtacttacgtaagtttaactgttactttacctattaccgtacgttcggtccgttacgacgtcgtacggggtagtcgtcggtagtgggtctcgttcttaagtacgtcgagtacgtgtctactactnttctagtcgactagtcctgtgacggacgggtcctattccaactnttccgtaacagaacgaacaacgtaaactaaccgtaccctcgttatactctagaactaaacgacgttacgacgttancggtaagaagtcgaacaagtagcccgttattacgtatttagttccgaggtaaacgaagtaacggtagacgtagtacttaggtacggtacgggtcctagttacgg

SEQ ID NO: 94532 - DNA, 627 bp, Homo sapiens
  misc_feature: GYAE6OF02IYV25.29.85.H08.1.454.CMB.1.raw
  modified_base (195)..(195): a, c, t, g, unknown or other
  misc_feature (195)..(195): n is a, c, g, or t
  modified_base (211)..(211): a, c, t, g, unknown or other
  misc_feature (211)..(211): n is a, c, g, or t
  modified_base (524)..(524): a, c, t, g, unknown or other
  misc_feature (524)..(524): n is a, c, g, or t
tcagatagagtactcacgaccggtgctcgatttagtatcactcagtcgcggggggtctcaggaggcagcactctcgggacgtctccaccatggcctgggctctgctcctcctcacgcctcctcactcagggcacaggatccgtggctcagtctgccctgactcacgcctcgctcagtcgtccggtctcctggacngtcacgtcacatctcngctacgtgaaccagcagcagtgtacggtgttattacttgctcgtacgtaccaacaaccaccgacggaccgaccggcccccgatcgtaattaacttgacgtatcgtacacgttaacgccgtaccgtcgacgggtcctacgcttaccgtctcgtcgtcgtcctacgtacgtcgacgtacacgtcctacgtccctacctacgaacctcgtaccgtagtccggtctccgagtcgtacgtacgacgtcggtagtagtacttacgttacgtaccgtcgtacgtacttaccgtagtttcgaccgtacggtacccgtaccncgttaacgtcgtccgtacggttccggtaccgggaacggtacggaaccgtacgtaccggtacggtacccgtacgtaggtacctacggtaccgtactaacccggg

SEQ ID NO: 94533 - DNA, 701 bp, Homo sapiens
  misc_feature: GYAE6OF02J1S21.29.85.H08.1.454.CMB.1.raw
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
  modified_base (265)..(265): a, c, t, g, unknown or other
  misc_feature (265)..(265): n is a, c, g, or t
  modified_base (354)..(354): a, c, t, g, unknown or other
  misc_feature (354)..(354): n is a, c, g, or t
  modified_base (371)..(371): a, c, t, g, unknown or other
  misc_feature (371)..(371): n is a, c, g, or t
  modified_base (475)..(475): a, c, t, g, unknown or other
  misc_feature (475)..(475): n is a, c, g, or t
tcagatagagtactcacgaccggtgctcgatttagtatcactcagtcgcggggggggtctcaggaggcagcactctcgggacgtctccaccatggcctgggctctgcctcctcctcagcctcctcacctcgacgggcacgaggtactccggtagggcctcacgttctcgcccgtgactcacgtccttcgctacgagtcggtccggttctccgnggaacncgttcaacggtccacctagtccgccgttgaccaacgtacggaaccngacgacgcgtagttaccggtcggtagttacttacgttcgtacctcgtaacgtaaccaacaccgtaccgacggacgtcccggaccccgtnacgttaactacgtttangtacgtcgtactaagtccggtcgtaccgtacggtaccgggttacacgtaccgtcgcctttacgtccggtacgtccgtacgtacgtccgtacgacccacgtaccnccgttaacccgtcctacgaacgtctaccggttacgacggtacctccggacgttcgggactacggtaccggtctaacggtacttaacgtacttgcgttcgtacttaccgtctagttaccgacggtctaccgtacggtcaccgtgtacaccgttccggagggaccgttacggacgtcccgtacgtacccggtacgtcggtaaccgtcggacccgtagtacggtacccg

SEQ ID NO: 94534 - DNA, 969 bp, Homo sapiens
  misc_feature: GYAE6OF02ISCUO.29.85.H08.1.454.CMB.1.raw
  modified_base (946)..(946): a, c, t, g, unknown or other
  misc_feature (946)..(946): n is a, c, g, or t
tcagatagagtactcacgaccggtgctcgatttagtatcactcagtcgcggggggggtctcaggaggcagcactcgtcggacgtctccaccagtggcctgggctctggacctcctcctcacgccctccttcacctcgagggcacgaggtactccgttggctccgaggttctcggtccctagtacctcacggtcccgttcgcctaccgtacggttcggtcccccggttctcccgtacggtacctacggtcctacggtcccacctatttcccgttacccggcttaaccgtaaccggttaccgaaaccgtcgaacccggaggtaacgttaccgggttcggggttaccggggtttacgttttaactttaccgttttcgttcccgtttacggttaaaccgacccgttaaacctaaccgacccgtaccgggtaaccccggtaccccgggtaccccccttacccttaaccgtaaccgtttaacgtttacggttacggttaaccgtttcgtaacgttaccgtttaaacccgggttcccgtaaccccgggtttaaccgggtacccccggggtttaccgtaaccgggttaccgttacccgggttcccggtttaacccttccgggttaccgtttacccggtaacccgttaaccggttcccggttaaaccgggtccccctttaaaaccggtcccccggttcccgttaaccccggtttccccccggttaaccggaccctttcccgggttaccgtttccgggtttaacccgcccggtacccggttcgaccggttccgggtaaccgtcgtacggtaacgttacgtacgtttacgtctacgtcgtacgttacgtccttagggtcccacgggtccaccgttaccctcgtcgttcggcgttaccgtccggtacgggttccggacggtaccgtaccgttccggacccgtttcggcgtttacccgnggtacccgtagtcgttaccccgg

SEQ ID NO: 94535 - DNA, 849 bp, Homo sapiens
  misc_feature: GYAE6OF02JFE1L.29.85.H08.1.454.CMB.1.raw
  modified_base (199)..(199): a, c, t, g, unknown or other
  misc_feature (199)..(199): n is a, c, g, or t
tcagatagagtactcacgaccggtgctcgatttagtatcactcagtcgcgggggggggtctcaggaggcagcactctcgggacgtctccaccatggcctgggctctgctcctcctcagcctcctcactcgagggcacaggatccgtgggctcagtcctgccctgactcagcctcgctcagtgtccggtctccgtggacngtacacgtcacctatactcgtacgacgtactacgggaaccagtcctaacggacgtaatcgggttacggtacggttaacgttaacgttacgtaccgttaccgttacggtaacccaagggttaacccaacccgtaaggggtaccctaacccggggtacccccctaaggttacccccgtaagttaaaccgtttaccgaacgttaacgtaccgtaaccgttaacgtttaaccggaccggttacccctacgggtacccggggttaccctaagggtacccttaccggtacgtttacccgtaccgttacgggtacctaccggtaaacgttccgtaagggtaccctaaaccgtaccggtaccgtaccctaccgtacggtaaccctacgttaccgtaaccggttcgggtaaccccttacggaaccggtacgttaaacgggtaccgtaacgttaccgggaaggtttaccgtaaacgtttaaccggtacgttaacgtccgttacgtacccgttaagttaccgtacggtaactacgggaccctaacggtacgttaccgtaggaccgtttacggtaccgacggggtaacgtaaccggtaacgtaccggtaaccgttacgaccggttaacgtaaccgggtccaaggttaccctacggtaaccgg

SEQ ID NO: 94536 - DNA, 598 bp, Homo sapiens
  misc_feature: GYAE6OF02F97KQ.29.85.H08.1.454.CMB.1.raw
  modified_base (205)..(205): a, c, t, g, unknown or other
  misc_feature (205)..(205): n is a, c, g, or t
  modified_base (210)..(211): a, c, t, g, unknown or other
  misc_feature (210)..(211): n is a, c, g, or t
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (400)..(400): a, c, t, g, unknown or other
  misc_feature (400)..(400): n is a, c, g, or t
  modified_base (465)..(465): a, c, t, g, unknown or other
  misc_feature (465)..(465): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctagactcagcctgctcagtgtccgggtctcctaggcagtcagtcacntctcnncnctgacngnagcgtatggtcgtgtatacgtttncctcgtacgtaccaactaccgaccaggtacgaggtacccaccccggtactcgtaattaacgtttacagtacttaggtactaaggtttaacgccggtacccttacggaccgggttccaggtacgtcgtacttcgtctagtcctcagtcacgctacnctcgtcctacctacgactctcgtcgtcggtctcgagtctagcgtagtagaggttctattacgttntacgtctatcgtatgttcgagtaccgtccaacgtcgtacgtcgtacgtcgtaccggtcggaaccgggtacgggtaaccgacgttacccggtaccgtacccggtttacgacgtccgttaacggtcctaaccggg

SEQ ID NO: 94537 - DNA, 825 bp, Homo sapiens
  misc_feature: GYAE6OF02G1VQD.29.85.H08.1.454.CMB.1.raw
tcagatagagtactcacgaccggtgctcgatttagtatcactcagtcgcggggagctctgggagaggagccccagcccctgagattcccaggtgtttccattcggtgatcagcactgaacacagagaacgcaccatggagtttggactgagcgttgggttttccttgttgtctattttaaaaggtgtccagtgtgaagtgcagtcgtggtggagtcgtgggggagtcggtggtacagccgtcgggggtccctgacgactcgtcctgtgcacgtcctcgtggtacttacgtaagtttaatgttactttttaccattactacgtcggggtacccgtacgtaacggtccggtaccgggggaacgggtcggtgggtagggttcgggttccgttcctttacgtttaagttaaacgtcggtaacggtacggttcgtaccttaacttacgtatttacgtaactcgtactaacggtaccttcggtacggttacgggaacggggtacccgtacgtttaccaccccgtaacgtccctaccgaaggtaaaccgaaaccaaaacgtaaaaccctaaacggttacccttaacccgttaggttaaccttacccgtaacggtaaactaaacggtttacgaaaaccgttcggttaacgtaacgggtaaacggtaacggtaaccggtaacggaaccggttacggtaacccggttcgttttaaccttagttttaacgttaggttaaacggaaaccgttaaaagggaacgtaaggggtaaccggtaaagggttaccgttaaccgttaggggttaacccggggttacggttacggtttaaccggg

SEQ ID NO: 94538 - DNA, 734 bp, Homo sapiens
  misc_feature: GYAE6OF02H5L4Z.29.85.H08.1.454.CMB.1.raw
  modified_base (236)..(236): a, c, t, g, unknown or other
  misc_feature (236)..(236): n is a, c, g, or t
tcagatagagtactcacgaccggtgctcgatttagtatcactcagtcgcgggggggggtctcaggaggcagcgctctcaggacgtcaccaccatggcctgggctctgctcctcctcaccctcctcactcagggcacgagggtcctgggcccagtctgtcctgactcagccctccctccgccggaccgggtctccgtggacagtcagtccactactctcctgctacgtacggaaccngtcaggtacggtacggtttgggtacggtttatcggtaacttagttcgttccttccgtaggttactaacgaaacctaacccggaccccgtaactaaaacccgtaccccctaaacgttccgttaagttaacttttacgtacggtaccggtcgaccgttaccgacccgtaccccgtcggtaccgggtccctaggtacttccgttctttcggcgtcctacgtagtcgtcggaccacgtccgtcctcccgtgtaccctccgtcggtcgggtccctacgtacggtcgtacggactacggtcgtaggtctacgtaacgttacttacgtccgttccttaccttacgtacttatcgaccgtaacgtaacctaaacgttagtttacgtttagttaccggtttacgggaccggtaacggaaccgtagaccgtacgtccggtcgtacgtacgaccgtacgttaccgtacgaccggtccgtacccggtcccgtcgtacctacccgttcccg

SEQ ID NO: 94539 - DNA, 756 bp, Homo sapiens
  misc_feature: GYAE6OF02GRPCU.29.85.H08.1.454.CMB.1.raw
  modified_base (597)..(597): a, c, t, g, unknown or other
  misc_feature (597)..(597): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggactcctgggctcagtctcgccctgactcagtccctcgctacgagtcggttcccgggtctccgtaggactacgtcacgtccaccacttcctcctcgctacgtacggaacctgacacgcgtatcggtacggttcgttacttaccttgttacctccgttacgtaccaacaaccaaccgacggaccgacccggacccccgtaacgtacgtaacttaacgttactacgtacgtgtactacgtaacggccggtaccctacgggtacggttacccgtcgtaacgttccgttaccttaccgttcgtcggttaccgtaccgtaacgtccgtacggacctaaaccgtaccgtccggtacccttcccgtacgtaaccctacgttccgtttaccggtaccggtcccgtaccgcgggtaccgtaccgggtaaccgacggttacggtaacggttataacgtttacttaccgtntccgtacgtctacgttagttcggacgtacgtccaaccgtctacgtacgttcgtaccgttcgggtacgggtcggaaccgggtaaaccgtcggtaccctacgggttaacccgtaccgggttacccggttaccggacccgttacggtaaccggtaacccggg

SEQ ID NO: 94540 - DNA, 765 bp, Homo sapiens
  misc_feature: GYAE6OF02GYDXF.29.85.H08.1.454.CMB.1.raw
  modified_base (196)..(196): a, c, t, g, unknown or other
  misc_feature (196)..(196): n is a, c, g, or t
  modified_base (744)..(744): a, c, t, g, unknown or other
  misc_feature (744)..(744): n is a, c, g, or t
  modified_base (758)..(758): a, c, t, g, unknown or other
  misc_feature (758)..(758): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgactcataatttangatgtcattaagccggcctcacggggtcctgatcgcttctctggctcaagtctggcaacactgcctccctgaccatctcgtgggcctccaggctggacgtatcggacggtgtatttattactgtacctgtctactagtttcgacgtacggaccctaccccggtactacgttcggtttacggtaacgtttcccgggtttacgggggaacccggggtaacgggggaacccctaaacgggtcccgttaccgggtaacccccggtttaccggttacgggttacccgtaaacgggtacccgtaccggtaaaccgggtcccgttaccccgggtacccccccgtttacccggggttacccttacccggtttacccggtttccccggtttaacccccctacccccgtttccccgttaaccgttaaccggttttaacccgttaccgttaacccgttaccggttacgggtaaacccggggtccggggttacccggttcgggtaacccggtaaaccgggtcccgtaccgtaacgttaacggcgtacgcgtacgcgttanccggctcgcgtacngctgtcg

SEQ ID NO: 94541 - DNA, 1001 bp, Homo sapiens
  misc_feature: GYAE6OF02HDECC.29.85.H08.1.454.CMB.1.raw
  modified_base (151)..(151): a, c, t, g, unknown or other
  misc_feature (151)..(151): n is a, c, g, or t
  modified_base (217)..(217): a, c, t, g, unknown or other
  misc_feature (217)..(217): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagngttgggttttcctgttgacttaattttaaaaggtgtcagtgtagaagtgcagctgggtgaggtcgngggggcgtgtaggtacgaggccggttcgggggtacctaggacgtacttcgtccgtgtcggacgtacgcccgttgttacgggaacttttaacgtaaacgggttttaaatacggtttaaccttttttacccaaggttaacccgtaacccgttcggggggtttaaccccggttacgtaaaccgggtaccggtttacccggggggggtaaaagggttccggttacggggtaacgggttcggggtttcctttaaccgttttaccgtttaaagtttttaaacgacggtaacggttaaccgggttcggttaaccttaaccgtaaactttaaacctttacgttaaacgttcgggaccgttaaagtaaacccgtttcgttaagggttaaccgggggtaacggggtttaaccccggtaaacctttaccgggtaaaccccttaacgtttaccccggttaacccgtaaacggtaaacccgtaaaaccgttaaaaacccgaaaccgtttaaaaccggtaaccccttttaacccggagttttaaaccgttacggtaacgggtaaccttaaacggtaaacgaaaccgttaggttaacggtaacggtttaaagggaaccggtttaaccggaaaccgggttaaacccggtaagggttaacccgggttactttttaaacgttaccgggtttaagttttaacccggttaacggaaaataaaaccggggttagggaaaccggagttaaacccgggtagtaacccggtttaaagggtccgggtttacggttacggtttaaacggg

SEQ ID NO: 94542 - DNA, 742 bp, Homo sapiens
  misc_feature: GYAE6OF02HLQ8L.29.85.H08.1.454.CMB.1.raw
  modified_base (213)..(213): a, c, t, g, unknown or other
  misc_feature (213)..(213): n is a, c, g, or t
  modified_base (470)..(470): a, c, t, g, unknown or other
  misc_feature (470)..(470): n is a, c, g, or t
tcagatagagtactcacgaccggtgctcgatttagtatcactcagtcgcggggagctctgggagaggagccccagccctgagacttcccgaggtgtttccattcggtgatcagcactgaacacagagaacgcaccatggtagttggactgagcgttggttttccttgttgtcttaagttttaaaaggtgtcagtgtagaagtgcagcgttggnggaggtcggtgggggagttcggtggtacgaggccggttcggggggtcctggacgtaccgttcctccgtgtcgtcacgtcctcgtaggtattacgtaagtttaatgttacttttaccacttactacggttcgggtcccgtacgaaggtccggtaacggggtacggttcgtgggtacggttcggggttccttcgttctttaaacgttaacgtacggtacggtaacggttcgtaaccttaacctactaagttacttagtnaccgtacgtactcggttagtacgggacggtccgtactaccacctacgttccccagaacgtaacaaaccgaaactaaaccacgttacccttaccggtacgttacttaccgagtaaactaacgtaacaaacgtgttaaaccgtggaaacggtaagtccgaaacgaccgaggttacctcttttaccgtagtttacgtaggttaagaaacggtaaaaggacggaagtaccggttaagacggtaacgttaggggtacgttcggttacgtttaacggg

SEQ ID NO: 94543 - DNA, 853 bp, Homo sapiens
  misc_feature: GYAE6OF02HY4OB.29.85.H08.1.454.CMB.1.raw
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagtctgggttttccttgttgtcttaattttaaaggtgtccagtgtgagtgcagctggtggagtcgtgggggagtcggtggtacacgccggtgggggtccctgacgactctccgtgtgcacgtcctcgtaggacttacgttaaagtttattacgttactttttaccaattaccgtaacggttcgggtacccgtacgtaaccggtccgggttaaccgggggtaacggggttaccttagggggtacgggtttcggggttccctttaccgttacgttttaaacgttaacgtaccgggtaacggtaccggggtactacccgttaaccgttaaccttacgttttaccgtagttacgaccgtaacggtacccgttacggttacgggtacggggtaaaccggggtacccgttacgtttacccgtaccctaaacttccccgttaaccgaaccgggtaacaaaaccgaaaccgtaaaaccgtaaccggttacccttaacccgttagttaacctacgtaacgtaactaaacggtaactaaacggttactacggtaacggaaagttaacgtaccggaacgtaacggacgttaccggttatttaccgtttattacggttacggtaagtaaaccggtaaaacgggtaggtaaccggtaacggtaaggttaaccgttaacgggttaacgggttccggggtacgtttacccggttaacggg

SEQ ID NO: 94544 - DNA, 806 bp, Homo sapiens
  misc_feature: GYAE6OF02HKOYR.29.85.H08.1.454.CMB.1.raw
  modified_base (303)..(303): a, c, t, g, unknown or other
  misc_feature (303)..(303): n is a, c, g, or t
tcagatagagtactcacgaccggtgctcgatttagtatcactcagtcgcggggagctcgtgggagaggagccccagccctgagattcccaggttgtttccattcggtgatcagcactgaacacagagaacgcacatggtagtttggactgagtcgttgggttttccttggttgacttaacgtttttaaaaggtgtccgagttgtagtaagtgcagcgtgggtggagtcggtgggggacgttggtaggtacgaggtccggttcggggggtccctggacgtacgttcctaccgttgacgtaccgngtcccgttcgtaggttactttaacgtaagttttaacgtagtttactttttacccaattaccgtacggttcgggtcctacgtacggccggttaccggggtaagggtcgttgggaggttcgggtccttacgttacgtttaagtaacgttacggaggtacggttcgtacgttaaccttaacgtactttcctaagtcgtactaacgtacttcgtagggtaccgggtaacgggttaccctacggtttaccaacctaccgttacctaccggtaagaaaccaaacgtaaacgaaaccgttaaccgttacccctccggtttaactacgtttaccacgtaaaaccgaaacgttacaactaaggttaccgtaggtaaacgtaacgggtagaacccgtaacgggtaacgtcgttaactttcgttatttaccggtagtaacgtaacgaaaggaaccggtaacggtagaagggttacttacgggtaacgggtacggttaccggttgtttaaacggg

SEQ ID NO: 94545 - DNA, 683 bp, Homo sapiens
  misc_feature: GYAE6OF02F956M.29.85.H08.1.454.CMB.1.raw
  modified_base (662)..(662): a, c, t, g, unknown or other
  misc_feature (662)..(662): n is a, c, g, or t
  modified_base (665)..(665): a, c, t, g, unknown or other
  misc_feature (665)..(665): n is a, c, g, or t
  modified_base (668)..(668): a, c, t, g, unknown or other
  misc_feature (668)..(668): n is a, c, g, or t
  modified_base (673)..(674): a, c, t, g, unknown or other
  misc_feature (673)..(674): n is a, c, g, or t
  modified_base (676)..(676): a, c, t, g, unknown or other
  misc_feature (676)..(676): n is a, c, g, or t
  modified_base (679)..(679): a, c, t, g, unknown or other
  misc_feature (679)..(679): n is a, c, g, or t
  modified_base (682)..(682): a, c, t, g, unknown or other
  misc_feature (682)..(682): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtggttataactttgtctcctgtaccaacaacacccaggcgacggcccccgactccataatttatgatgtcattaagccgtccctacgagggtccctgactcgtccttctcgtgtctacctaagtcctggccaaccgactcgccctccgtagaccattctcgtcggctccgaggctacgacgtagtacggacggtgtaacttcttacgtgtcgtcggtaccttcgttaagtttcggaccgacggtaccacccgtcgtacgttcgtcgtacgtccgttacgggacggacggtaccaaggttccacgggttacccgttaccgtacggtaccgacgtacccgtacgaaccggtccgtaccccggtacccccggttccggttacccgccgtttaccccgttccggtttacccccctacccccgttacccgtacccgttaaccgttaaccctttccgttacgttcccgggtttacggccggtacccgggttacgacccgggtaacggacccgggacgtacgtaccggtagtacgcgngcncgngtgcnncngcnctnc

SEQ ID NO: 94546 - DNA, 610 bp, Homo sapiens
  misc_feature: GYAE6OF02GBV64.29.85.H08.1.454.CMB.1.raw
  modified_base (72)..(72): a, c, t, g, unknown or other
  misc_feature (72)..(72): n is a, c, g, or t
  modified_base (180)..(180): a, c, t, g, unknown or other
  misc_feature (180)..(180): n is a, c, g, or t
  modified_base (189)..(189): a, c, t, g, unknown or other
  misc_feature (189)..(189): n is a, c, g, or t
  modified_base (327)..(327): a, c, t, g, unknown or other
  misc_feature (327)..(327): n is a, c, g, or t
  modified_base (385)..(385): a, c, t, g, unknown or other
  misc_feature (385)..(385): n is a, c, g, or t
  modified_base (556)..(556): a, c, t, g, unknown or other
  misc_feature (556)..(556): n is a, c, g, or t
  modified_base (577)..(577): a, c, t, g, unknown or other
  misc_feature (577)..(577): n is a, c, g, or t
  modified_base (582)..(582): a, c, t, g, unknown or other
  misc_feature (582)..(582): n is a, c, g, or t
  modified_base (594)..(594): a, c, t, g, unknown or other
  misc_feature (594)..(594): n is a, c, g, or t
  modified_base (605)..(605): a, c, t, g, unknown or other
  misc_feature (605)..(605): n is a, c, g, or t
tcagatagagtactcacgaccggtgctcgatttagtatcactcagtctgccctgactcagcctcgctcagtntccgggtctcctggacagtcagtcaccatctcctgcactggaaccagcacgcgatgtccggtggttataactttgtctctggtaccacaacaccaggcgacgcccccntcatattcnatgtcattacgccgcctcgagggtcctgactcgtcttctcgtcggcctctaacgtcctaggaccactaccgtcgccctaccgtacgcctactcctcgtcggtcctacggtcgtcgtacggaccgtgtacggtacggtnttaactttacgtcgtgtcctacgtctacgtacgttcggacgtaccggtccacccggtntaaccggtgtacgtacgttccggccgggtaacggaacgggacctacggtaccggtaccgtaccgtacgggtacgtccgacgtaccgtaccggtcgtccgtcccgtccgttcgaccgtccgttacgtcccgtcccgtcctacgtctaacgtcgtactcgtcgtgtcgtcggngtccgagaccgcgtatcgacngcacngagtcaggtccngacgtgacctnacgag

SEQ ID NO: 94547 - DNA, 828 bp, Homo sapiens
  misc_feature: GYAE6OF02F93RI.29.85.H08.1.454.CMB.1.raw
  modified_base (293)..(293): a, c, t, g, unknown or other
  misc_feature (293)..(293): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcgttcggttttccttgttgacttaagttttaaaaggtgtcctaagtcgtagaagtgcgagcgtgggtggacgtcggtgggggtagtcggtggtacgacggtccggtcggggggtccctaggacgtacctcctccgtggtcgcncgtcctgcgtattacgtaaacgtttaatacgttattttacctactaccgtaccgttcgggttacccgtacgtaacggtaccggtaccgggggtaaggttcggtagggtacgttcggggttcctacgtttacttaacgttaacggtccggaacggtaccggtacgtaccgttaactaccttacgtttacagttacgcgtaacgtacctcgttaggtacggtaaccgggtaccgtaactttcccggaaacctacgtttacccaaccgtaacgtaaaccggtaaccaaacctaaaccgttaaccgtaccccgttacttaacgtacttaccgagtaaacctaaacggttacggtaaactaacgggttcctaaggtaacggtaacgtcgaaaaccgggtcgtaaacggtccgttaacccgttattaggtttaacgtaccgtaaaacgggaacccgttaaaaagggaccggttaaacggaccggttaacgtaacccggttagggttaacgggtcgggttttacccgtaggtttaaccccgg

SEQ ID NO: 94548 - DNA, 686 bp, Homo sapiens
  misc_feature: GYAE6OF02FROW0.29.85.H08.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
tcagatagagtactcacgaccggtgctcgatttagtatcactcagtcgcggggggggtctcaggaggcagcactctcgggacgtctccaccatggcctgggctctggctcctcctcagcctcctcactcgagggcacgaggatcctgggctcagtctgccctgacctcagcctcgctcgagtcgtccgggtctcgtggacngtcagtcactntcctcgngctactacggaaccngcaggcagtcggtcggtaggttattaacgttgtcctctcggtaccaacacctaccgaggccgaccggcccccgtaatccataacttatgtagttcgtactagttaaccgccggtacccgtcgaccggggtcctagacgtctcgttctcgcgtcctacgtagtcctacggacaaacctcgtacgtcccgtaccttaccgactacgtcctccgtcgggtctaccggaccggtacgaccgtacggaccgtgggtaccgtcgtaacttccgtacgtcgtactcgtccttaccgttagttccgcgtaacgggtcccctacggtaccgtccgttagaccttacgttccgggtaccggtccggggtacggtaacccggtaacgtcccggttaaaccgggtcccggtttaaccgggtaacccgttcccggtaaccggtacgtttcccgggtaaaccccgg

SEQ ID NO: 94549 - DNA, 758 bp, Homo sapiens
  misc_feature: GYAE6OF02JJZSW.29.85.H08.1.454.CMB.1.raw
  modified_base (185)..(185): a, c, t, g, unknown or other
  misc_feature (185)..(185): n is a, c, g, or t
  modified_base (209)..(209): a, c, t, g, unknown or other
  misc_feature (209)..(209): n is a, c, g, or t
  modified_base (574)..(574): a, c, t, g, unknown or other
  misc_feature (574)..(574): n is a, c, g, or t
tcagatagagtactcacgaccggtgctcgatttagtatcactcagtcgcggggggggtctcaggaggcagcactctcgggacgtctccaccatggcctgggctctgcctcctcctcacgcctcctcactcgagggcacgaggactccgtgggctcgagtctcgcctaggactcagcctcgctcgngtcgtccggtctcgtgacacgtcncgtaccacgtactccttccgtacgaccgtaacgtaccggaaccgcgacgtacgacggtacgttacgggtcgggttacgtttaactttaccgtttccgttactacccggttagtaaccccgaaagtaccccaccggacggtaccgaccccggacccgtactacgtaactttagttacacgtacttcgtaacgacgttaccggcccgtaccggttacggtacccggtcttagtaccgtcctccgttacgtcgtcgaccgtacgtacggtcgtaccgaacttacgtcgttacccgcctacgtacgtcacgttcgtcgtaccgtccgtacgcggtaacgtccggtacgtacggttcggtaacgttttanaaccggtttccttaggttcctaccggttacgtttcgttacgtttccggtaacgcccgttaaccgtccgtaaccgttgtccggtacgtttaacgtcggtaacccgggtggttaacccgggaagtcccggaaaccgttccgttaccgacgtttacgcggttaacctccggtacgtaccgtacccgg

SEQ ID NO: 94550 - DNA, 167 bp, Homo sapiens
  misc_feature: GYAE6OF02JYXJV.29.85.H08.1.454.CMB.1.raw
  modified_base (146)..(167): a, c, t, g, unknown or other
  misc_feature (146)..(167): n is a, c, g, or t
tcagatagagtactcacgaccggtgctcgatttagtatcactcagtcgcgggacacgactggagattaaacgaactgtgctgcaccatctgtcttcatcttcccgcatctgaatgcgtactctgcgcggctggcaaggcgcatagnnnnnnnnnnnnnnnnnnnnnn

SEQ ID NO: 94551 - DNA, 681 bp, Homo sapiens
  misc_feature: GYAE6OF02GQ3OX.29.85.H08.1.454.CMB.1.raw
  modified_base (194)..(194): a, c, t, g, unknown or other
  misc_feature (194)..(194): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacngtcagtcaccatctcctgccactggaaccagcagcgatgtcggtgttatacttgtctcgtcgtaccaacaccaccgacggccgaccgcccccgactctaacttaattagtagtatcgtactagtacgccgtccgtacggtaccggtcctagtactccgtccttccgtcgtcgtcctacgtaacgtcgtacgacctaacctaccgtccgtccctaccgtaccgtacctactccgtccgtcggtcccgtaccgacggtcgtacgtacgtacgtacggtacgttagtaacttacgttacgtcgtaccgttcgttccgttacgttacgtttaccgaccggtaccgacccgtacccgtaccgtaccgttcgttacgttaccgttaccgggttaccgggaaccggggtaaccggtaaccgtaaccggtacccggttaccggtaccccggttaccggttaccggtacccgtaccggtaccgttaccggtaccgg

SEQ ID NO: 94552 - DNA, 827 bp, Homo sapiens
  misc_feature: GYAE6OF02F6PPG.29.85.H08.1.454.CMB.1.raw
tcagatagagtactcacgaccggtgctcgatttagtatcactcagtcgcggggagctctgggagaggagccccagcccctgagattccccaggtgtttccattcggtgatcagcactgaacacagagaacgcaccatggagtttggactgagcgttgggttttcctttggttgtcttaagtttttaaaaggtgtacctagtgtagaagtgcagtcgtggtggagtcggtgggggtagttcggtggtaccgaggtccggttcggggggtcccgtggacgtaccttccttccgtgtcgcgtacgcctcgttaggattacgttaaagtttaattgttactttttacctataccgtacgttcgggttccggtacgtaacggtccgggtaccgggggtaacggtcgggtcggggtaggttcgggttcttacgttacgtttaacgttacggttacggacggtacggtcgtaccttacttacgttacttcttagtacgtacgtacgtacgttcgtacgggtacgggtaacggtaccgtacgtttacccaaccgtttcctaaccgtaccggtaaacggtaacaaacctaaaaaccgtaaaccgtacccgtttaaacccttcccgttaaacggtttacttaccgtaacgtaaacgttaaagtaccgaaacgttacgttaacgaacggtaaaacgggtacgtaacgggaaccttaacgggtacggtaccgttaccttttagttacgtttaggtacgtaaaggaaaacggaaaggtaacggacggaagttaacggtacgttaggttacggggtacggttccggtttaaaccgttcggg

SEQ ID NO: 94553 - DNA, 777 bp, Homo sapiens
  misc_feature: GYAE6OF02GCYVQ.29.85.H08.1.454.CMB.1.raw
  modified_base (150)..(150): a, c, t, g, unknown or other
  misc_feature (150)..(150): n is a, c, g, or t
  modified_base (212)..(212): a, c, t, g, unknown or other
  misc_feature (212)..(212): n is a, c, g, or t
tcagatagagtactcacgaccggtgctcgatttagtatcactcagtcgcgggggggggtctcaggaggcagcactctcgggacgtctccacatggcctgggctctgctcctcctcagcctcctcactcagggcacaggatcctgggcctnacgtctcgccctgactcagcctcgctcagtcgtccggtctccgtggacagtcagtccaccgntcctcctgctacgcggaaccagccagtcgattcggtacggttgttacttacgtttgtcctccgttacgtaccaacgaacctacccgaggccgtacccggcccccgtaacttacgtaacgtaactttacgtcgtattcgtacgtaacgttaacggccgtacccgtacggtaaccggggtccttggacctcgtaccgtttcgacttcggacctaccgtacgtccgtacggactaaccgtccgtcctaccgttacccgacgtaacccgtacgttccgttcggtccggtaccgttccggtacgttaccgtacggacggtacgtacggtacggttacgttaacggtttaacgttccgtacgttccgttacgtcttaccgtaggttttaaccggaccggtaaccgtacccgtacccgaccggttaaccgttacggttccgtaccgtttcgggtacccgggtaacccgggggttaaccggtaacccggtaacgttcccggtaacccgggtttcccggtttacccggtaccggttaccggtaaccccggttacccggtaaccggtaacccggg

SEQ ID NO: 94554 - DNA, 782 bp, Homo sapiens
  misc_feature: GYAE6OF02F4NUQ.29.85.H08.1.454.CMB.1.raw
  modified_base (366)..(366): a, c, t, g, unknown or other
  misc_feature (366)..(366): n is a, c, g, or t
tcagatagagtactcacgaccggtgctcgatttagtatcactcagtcgcgggggggtctcaggaggcagcactctcgggacgtctccaccatggcctgggctctgactcctcctcagcctcctcactcaggcacaggatcctggctcagtctgcctgactcagcctgctcagtgtccggtctccgtaggactagtcacgtcaccactctcctgacacgtacgaaccgtgacgacgacgtattcggttaccggttaggttaactaacgtttcgttacctaccgttacggtaaccaaactaacccgaacccgtaagggtaccgaaccgggaccccccctaaagtaccgtaacttaaacgttttaacgngtaacgttcgtactaagtttaaaccggccggtcccttaacggaccggggtaccctaggacgttccgtacgttcgtccgtcgggtacctacctaacggttcgtacggactaaccgtactccacccgttccgtacgactactcctgtaccggaccttccggacggtctacgacgtacgtacggtcgttagtacgttaacttactcggtactacgtacccgttaagtacctttacggacgtaacccgggaccgtaacccacggttaaccgttacggtaacgttacgttacccggtttaccggggaacccgggttaaacgggtaaccccgtaaagggtaccccgttaaccgggtacccgtttacccgggtttaaaccgggaacggtcccgggtttaacccgacgggttaaaacccccggg

SEQ ID NO: 94555 - DNA, 660 bp, Homo sapiens
  misc_feature: GYAE6OF02GTN7Z.29.85.H08.1.454.CMB.1.raw
  modified_base (231)..(231): a, c, t, g, unknown or other
  misc_feature (231)..(231): n is a, c, g, or t
  modified_base (557)..(557): a, c, t, g, unknown or other
  misc_feature (557)..(557): n is a, c, g, or t
tcagatagagtactcacgaccggtgctcgatttagtatcactcagtcggcgggggggggtctcaggaggcagcactctcgggacgtctccaccatggcctgggctctgctcctcctcagcctcctcactcgagggcacaggactccgtgggcctacgacgtctcgcccctagacctcacgccctcgctcaggtcggtccggttctccgtaggactacgtcacgtccacctntccgtcctgacacgtacgaaccagccaagcgatcggtcggttagttactacgtttcgcttcctagtaccaacactaccgaggtccgacccggcccctatcctaattacttagtagtactgtacagttacgccgtcctacggcggtacctctacgcctattcgcgttcgcctacgtactcgacgtctaacgccgtctcccgtcaacgtacctacgtcgtcgtaccgtcgtaccgtcgggtctacggtcgtacgacgttaggttactacgttagttcgtctacggttcctagttaccttagtaccgtacggaccgtaccgtacccgtnaacgttcgtacgtacgttaccggtggtaacccgggaacggttaccgaccggtaccgtacggtacccggtttcgtaaccggtcccaggtccctaacgtccccgg

SEQ ID NO: 94556 - DNA, 1050 bp, Homo sapiens
  misc_feature: GYAE6OF02HDMHR.29.85.H08.1.454.CMB.1.raw
tcagatagagtactcacgaccggtgctcgatttagtatcactcagtcgcggggagctctgggagaggacgccccagcccgtgagacttcccaggtgtttccagttcggtgatcagccactgaacacagagaacgcaccagtggtagttggactgagtcgttcgggttttccttgttgtacttaagttttaaaaacggtcgtactagtgtagaacgtgacagcgtggtaggacgtcggtaggggacgttcggtaggtaacgaggaccggttcgggggtacccctagtacgtaccgttaccgttccgtaggtacgacgtaccgtccgttcgtacggtaactttaccgttaaaagttttaacgttacgttaacgttttttaccgaacgttaacgtaaccggtttacgggttacccgtaaccgtaacggtccgggttaaccgggggtaaacgggttcggttaacggggtaacggtttacgggttacccgttacgtttaacgtttaacggttaaacgtacggtaacggtaaccggttacggtaaccgttaacctaaacgttacgtttacccgtaattacggaacgtaacgtaaccgttaccgttagggttaaacgggaaacccgggtaccgttaaacgttacccgtaaccgtaaccgtttacccgtaacccgtaaaggtaaacccgtaaaaccgtaaaacctaaaaccggttaaaccgtttaaacccccgtacgttaaaccggtttaaccgtaaccgtttaaacggtaaaacccttaaaacggtaaccggttaaaaccgttaaacggttaaccggttaaacggttaaacggttaaaacgggtaaaccgtaaaccggggttaaaccgtaaacggggtttaccgttaaccgttttaaaccgtttaagtttttaccggttaacgggtaaaacggttaaaaccggtaaaaaacggggttaaccggttaaacgggttaacccgaaacgggtttaaaccggtttaaccgggttaaaccgggggtttaacgggtacccggttttttaaccgggtaaaccggg

SEQ ID NO: 94557 - DNA, 785 bp, Homo sapiens
  misc_feature: GYAE6OF02HXNXE.29.85.H08.1.454.CMB.1.raw
  modified_base (290)..(290): a, c, t, g, unknown or other
  misc_feature (290)..(290): n is a, c, g, or t
tcagatagagtactcacgaccggtgctcgatttagtatcactcagtcgcggggagctctgggagaggagccccagccctgagattcccaggtgtttccattcggtgatcagcactgaacacagagaacgcaccatggagtttggactgagcgttggttttccttgttgcttaagttttaaaaggtcgtccagttgtagtaagtgcgagcgtagggtcggagtcggtgggggagttcggtggtaaccaggtccggtcggggggtccctggacgacgttcctcctggtcgcncgtcctgtagtattacgtaagtttaatgttacttttcataacgtcgtgggtccctacgaacgtccggtacggggtaaggttcgtgggacggttcggttcttcgttacgtttaagttaacgtacggtacggtacggtactaccgttaactacttattacgtaagtcgtacgagtaccgttgtacggtaacgggtacggtcccgttagtacctaacctaacttccgtaacgaaggtaaacaaaccgtaaaccaaacgttaaccgttaccgttaaccgttacgtttacacgttacaaacgtaactacgtaaactacggtaacgtaggtaaacgtaacggtaacgaccggtaaccggtacggtacccggtttacttacgttttaagttccgttaagggtaaacggtaaacgtaaaaacgggtggttaaaccgggaagttacggtaacgtttaacggttaacggggtttacccgggttacgggtttacggttaaacccgg

SEQ ID NO: 94558 - DNA, 865 bp, Homo sapiens
  misc_feature: GYAE6OF02GXCVF.29.85.H08.1.454.CMB.1.raw
  modified_base (257)..(257): a, c, t, g, unknown or other
  misc_feature (257)..(257): n is a, c, g, or t
tcagatagagtactcacgaccggtgctcgatttagtatcactcagtcgcggggggggtctcaggaggcagcactctcgggacgtctccaccatggcctgggctctgctcctcctcacgcctcctcactcgagggcacaggtatccgtgggcttcagtctcggtccctagactcgacgtcctcgctacgaggttcgtccgggttctccgttaggaactacgtcacgttccacctagtccttctacgcactcggaaccngaccgagtcgagtcggtacgtagttataacgtttgtccttaccgtacggtaaccaacgtaacctaccgaggaccggtaccgacccccgtaagtactaagttaaacgtttcgaacgtacgttacgttactaaagttaaaccggtcccggtacccgttaacgggtccggggttaacccttagtaccgttccgttccgttaccgttcgtaccggtaccgtaacgttaccgtcggtaacggtaccttaaacgccgtttaccgtccccgttaacctcggtaacccttacgtacgttacccgttaggtcccgtaaccggtggtacgaccggtaacgtacggttccggtaacgggttattaaaccgttacgttcgtaccggtaacgtcgttaccgttaaccgttcgtttaccggacggtaacccggttacccgtacccgaaaccgttcggggttaacccgttacctaagggggttttccccgggtaaccgggtaaacccgggggtttaacccggaaccgttaaacgggttacccggtttaaacccgggtaccccggttaccgggtttaacccgggaacgtttaccgggttaacctacccccggttaaccccgggg

SEQ ID NO: 94559 - DNA, 741 bp, Homo sapiens
  misc_feature: GYAE6OF02H8P2R.29.85.H08.1.454.CMB.1.raw
tcagatagagtactcacgaccggtgctcgatttagtatcactcagtcgcggggagctctgggagaggagccccagccctgagattccccaggtgtttccattcggtgatcagcactgaacacagagaacgcaccatggagtttggactgagtcgttgggttttccttgttgtcttaattttaaaaggtgtccagtgtagagtgcagtcgtggtggagtacggtgggggagtcggtggtacacggtcggtcgggggtccctgagactctcctgtcgcacgcctgtggattacgtaaagtttatcgttatttttaccatacgtacgtcggtccgtacaacggtccggtacggggtaaggtcgtaggacgggttcggttccttacgttacgtttaagtaaacgtcggtaggtacggtcgaccttaagtactactttactagtcgactacgtacgtcgttggtacggacgggtaccctagtaccaccgttaacgttaccgtccgaaaggtaacccgaaactaaacccggtaaactaaacggttacccttacccggttaagttaccttaccggttaataacccgtaaaagttaaaccgacgttaaacggtttaccgtaaggaaagttaaccggtacgaaaccgggtacgtacggtaccgtttaccttagttttacttacgtttagaacgtaaacgaaggtaaccggaagtacgtagtacgaggttaggtaccgtcgttcgttacgg

SEQ ID NO: 94560 - DNA, 602 bp, Homo sapiens
  misc_feature: GYAE6OF02G9XFS.29.85.H08.1.454.CMB.1.raw
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (338)..(338): a, c, t, g, unknown or other
  misc_feature (338)..(338): n is a, c, g, or t
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
  modified_base (384)..(384): a, c, t, g, unknown or other
  misc_feature (384)..(384): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcgacgggcacaggactccgtgggctcagtctcgcccttgactcacgccctcgtctcaggtcgtcggtctcctggacngtcagtcacctntctcngcacgtcggaacancgacgctactcggtacggttacgttatacgtttgccttacgcgtaaccacaacctaccgagggtccgacccggacccctaacgtcaacttaagttatacgtancgtacaagttacgccgtaccncggacggtccngtctcgtctctcgngtcctacacgttcgcactaacgctcgcctaccngacctntcctcgtcgactcgngntacgcgagtggaacgttagtacttagtcgtntcgtcncgttacgtctacggactccgtacgaacgtcctaacgtcgtacggtactcgggtacggaccgggttaacgaccgtagtccgtaccggtaccgtacggttacgacgtaccggtacgtacggtaccgg

SEQ ID NO: 94561 - DNA, 658 bp, Homo sapiens
  misc_feature: GYAE6OF02HSUB7.29.85.H08.1.454.CMB.1.raw
  modified_base (237)..(237): a, c, t, g, unknown or other
  misc_feature (237)..(237): n is a, c, g, or t
  modified_base (332)..(332): a, c, t, g, unknown or other
  misc_feature (332)..(332): n is a, c, g, or t
  modified_base (641)..(641): a, c, t, g, unknown or other
  misc_feature (641)..(641): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggactctgggctcagttctcgccctgactcacgcctcgctcagtgtccggtctccgtggacagtccagtccaccgatcctccgtgcctacgtacggaaccngccaggcattggtcgtagttattactttgtctccgtacgtaccaactaaccacccgaggccgacccggcccccgtatacctaactttaatttagngtacttagtactaagttaacgtcccgaccgtccggtaccggttcctacggtcttcgtaccttcgtcgtcgtacctaccgtacgtccgtgactacgtaccgtcgtccctccgtacgacctcgtacgtccgtcggtcctcggtacgtcgtacggtacgtcgtacggtacggttacacgttttactacgtcgtcctaggtcctacgttacgttacgcggtaccgacctaccgcgttaacgtcgtacgttacgttcggtaccgggcggtaaccggtacaccgttcgtacgttacccgttccgttaccggtacncgtaccgtgtaccccgg

SEQ ID NO: 94562 - DNA, 673 bp, Homo sapiens
  misc_feature: GYAE6OF02G00QR.29.85.H08.1.454.CMB.1.raw
  modified_base (232)..(232): a, c, t, g, unknown or other
  misc_feature (232)..(232): n is a, c, g, or t
  modified_base (447)..(447): a, c, t, g, unknown or other
  misc_feature (447)..(447): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcactcagggcacaggatccgtgggctcagtctcgccctgactcagcctcgctcagtcgtccgggtctccgtggactgtcagtcaccatctcctgcctactacggaaccngcagcgtatcggtcggtggttatacttgtcctctcggtacaacaccgaccaggccgaccgccccgatctacttaacttatgatcgtactacgttacgccggtcctcggtacgggtccctgtactcgtcttctcgtcgtctaccgtaagtccgtacggtaccacgccgtacgccctccgacgtacctactccgttccgtcgggtcctccgggtacncgtacggacgtcgtaggtacggttactacgtttacttccgtacggtcgttacgtcttaccgttacggttcgcccgttaggacccgtacccgttacgaccgttcgtaccggttacgtttcccgggttacgggtaaccggggtaaccggtaccgtaaacccgggttccgtaacccggtacccggttaccggttaacgggtaccgtacggtacccgttacggaacccgg

SEQ ID NO: 94563 - DNA, 695 bp, Homo sapiens
  misc_feature: GYAE6OF02GK0MD.29.85.H08.1.454.CMB.1.raw
  modified_base (198)..(198): a, c, t, g, unknown or other
  misc_feature (198)..(198): n is a, c, g, or t
tcagatagagtactcacgaccggtgctcgatttagtatcactcagtcgcggggggggtctcaggaggcagcactctcgggacgtctccaccatggcctgggctctgctcctcctcagcctcctcacctcagggcacgaggtactccgtgggctcagtctcgcctgactcagcctcgctcagtgtccggtctcctgacngtcagtcacatcctctgctacgtgaacctgcagcgagtcgtcggtagttactacgtttcgtcctccgtcggtaaccaacaacctacccgaggcccgaccggaccccccgtagttcctaactttaacttacgtagtacgtcgtacgtaagttaacggacgtacccgttcggtacggggtaccctagaaccgttccgtccttcgtctacggtccttaccggtatccgtaggaacctacgtaccgtcctacccgtcctcggaacctcgttcgtacggtccgggtacctacggagtccgtacgacggtcgtacggtacggtagttaacttcgttacgtcggtactcggttactcgtacgttcgaccggaccgtccgtacccgtagttaccgttcgtacggttccgttacggtaccgggacggtaaccgggtaaccgtaaccgtacgttacccggtacccggttccgttaaacggccggtacggttaccgtcggtaacccgg

SEQ ID NO: 94564 - DNA, 661 bp, Homo sapiens
  misc_feature: GYAE6OF02I34HW.29.85.H08.1.454.CMB.1.raw
  modified_base (237)..(237): a, c, t, g, unknown or other
  misc_feature (237)..(237): n is a, c, g, or t
  modified_base (378)..(378): a, c, t, g, unknown or other
  misc_feature (378)..(378): n is a, c, g, or t
tcagatagagtactcacgaccggtgctcgatttagtatcactcaggtcgcggggggggtctcaggaggcagcactctcgggacgtctccaccatggcctgggctctgctcctcctcagcctcctcactcgagggcacgaggatccgtgggctcagtctgccctgactcacggcctcgctcaggtcgtccgggtctcctggacagtcagtccacctatctcctgactactaggaaccngaccgagcgaatcggtcggtgttactacgtttcgtctcctacggtaaccaactaaccaccgacggcgacccggccccctatacgtaacttaacttagtcgacgtgtacctaagttacggccgaccttcggtacgggttccngtacgtcgtccttcgtacgtcggtaccttacgacgttcgcgaccaactccgtcgacccttccgtacgaccctacgtcctaccgggtcggtacctccggagtctacggaaccgtgttcggtaacgtcgttaacgtacttacgtctacgtcgtccttacgtagttacgcttaccgggacctccggtcacggttcgtacgtccgttacggtcgggaaccggtaccggtaccgtacgtaccggtacgttacccgtcggtaccggactccggaaccgttggaacccgg

SEQ ID NO: 94565 - DNA, 628 bp, Homo sapiens
  misc_feature: GYAE6OF02F6FWF.29.85.H08.1.454.CMB.1.raw
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (300)..(300): a, c, t, g, unknown or other
  misc_feature (300)..(300): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
tcagatagagtactcacgaccggtgctcgatttagtatcactcagtcggcggggggggtctcaggaggcagcactctcgggacgtctccaccatggcctgggctctgctcctcctcagcctcctcactcagggtcacgaggactccgtgggtctcagtctcggtccctgacctcagtccctgctcgtagtcgttccggtctccgtggactacgtcgactccacctattcctcgngcacgtcggaaccngcagtccgtatcggtacgtgttatacttgtacctcgtacgtacaacacacgngccgaccgaccccactctatagttantntcgtctaagtacgaccgtcctcggacggtcctagtctcgtctcgtctcgtactacgtacgtcgtacacgtaacctacgtccgtaccctccgtacgaccttactccgttccggtaccggtcctaccggacggtcgtaccggaacgttgtaccggtggttacgtaacgtttactcgtagtccgttaggtcctacgttgtaccgcgtaacggcctacccgtgtactcgggtcttacgtcggttcgggaccgggtacaacggtaccgcgttaaccgcgttcggacggtcacgtacgagtcccgg

SEQ ID NO: 94566 - DNA, 754 bp, Homo sapiens
  misc_feature: GYAE6OF02F4JXV.29.85.H08.1.454.CMB.1.raw
  modified_base (715)..(715): a, c, t, g, unknown or other
  misc_feature (715)..(715): n is a, c, g, or t
  modified_base (733)..(733): a, c, t, g, unknown or other
  misc_feature (733)..(733): n is a, c, g, or t
  modified_base (741)..(742): a, c, t, g, unknown or other
  misc_feature (741)..(742): n is a, c, g, or t
  modified_base (745)..(745): a, c, t, g, unknown or other
  misc_feature (745)..(745): n is a, c, g, or t
  modified_base (748)..(748): a, c, t, g, unknown or other
  misc_feature (748)..(748): n is a, c, g, or t
  modified_base (750)..(750): a, c, t, g, unknown or other
  misc_feature (750)..(750): n is a, c, g, or t
  modified_base (752)..(754): a, c, t, g, unknown or other
  misc_feature (752)..(754): n is a, c, g, or t
tcagatagagtactcacgaccggtgctcgatttagtatcactcagtctgccctgactcagcctcgctcagtgtccgggtctcctggacagtcagtcaccatctcctgcactggaaccagcagcgatgtcggtgttataactttgtctcctagtaccaacacacccgagcgacggcccccgactcaataactttatcgtatgtactacttaacgccggtccctccgacggggtccctgactccgtcttcgtcgtccggtacctaccgtaacgtccgtcggaccaacgtacctcggtccctccgtacgtaccgtacgttccgtcgtacggtccctaccggacggtacctcggaaccgttacgtacggtacgggttaacgttaacggtttaactaccgttcggaccgtttacgtacccgttgttaaccggttttccgaccgggttacgccccgtaacccgtcggtaaccgttcgggtaacgttaccggtttccgggtaccggtaacgggggtaacccggtaaaccggtaccggtacccgttacggggttaaacccgtcggtttacccgtacgtacccggtaccgtaccgtaaccggtccgttccccggtcccccgtaaccgttctacccgtttacgtccccggttacccctacccgtccgtactacgtacccgttctaaccttcgcgggttacgccgggtcgtacggtacgtacccgnggaccttaggcgacgtcnccagtccnngcncgncncnnn

SEQ ID NO: 94567 - DNA, 682 bp, Homo sapiens
  misc_feature: GYAE6OF02IJFM4.29.85.H08.1.454.CMB.1.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
tcagatagagtactcacgaccggtgctcgatttagtatcactcagtcgcggggggggtctcaggaggcagcactctcgggacgtctccaccatggcctggctctgctcctcctcagcctcctcactcgaggccaacaggactccgtcgggctcgtagtcctcgcccttcgacctcgacgtcctcgctcgtagtcgtccggtctccgtgactacgtcacgtacactntcctactgctaacgtacgaccngcncgcgtatcggttacgtacgttacttacgttcttccgttaccgtacgtaaccaactaccgtaccgacggccgacccgtaccctactacgtaacttacgttacgtagtactacgtacgtacgtaccgccgtaccgtaccggtacggtccgtcgtcgtcgtcttcgtctcgtactacgtcgtctacgtacctaactctcccgtacctaccgacgtaccgtctccgtcgtacgtcctagcgtcgtacacggtcgtacggttacgttatacgttacgttcgtctcgttcgttacgtacgttacgtccgtacgaccgtccgtaaccgtcgtacgtacggtccttaccggttccggtaacgggtcgtaacccggtacgtccgttaccggttaccggtcgtaccgggttacggtaccgttcgtacccggtacgtaccgg

SEQ ID NO: 94568 - DNA, 875 bp, Homo sapiens
  misc_feature: GYAE6OF02IFFIC.29.85.H08.1.454.CMB.1.raw
  modified_base (272)..(272): a, c, t, g, unknown or other
  misc_feature (272)..(272): n is a, c, g, or t
tcagatagagtactcacgaccggtgctcgatttagtatcactcagtcggcggggggggtctcgaggaggcagcactcgtcgggacgtctccaccatggccgtgggctcgtgcctccgtcctcacgtcctcctcacgtcgacgggcacgaggactccgtgggcctacgcgttccgtcgtcccgtagtaccttcgacggtccctccgtcctacgtacggtccggtccgggttcctccgtggtaacgtacggtaccgtacggttaccaaccgttntccgttccgtacgtactaaccggtaacggaacctacgtacgtaacggtcgtaacggttcggttaccgggttagtttaaacttccgtttcgtacgtaccgttaacgggtaacctaacgtaacccgtaaccggtcgggaccccgtaaccccggtacccccgtaacgttactaacggttttaacctgttaccggtactaccggttacgtaaccggttaccggcccggtaccgttaccgggtaccggttccaggttaccgtccgttacgtccgtcgtcgtacctacggtacgtcgacgtacttacgcccgtccgttaccgacgttaccgtaaccgttcgtacggttacccgtcggtaccctccggtaaacgttccgtacggaacggttaccggtacggttaaacggttccgttacggtttaacgcggtacgtcccgttagttacctcggttcgtaaccggccttaccggaaccttcccggaagttccgtaggtacccgttacggggttaccggttaccggacgggttaaccctcggtaacccgtaccgggttccgttaccgggttaacgtaccggtaaccccttgggtaacccggtgttaacccggg

SEQ ID NO: 94569 - DNA, 255 bp, Homo sapiens
  misc_feature: GYAE6OF01B4YUJ.23.14.B03.1.454.CMB.1.raw
  modified_base (251)..(255): a, c, t, g, unknown or other
  misc_feature (251)..(255): n is a, c, g, or t
tcagacgcgagtatcacgaccggtgctcgatttagtgtgagtagtttgggtctgggacagatttcactctcaccatcagcagcctgcaggctgaagatgtggcagtttattactgtcagcaatattatagtattcctttcactttcggccctggaccaatgtggatatcaaacgaactgtggctgcaccatctgtcttcatcttcccgccatctgaatactcgcgtctgagcggctggcaaggcgcatagnnnnn

SEQ ID NO: 94570 - DNA, 259 bp, Homo sapiens
  misc_feature: GYAE6OF01C6KFB.23.14.B03.1.454.CMB.1.raw
  modified_base (252)..(259): a, c, t, g, unknown or other
  misc_feature (252)..(259): n is a, c, g, or t
tcagacgcgagtatcacgaccggtgctcgatttagtgtgagtagtttgggtctgggacagatttcactctcaccatcagcagcctgcaggctgaagatgtggcagtttattactgtcagcaatattatagtattcctttcactttcgaccctgggaccaatgtggatatcaaacgaactgtggctgcaccatctgtcttcatctcccgccatctgaatactcgcgtctgagcgggctggcaaggcgcatagnnnnnnnn

SEQ ID NO: 94571 - DNA, 531 bp, Homo sapiens
  misc_feature: GYAE6OF01E18BY.17.9.A09.1.454.CMB.1.raw
  modified_base (365)..(365): a, c, t, g, unknown or other
  misc_feature (365)..(365): n is a, c, g, or t
  modified_base (432)..(432): a, c, t, g, unknown or other
  misc_feature (432)..(432): n is a, c, g, or t
tcagcgtagactagcacgaccggtgctcgatttagcgagacgcgcaggggagctctgcttcagctgtgagcgcagaaggcaggactcgggacaatcttcatcatgacctgctcccctctcctcctcacccttctcattcactgcacagggtcctgggcccagtctgtcttgacgcagccgccctcaatgtctgcggccccaggacagaaggtcaccatctcctgctctggaagcgctccaacatggaaatattatgtatcgtgttccagcacctccagaacacgaccccaaactcctcatctatagaaaaataactaacccgaccctcacgggtacttcctgaccgattctctggctccaagtcnggcacggcagcccacccgtggacactcacccgcctccagacgtggggacgacggcctattacttacngacggaacagtagggatagcagctagactgggttgggtcgtcgggacgggacgggacaaggctacggacccgtacgtacggcacgcccgaggctcccgg

SEQ ID NO: 94572 - DNA, 691 bp, Homo sapiens
  misc_feature: GYAE6OF01AT5R8.17.9.A09.1.454.CMB.1.raw
tcagcgtagactagcacgaccggtgctcgatttagcgagacgcgcaggggagctctgcttcagctgtgagcgcagaaggcaggactcgggacaatcttcatcatgacctgctcccctctcctcctcacccttctcattcactgcacagggtcctgggcccagtctgtcttgacgcagccgccctcaatgtctgcggccccaggacagaagtcaccatctcctgctctggaacgcggctaccaacattaggaaatattatgtatcgtggttccagccacctccgaggaaccacgacccccaaactcctcatactaatagaaaactaactaaacccgaccctacgaacggtacttaccctgacccgtatttccgtacgtcggtcctaccgtaagttccgtcggacctaccggacacgcccctaacccgtggaacctacgtcccgaacccgggtccctacccgaacggtaccggtcgggggaacctacgggaccccgttaagtttaaccgttaccgtacgggaaccgggtaaactaggtacgggaattacggaccgaacggtcccctagggtaccgttgggggtttcgggtacgggttccggggacggggacgggaaccctaggtcccgtacggtaaccccggttcccggtaagggttcccaaccggaccccgtaagggtcccgtacccccggg

SEQ ID NO: 94573 - DNA, 775 bp, Homo sapiens
  misc_feature: GYAE6OF01AEPQT.17.9.A09.1.454.CMB.1.raw
tcagcgtagactagcacgaccggtgctcgatttagcgagacgcgcaggggagctctgcttcagctgtgagcgcagaaggcaggactcgggacaatcttcatcatgacctgctcccctctcctcctcacccttctcattcactgcacgagggtcctgggcccagtctgtcttgacgcacgccgccctcaatgtctgccggccccaggacagaagtcaccatctcctgctcgtggaacgccggctaccaactagttaggaaattaattatggttactcggtcggttccacgccaccctaccgaacggaaccaccgtaccccctaaacttccctactaacgttactaagtaaacgtaaaaacttaacctaaaccccgtacccgtacgaacgggtaacctttcccgtacgtaacccgttactttacctccggtcggtaccttacccgtaaacggttccgtcgggacccgtaccgggacctaaccggaccccgtaacccgtcggaaccctaccgtaaccccggacccggtaccctaccggaacggtacccggggtaccgggggaaccggtaacgggtacccgttaaagttttaccggtaaccggttaccgggaacggtaaacgtaggttaacgggaactacggtaccggacggttccgtacggtacgggttggggttcgggttacgggtaccggggtacggggaacgggaccgtaacgggtccgtaccggtaccgttacggtacggtaccgaaccgggtccgacgggtccctaccccggg

SEQ ID NO: 94574 - DNA, 787 bp, Homo sapiens
  misc_feature: GYAE6OF01A2MDD.17.9.A09.1.454.CMB.1.raw
  modified_base (192)..(192): a, c, t, g, unknown or other
  misc_feature (192)..(192): n is a, c, g, or t
  modified_base (233)..(233): a, c, t, g, unknown or other
  misc_feature (233)..(233): n is a, c, g, or t
tcagcgtagactagcacgaccggtgctcgatttagcgagacgcgcgtagggggagctctgcttcagctgtcgagcgcagaaggcaggactcggacaatcttcatcatgacctgctcccctctcctcctcacccttctcattcactgcacgtagggtcctgggtcccaggtctgtcttgacgcagccgccctnaatgtctggccggccccaggacaggaacgtccacctatccncctgctcgtggacgcgtcctaccaacgtattaggaaaacttatttagtacgtaagttcggttacggttacccaacgtcccacccgtcccgaaggtaaccacccgacccccgtaaagtccctacgtagttacctaacgtaacgtaaaaacttaaccgtaacccggtacccgtaggtaacgggttacctttacccgtaacggttacccgtacttttccgtacgttccggtacccttaccgtaacggttaccttacgggaccctaaccgggtacctacccgtaccccgtacccgttaacggaaccctacgtacccgaacccggtccctaccgaacggtacggtacggggaccgtacgggtacgtacgttacgttaccgtacggaacggtaaccgtacggtacgggtacgtacggtacgtacggtaccgttacggtacggttacggggttcgggtcggtacggggtaacgggtacgggaaccgtacggtacccggttacgggtacccgttacggtaccggtaccgtaacggcccggttaaaggtcccgtacccccggg

SEQ ID NO: 94575 - DNA, 752 bp, Homo sapiens
  misc_feature: GYAE6OF02JZSM8.17.9.A09.1.454.CMB.1.raw
  modified_base (118)..(118): a, c, t, g, unknown or other
  misc_feature (118)..(118): n is a, c, g, or t
tcagcgtagactagcacgaccggtgctcgatttagcgagacgcgcaggggagctctgcttcagctgtgagcgcagaaggcaggactcgggacaatcttcatcatgacctgctcccctntcctcctcacccttctcattcactgcacagggtcctggcccagtctgtcttgacgcagccgccctcaatgtctcgccgcccaggacagaagtccacctatctcctgactcgtggacgcggcctaccaacgagttaggaaacttattaactggtaacttcggttggttaccacgaccctacccgtaccccgaaggaaacccaccggtacccccctaaaactcccgttaccaacgttctaacgtaaacgtaaaaacttaacctaaacccggacccttacggaacggtacttaccgcgtaaccgtactttcctacgtcggaccttaccgaagttctcggaccacggacctacgacccgaccgtacggtaccacgttccgacccgtccgtacccgaaggacccggttacgggggaaccgtacgggtaccccgttaaatttaccgttaacgtacggaccgggtaaaccaggtacgggtaaacgtaccggtacgaaccgtacgttacggaacgtttcgggttacgggttacgggttaccgggtaccgggtaacgggaacccgtaacggtccgttaaccggttacccgggtaccttaacgggtaccgtacccggtaccgggtaccgtcccgttacccccgg

SEQ ID NO: 94576 - DNA, 706 bp, Homo sapiens
  misc_feature: GYAE6OF02GEIXB.17.9.A09.1.454.CMB.1.raw
  modified_base (276)..(276): a, c, t, g, unknown or other
  misc_feature (276)..(276): n is a, c, g, or t
  modified_base (303)..(303): a, c, t, g, unknown or other
  misc_feature (303)..(303): n is a, c, g, or t
tcagcgtagactagcacgaccggtgctcgatttagcgagacgcgcaggggagctctgcttcagctgtgagcgcagaaggcaggactcgggacaatcttcatcatgacctgctcccctctcctcctcacccttctcattcactgcacagggtcctgggcccagtctgtcttgacgcagccgccctcaatgtctcgccggccccaggacagaaggtcaccatctcctgctcgtggaacgcggctccaactattaggaaataattatgtatcgtgttcngcacctccagacacaccccaaactccncactctatacgaaaataactaacccgaccctacgaacgggtacttacccgtacgtaacccgttatttcccgttacgtcggtaccttacccgtaaacgttccgtacgggacctaaccggacaacccgcccctaacccgtaggaacctaccgtacccgacccggtccctacccggacgtaccggtacgggggaaccgacggtccgtaatttacgttacgtcggaccggtaaacagttacgggactacggccgtacggtcccttaggtacggtttacggggtttggggttacgggttacccggggacggggtaacgggtaacccgaagggtccggttaccggtaacccggttaccggtaacgggtcccggaaccggaccccggtaacgggtccccgtacccccggg

SEQ ID NO: 94577 - DNA, 765 bp, Homo sapiens
  misc_feature: GYAE6OF02IWZBE.17.9.A09.1.454.CMB.1.raw
  modified_base (129)..(129): a, c, t, g, unknown or other
  misc_feature (129)..(129): n is a, c, g, or t
  modified_base (165)..(165): a, c, t, g, unknown or other
  misc_feature (165)..(165): n is a, c, g, or t
  modified_base (235)..(235): a, c, t, g, unknown or other
  misc_feature (235)..(235): n is a, c, g, or t
  modified_base (348)..(348): a, c, t, g, unknown or other
  misc_feature (348)..(348): n is a, c, g, or t
tcagcgtagactagcacgaccggtgctcgatttagcgagacgcgcagggggagctctgcttcagctgtgagcgcagaaggcaggactcgggacaatcttcatcatgacctgctcccctctcctcctccncccttctcattcactgcacgcgggtcctcgggcccngtctgtctggacgcacgcccgccctcaatcgtctcggccggcccaggacaggaacggtccacatcctctnctcgaggacgcgcctaccaactagttaaggtaaattaattacgtcgttaagtccggttggttaccaaggccctacccgtaccgaagaacccgaccacccctaaacctcctaanaccttactaataaacgtaaaaccttaaccgaaaccccgtaccgtacgaacgggttacttacccgtacgtaacccgttacttccgttacgtaccgccgttaacccgaaggttccgtcggaaccgaccgggacctaccggaaccctacccggtacggaaccctccgtacccggaccccgttaccctacgggaacgtaccggggtaacgggacggtaaccgggttactaactttacggttaccgacgggaccggtaaactcggggttaaggacaccggtactaccgggtccggtaacgttcgggtcggggtttagggaccgggtttcggggaccggaaccgggtaacgaccggtacgtccggtaaccggttacggtaacgggtcccggaacgggaccccggtacggtccccgtacccggg

SEQ ID NO: 94578 - DNA, 695 bp, Homo sapiens
  misc_feature: GYAE6OF02G0M7J.17.9.A09.1.454.CMB.1.raw
  modified_base (193)..(193): a, c, t, g, unknown or other
  misc_feature (193)..(193): n is a, c, g, or t
  modified_base (513)..(513): a, c, t, g, unknown or other
  misc_feature (513)..(513): n is a, c, g, or t
tcagcgtagactagcacgaccggtgctcgatttagcgagacgcgcaggggagctctgcttcagctgtgagcgcagaaggcaggactcgggacaatcttcatcatgacctgctcccctctcctcctcacccttctctattcactgcacgtagggtccgtgggccctagtctgtcttgacgcacgcccgccctanaatcgtctcgccggcccaggacacggtacggtccaccatccgtcctgcctcgtaggacgccggcctaccaactacgttaaggtaaaacttaagttactagttacgttcggttcggtacccagtcccaacccgttaccgacggaacctaccgaaccccctaacgtcctacactacttaactaaggtaaaaacttaaccgtaaacccgtacctacggaacggttacgttacctagaccgttacttcgtacgtcgtacctacgtagtccgtacgcgacgccacgaccctaccgagacgtaccgtaccgaccgtcctacggganaccggggtagggacccgcgggaacttacggttactacggtacgtaaccggaactaggtgggtaactaagccggacgtccggttaggtaaccgttggggttcgggtacggttccggggacgttaacgggactacggtcgaccgtacgttcggacgtccgacgtaccggtacgccgttccccgg

SEQ ID NO: 94579 - DNA, 537 bp, Homo sapiens
  misc_feature: GYAE6OF01BYXTQ.11.81.H04.1.454.CMB.1.raw
  modified_base (214)..(214): a, c, t, g, unknown or other
  misc_feature (214)..(214): n is a, c, g, or t
  modified_base (336)..(336): a, c, t, g, unknown or other
  misc_feature (336)..(336): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcggtggtttcgcgtaggctctttaagaggtntcagtgtcaggtgcaactggtggagtctgggggaggcgtggtccagcctggggaggtccctgagactctcctgtgcagcgtctggattcaccttcaggagctatgacatgcacgtgggtccncaggctccaggcgaaggggctggagtggggtgcagttatatggtatgatggtaagttataaatactatggagacgtcgtagaagggccgattccaccatcctcagacgactacgttaccaaagaactacggtagtatctacgactaaagtcgaacaggcctaggacggacggaccggaacggaagaccgggtgtggttacg

SEQ ID NO: 94580 - DNA, 596 bp, Homo sapiens
  misc_feature: GYAE6OF01ENAQW.11.81.H04.1.454.CMB.1.raw
  modified_base (280)..(280): a, c, t, g, unknown or other
  misc_feature (280)..(280): n is a, c, g, or t
tcagcgagagataccacgaccggtgctcgatttagtagtgtagattcgcggggctgcccgtttggctttggagatggttttctcgatgagctctgggagaggagccccagcactagaagtcggcggtgtttccattcggtgatcagcactgaacacagaggactcaccatggagtttgggctgagcttgggttttcctcgttgcttcttttaagaggtgtccagtgtcaggtgcaactggtggagtcgtgggggagcgtggtccagcctgggagttcccngagactctcctgtcgcaggtcgtcgtggatttccgacctttcgaggtagtctatgaactagtcgacaccgttgggtcccgaccaggcctacgaggcgaaggggctgggagtgggtgcagttatagtggtatgataggtaagttaataaatacgtagtggacgtacgtcgtagaacgggtcctatttccaacctatctccgaagacgaactacgttaccaagtaaccgtacggttagtactcgttacgaactaaagtacgtaaacacggtacctaggaacgacggtaccggaaggaccgaccggtcgttggttaacg

SEQ ID NO: 94581 - DNA, 597 bp, Homo sapiens
  misc_feature: GYAE6OF01BSMYA.11.81.H04.1.454.CMB.1.raw
  modified_base (384)..(384): a, c, t, g, unknown or other
  misc_feature (384)..(384): n is a, c, g, or t
tcagcgagagataccacgaccggtgctcgatttagtagtgtagattcgcgggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtcgtggggggaggcgtggtccaggcctggggaggtccctgagactctcctgtgcagcgtctggattcaccttcaggagctatgacatgcacgtgggtccgcaggcctccgaggcaagggggctgggaggtgggtggctagttanagtggtatgtagtagggtaagttataaatactagtggagtacgtccggtaggaacgggccgtattccgactactcgtacccgaagtacgaacctacttacccgaaagtaaccgtacgggtacgttatccgtagacctaaaagtcgaaacgacggtacccgttaggaacggacggtacccggaacggaaccgtaccgggtcgttcggttaacgg

SEQ ID NO: 94582 - DNA, 785 bp, Homo sapiens
  misc_feature: GYAE6OF01EJ60L.11.81.H04.1.454.CMB.1.raw
  modified_base (212)..(212): a, c, t, g, unknown or other
  misc_feature (212)..(212): n is a, c, g, or t
  modified_base (302)..(302): a, c, t, g, unknown or other
  misc_feature (302)..(302): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagagactcaccatggagtttgggctgagcttgggttttcctcgttgcttcttttaagnggtgtccagtgtcaggtgcaacgtgggtggagtcggtgggggagcgtggtccaggcccgtggggacggtccctggagacctctcctggtncaggcgtctgggactttccgacctttcgaagggagtccttaatggaacctagttcggacctaaccggttcgggggtccccacccgtaagggtccctacccggaaggggtccggaaacggggggtcctagggggacggttgggggtcggtacctaaagggtttataggttgggttaatggtaagttagggtaaagtttaaattaaaagttacgtaaggttacgggtaacgtaaccgttacccgggtaagggtaaaccggggtcccgttaactttacccgaaccctacgttaccccgttaaccgaaacgggtaaccgtaacccgttaacccgtttaaccgaaaacggtaaaccgtaccgggttagtaacttaccgtacgtaaaccgtaaaacgttaccggaaaaccgtaccgtccggttaacggaaacggaacccgggtaccccggaaagggtaacccgtacccgggtagttcgggtttaaacgg

SEQ ID NO: 94583 - DNA, 531 bp, Homo sapiens
  misc_feature: GYAE6OF01D32IJ.11.81.H04.1.454.CMB.1.raw
  modified_base (337)..(337): a, c, t, g, unknown or other
  misc_feature (337)..(337): n is a, c, g, or t
  modified_base (492)..(492): a, c, t, g, unknown or other
  misc_feature (492)..(492): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtcgtgggggaggcgtggtccagcctgggaggtccctgagactctcctgtgcagcgtctggattcaccttcaggagctatgacatgcactgggtccncaggctccaggcaaggggctggagtgggtggcagttatagtggtatgatggaagttataaatactagtggagacgtccgtagaacgggccgtattcacctatctaccagacgactaccttaccaagaaccacggtgtatctagacaaagtcgaanacgcctagagacggccgaaggaccgacggtcgtggtacg

SEQ ID NO: 94584 - DNA, 553 bp, Homo sapiens
  misc_feature: GYAE6OF01BWAN5.11.81.H04.1.454.CMB.1.raw
  modified_base (196)..(196): a, c, t, g, unknown or other
  misc_feature (196)..(196): n is a, c, g, or t
  modified_base (485)..(485): a, c, t, g, unknown or other
  misc_feature (485)..(485): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcgtgggttttccncgttgctcttttaagaggtgtccagtgtcaggtgcaacgtggtggagtcgtgggggagcgtggtccagcctgggaggtccctgagactctcctgtgcagcgtctggattcaccttcgaggagctatgacatgcacgtgggtccgcaggcctaccgaggcgaaggggctagggagtggggtgactagttatagtggtatgagtggaattataaatactagtggagtacgtccggtaggaacggccgtattacaccatcgtacaagacgactaccttaccaagacacggtntactactgaaccaaagtcgaacacgtcccgtaggaacgacggccggaacggaccgcggtctggttacg

SEQ ID NO: 94585 - DNA, 563 bp, Homo sapiens
  misc_feature: GYAE6OF01BBUMV.11.81.H04.1.454.CMB.1.raw
  modified_base (317)..(317): a, c, t, g, unknown or other
  misc_feature (317)..(317): n is a, c, g, or t
  modified_base (339)..(339): a, c, t, g, unknown or other
  misc_feature (339)..(339): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtcgtggggggaggcgtggtccagcctggggagtccctgagactctcctgtgcagcgtctggattcaccttcagganctatgacatgcacgtgggtccncgaggctccgaggcaaggggctgggagtgggtgctagttatagtggtatgatggtaagttataaatactagtaggagactccggtagaacgggccgtattcaccatcctaccgagacgaactaccttaccaagaaccgtacggtagtactcgtagacctaaagtcgaaacacggtcctaggaacggacggacccgggaagggaccgaccgggtcgtggttacgg

SEQ ID NO: 94586 - DNA, 900 bp, Homo sapiens
  misc_feature: GYAE6OF01EBK83.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcacatggagttggctgagcttgggttttcctcgttgcttcgttttaagaggtgtccagtgtcgaggtgctaacgtggtggagtcggtgggggagcgtggccaggcccgtggggacgtcccgtaggacgtaccttcgtccgtggtcgcgtaggtccgttcgtggtactttccgtaccttcgaggtacgtcctaagtcgaacagttcgaccgtacggttcgggtaccccgccgaagggtccctacccggaagggtaccggaaacgggggtccgttagggggtacgggttcgggggtcggtacgttaagggtttaattaggttaggggttaagtagggtaaggttaaggggttaaagttttaaagttaaaacgttacgtaaggttacgggtaaacggttaacccgttaccggggtaagggtaaacccggggtacccgttaaacgttttacccccgaaaccgttaccgttaccccgtaacccggaaacgggtaacccgtaaaccccgttaaaccccggttttaacccggaaaaacggttaaaccccgggttaacggggttttaccggttaaaccgttaccccgttaaaggtaaaaaccccgttaaaaagggttacccggaaaaacccggtaccggttaaccccgggttaaaggggaaacccgggaaacccggggtaaacccccggggtaaaacggggtaaccccgtaacgggggttttcccttaagggggtttttaacccgg

SEQ ID NO: 94587 - DNA, 543 bp, Homo sapiens
  misc_feature: GYAE6OF01B44JT.11.81.H04.1.454.CMB.1.raw
  modified_base (317)..(317): a, c, t, g, unknown or other
  misc_feature (317)..(317): n is a, c, g, or t
  modified_base (339)..(339): a, c, t, g, unknown or other
  misc_feature (339)..(339): n is a, c, g, or t
  modified_base (538)..(538): a, c, t, g, unknown or other
  misc_feature (538)..(538): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtcgtggggggagcgtggtccagccgtgggaggtccctgagactctcctgtgcagcgtctggattcaccttcagganctatgacatgcacgtgggtccncaggcctcgaggcgaaggggctgggagtgggtgctagttatagtggtatgagtaggaagttaataaatacgtagtggagtacgtccggtagaacgggccgtattacaccatcctaccgagacgacctaaccttaccaagaacctacggtgtatctagacaaagtcgaacaggccaggagacgccggaaggaccacggtntgtag

SEQ ID NO: 94588 - DNA, 758 bp, Homo sapiens
  misc_feature: GYAE6OF01DEKQW.11.81.H04.1.454.CMB.1.raw
tcagcgagagataccacgaccggtgctcgatttagtagtgtagattcgcgggctgccctttggctttggagatggttttctcgatgagctctgggagaggagcccagcactagaagtcggcggtgtttccattcggtgatcagcactgaacacagaggactcaccatggagtttgggctgagtcgttgggttttcctcgttgtcttcttttaagaggttgtccagtgtcaggtgcaagtggtggagtcgtgggggagcggtggtccagccgtgggacggtccctgacgtactctccgtgtcgcagcgtcgtggacttcaccttcgaggagtctatgacatcgcacgttcgggtcccgaccgagggcctacccgaggaccgaacggggtctagggaggttggggtggacgtaaggtttagtaggttaggtagtggtagttaagggtaaagtttaagtaaaagttaacgttaaggtacgggtaacgtaccgttaccgggtagggaaacgggtcccgtaacgtttacccgaacccgtacgttacccgttacccgaaaggtaaccgtaaacccgtaacccgttttaaacccgaaaacggttaacccggtaaccggggttacgttaaccgttaccgtaaacggtaaaccctaaaaaggttaccggaaaaccctacgggtaaccccgttaagggaaaccggtaaccggggtaaccccggaaacgggtaacccggtacccggggttgttacggggttttaaacgg

SEQ ID NO: 94589 - DNA, 664 bp, Homo sapiens
  misc_feature: GYAE6OF01BIR9G.11.81.H04.1.454.CMB.1.raw
  modified_base (195)..(195): a, c, t, g, unknown or other
  misc_feature (195)..(195): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcgtggttttccncgttagctctttaagaggtgtccagtgtcaggtgcaactggtggagtcgtggggggaggcgtggtccaggcctggggaggtccctgagactctcctgtgcagcgtctggattcgaccttcgaggagctaatgacagtgacctacggtcgggtccgcccgtagggcctaccggaagggccgaaaggggggtccgttaggggacgggtgggggttcggacgtaagggtttaataggttgggtaataggtagttagggtaaaggtttaataaaagttacgtagtaggaacgtaccgtccggttagggaacgggtccctaagtttccgaaccctaagtccgtaccgagaaccgaactaccgttaccaaacggtaaccgtacggttagtaactccgtagaaccgtaaaagtccggaaacacggtccgtagggaacgacggtacccggaaggaaccgcgggtacgttggttaacg

SEQ ID NO: 94590 - DNA, 611 bp, Homo sapiens
  misc_feature: GYAE6OF01EHG3M.11.81.H04.1.454.CMB.1.raw
  modified_base (321)..(321): a, c, t, g, unknown or other
  misc_feature (321)..(321): n is a, c, g, or t
  modified_base (344)..(344): a, c, t, g, unknown or other
  misc_feature (344)..(344): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggtggagtcgtgggggaggcgtggtccagccgtggggagtccctgagactctcctgtcgcagcgtctggacttcaccttgagganctatgacatgcacgtcgggtccncaggctccgaggcgaaggggctaggggaggtggggtcggactagttatagtggtatgagtaggtaagtttaataaatacgtagtgggactacgtccggtaggaacgggcctagtccacctactctaccgaagaacgtacctacgttaccgaaagtaaccgtacggtacgtaatccgtacgtaacgaaagtccgaaacgacggtacccgtagggaacggaacccggaacccgggaacgggtaaccgaccggggttcgtaggttaacgg

SEQ ID NO: 94591 - DNA, 769 bp, Homo sapiens
  misc_feature: GYAE6OF01CAPRA.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactgggtggaggtcgtggggggaggcggtggtccagcctggggaggtccctgagactctcctgtgcagcgtctggattcaccttcaggagctatgacatcgcacgtgggtccgccaggcctaccgaggcgaaggggctgggaggtggggtcggctaaggtttataggtggtaatgggaagttaggggtaaagtttaaataaaattaacgttaagtaggggaacgtaacccgttacccggggtaagggtaaaccgggggtccctaaacgtttccccgaaacccttaacgttacccgttaaccccgaaagggtaaccggtaaaacccgtaacccgtttaacccccgaaaaacgggtaaaccccgtaacggggtttacggtttaaacgttaccccgtttaaaggaaacctaaaaaacggtttcgggaaaaacccgtacccgggtaacccccggttaaggggaaacgggtacccggggtaaaccccgggaaacggggaaaccccggaaacggggttccccgtttaaggggttttaaaccgg

SEQ ID NO: 94592 - DNA, 546 bp, Homo sapiens
  misc_feature: GYAE6OF01CDUIX.11.81.H04.1.454.CMB.1.raw
  modified_base (156)..(156): a, c, t, g, unknown or other
  misc_feature (156)..(156): n is a, c, g, or t
  modified_base (476)..(476): a, c, t, g, unknown or other
  misc_feature (476)..(476): n is a, c, g, or t
tcagcgagagataccacgaccggtgctcgatttagtagtgtagattcgcggggctgggagaggagcccagcactagaagtcggcggtgtttccattcggtgatcagcactgaacacagaggactcaccatggagtttgggctgagcgtggtttccncgttagctctttaagagcaggtgtccagtgtcaggtgcaactggtggagtctgggtgaggcgtggtccagcctggggagtccctgagactctcctgtgcagcgtctggattcaccttcaggagctatgacatgcactgggtccgccaggctccaggcaaggggctgggagtgggtgcagttatgtggtatggattaggaaagttataaaattacgtagtagggaagtaccgttccggtaggaacgggccgtaattccgacctagtcctaccgagacgacacttaccgaagtaaccgagtgtatcgtagactaaatgaacncgctagagacgccggaggaccacggcgtgtagtattcgtgtggacggaagggaacaggcaggcgtacggg

SEQ ID NO: 94593 - DNA, 607 bp, Homo sapiens
  misc_feature: GYAE6OF01BFNVV.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggtggagtcgtgggggagcgtggtccagcctgggagtccctgagactctcctgtgcagcgtctggacttcaccttcgaggacgctatgacagtcgcctacgtcgggtcccgcgacgggcctacccgaggcgaaggggtctagggaggtgggtcggactagttatagtggtatgagtaggtaagttaataaatacgtagtagggacgtactccggtaggaacgggtcctattaccgacctacgtcctaccgaagtacgaacctacgttaccgaaagtaaccgacggttatacgtacgtacgaactaaacgtcgaaactacggtacccgtaggaacgacggacccggaaggaacccgacgggtcgtggttaacg

SEQ ID NO: 94594 - DNA, 539 bp, Homo sapiens
  misc_feature: GYAE6OF01DWY16.11.81.H04.1.454.CMB.1.raw
  modified_base (480)..(480): a, c, t, g, unknown or other
  misc_feature (480)..(480): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggtggagtcgtgggggaggcgtggtccagcctggggaggtccctgagactctcctgtgcagcgtctggattcaccttcaggagctatgacatgcacgtgggtccgcaggctccgaggcaaggggctggaggtgggtgctagttatatggtatgatggaagttaataaatactagtaggagactcgtaggaagggtccattcaccatcaccgagacgactaccttacaagaacacggtagtatcgngaacaaagtcgaaacacgtccgtagacgacggacccggaaggacgacggtcgtggtacg

SEQ ID NO: 94595 - DNA, 579 bp, Homo sapiens
  misc_feature: GYAE6OF01ADIEN.11.81.H04.1.454.CMB.1.raw
  modified_base (230)..(230): a, c, t, g, unknown or other
  misc_feature (230)..(230): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcagggtncaacgtggtggagtcgtggggggaggcgtggtccagccgtgggaggtccctgagactctcctgtgcagcgtctggattccaccttcaggagctatgacatgcacgtcgggtccgccaggctcccgaggcgaaggggctgggaggtgggtggctagttatagtggtatgagtaggtaagttataaatactagtggaacgacgtcggtaggaacgggccgtacttaccgactatcctccgaagacgaacctacttaccaacgtaacctacgggtatactcgtagaactaaagtacgaacacgccgtaggaacggaacggacccggaaggaaccgacgggtgttggttacgg

SEQ ID NO: 94596 - DNA, 591 bp, Homo sapiens
  misc_feature: GYAE6OF01CSEUS.11.81.H04.1.454.CMB.1.raw
  modified_base (341)..(341): a, c, t, g, unknown or other
  misc_feature (341)..(341): n is a, c, g, or t
  modified_base (381)..(381): a, c, t, g, unknown or other
  misc_feature (381)..(381): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggtggagtcgtgggggagcgtggtccagcctgggaggtccctgagactctcctgtgcagcgtctggattccaccttcgaggagctatgacatgcacgtgggtcccncaggctccgaggcaaggggctgggagtgggtgctagttanagtggtatgagtaggaattataaatacgtagtggagtacgtccggtaggaacgggtcctatttccgaacctactcctaccgagaacgtaacctaccttaccgaaagtaaccgtacggttacgtacttcgtagacctaaaagtacggaaacgacggtcccgtaggaacggacggacccggaacggaccgaaccgggtcgttaggttaacgg

SEQ ID NO: 94597 - DNA, 532 bp, Homo sapiens
  misc_feature: GYAE6OF01ARMV9.11.81.H04.1.454.CMB.1.raw
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (525)..(525): a, c, t, g, unknown or other
  misc_feature (525)..(525): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtcgtggggggaggcgtggtccagcctggggaggtccctgagactctcctgtgcagcgtctggattcaccttnagganctatgacatgcacgtgggtccgccgaggcctccgaggcaagggggctgggagtgggtggctaggttatagtggtatgagtggaagttataaatactagtggagactccgtaggaagggcgattcacatctccagacgacacttaccaagaacacggtatatctgacaaagtgaacacgcctaggacgacgaccggaggaccgacggntggtacg

SEQ ID NO: 94598 - DNA, 862 bp, Homo sapiens
  misc_feature: GYAE6OF01DHJ5T.11.81.H04.1.454.CMB.1.raw
  modified_base (215)..(215): a, c, t, g, unknown or other
  misc_feature (215)..(215): n is a, c, g, or t
tcagcgagagataccacgaccggtgctcgatttagtagtgtagattcgcgggctgccctttggctttggagatggttttctcgatgagctctgggagaggagcccagcactagaagtcggcggtgtttccattcggtgatcagcactgaacacagaggactcacagtggagtttggctgagtcgttgggtttcctcgttgtcttcgttttaaggnggtgtccagtgtcgaggtgactaacgtgggtggaggttcggtggggggacggtcggtggtccgaggcccgtggggacggtccctggacgactctcctggtgcgaggtccgttcgtggtaactttccgacccgtttcgaagggtagtccttaagtggaacctgttacggaccgtaaccggttcgggggtaccccgacccgaacgggtcccgttacccggaacgggtaccgggtaaaggggggtccttagggggtaacgggtttcggggggtacggtaccgttaagggttttaacgtaggtttaggggttaagttagggtaaaggttagggttaaaacggtttaaatttaaaaacgttaccgttaaggtacgggtaaacggtaacccgtttccgggtaaagggtaaaccggggtacccgttaacgtttacccgaaccgtacgttaacccgttacccgaaaggtaacccgtaacccttaacccgtttaaacccgaaaacgggtaaccgttacggggttacgtttacgtacccggttaacgtaaaccgtaaaagttaccggaaaacgtacggtacccgttaacgggaacggaacccgggtaacccgggtaaacgggaacccggtacccgggtgtttacggggtttaaacgg

SEQ ID NO: 94599 - DNA, 603 bp, Homo sapiens
  misc_feature: GYAE6OF01EKIS3.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggtggagtcgtgggggagcgtggtccagcctgggaggtccctgacgactctcctgtgcagcgtctggattcaccttcaggagctatgacatcgcacgtcgggtccgccaggcctcgaggcgaaggggctgggagtgggtggctagttatagtggtatgtagtaggtaagttaataaatactaagtgggtacgacgtcggtaggaacgggaccgtattccacctatccgtaccaagacgacctaaccgtttaccaaacgtaaccgaccggttagtaacttacctagacctaaaagtacggaaacctacggccctaagggaacggaacggtacccgggaaacgggaaccgtaaccgggtcgtggttacgg

SEQ ID NO: 94600 - DNA, 578 bp, Homo sapiens
  misc_feature: GYAE6OF01A9N7G.11.81.H04.1.454.CMB.1.raw
  modified_base (339)..(339): a, c, t, g, unknown or other
  misc_feature (339)..(339): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggtggagtctgggggaggcgtggtccaggcctgggaggtccctgagactctcctgtgcagcgtctggattcaccttgaggagctatgacatgcacgtgggtccncaggctccgaggcaaggggctgggagtgggtcgctagttatagtggtatgatagggtaagttataaagtactagtggaagtactacgtggaacgggccgtaattcactaatcctaccgaagacgacctacttaccgaaagaaccgtacggtacgttactacgttacggacctaaaagtcgtaaacgaggtacccttaggacgaacggtaccggaacggaacgacggtacgttggtaacg

SEQ ID NO: 94601 - DNA, 699 bp, Homo sapiens
  misc_feature: GYAE6OF01EWR7E.11.81.H04.1.454.CMB.1.raw
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
tcagcgagagataccacgaccggtgctcgatttagtagtgtagattcgcggggctgccctttggctttggagatggtttttctcgatgagctctgggagaggagcccagcactagaagtcggcggtgtttccattcggtgatcagcactgaacacagaggactcaccatggagtttgggctgagcgtgttcgcgtagctcttaagaggtntcagtgtcaggtgcaacgtggtggagtcgtgggggagtcgtggtccagcccgttggggaggtccctgacgactctcctgcgcagtcgtncggnttcaccttgaggatctatggactatcgacgtacgtcgggccgcgacggctccgaggaccgaagggtcgtaggaggtgggtggactagttagtacgttagggtataggtagttaagggtaacgtttaataaacgtacgttaagtaggacgtaaccgttcgggtaagaccgggtacctacgtttacccgaacccgtattaccgttacccgaaggtaacccgtaaccgttaaccctttaacccgggaaaataaccgggtttaacccggttagttaacggttaaccccttaaacggaacctaaaacggttccgtaaaaccggaccgttcccgtaaagggtaacccgaacgggttacccggggaacggaaacccggttaccggtagttaaccggttaaagg

SEQ ID NO: 94602 - DNA, 527 bp, Homo sapiens
  misc_feature: GYAE6OF01C3J9Y.11.81.H04.1.454.CMB.1.raw
  modified_base (316)..(316): a, c, t, g, unknown or other
  misc_feature (316)..(316): n is a, c, g, or t
  modified_base (339)..(339): a, c, t, g, unknown or other
  misc_feature (339)..(339): n is a, c, g, or t
  modified_base (382)..(382): a, c, t, g, unknown or other
  misc_feature (382)..(382): n is a, c, g, or t
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
  modified_base (491)..(491): a, c, t, g, unknown or other
  misc_feature (491)..(491): n is a, c, g, or t
  modified_base (520)..(520): a, c, t, g, unknown or other
  misc_feature (520)..(520): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtcgtgggggaggcgtggtccagccctgggaggtccctgagactctcctgtgcagcgtctggattcaccttcaggngctatgacatgcacgtgggtccncgaggctccgaggcaaggggctgggagtggggtgctagtttanagtggtatgataggaagttaataaatactagtaggagtactcggtaggaacggcgtattcacatctacagatactactacaagaacaggtntatcngacaaagtgaacngtcctagagacgaccgaaggacgacggtntggtacg

SEQ ID NO: 94603 - DNA, 569 bp, Homo sapiens
  misc_feature: GYAE6OF01A83PY.11.81.H04.1.454.CMB.1.raw
  modified_base (325)..(325): a, c, t, g, unknown or other
  misc_feature (325)..(325): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtcgtgggggaggcgtggtccagcctgggaggtccctgagactctcctgtgcagcgtctggacttcaccttcaggagctatgacngtgcacgtcgggtccgccgaggtctccgaggccaaggggctgggagtgggtgctaggttatagtggtatgataggtaagttaactaaatactagtaggagacgtccggtggaagggccgtaattacaccatctccaagacgaccacttaccgtaaagaacctacggtacgtatcgtagacctaaagtcgaactacggccgtaggaacgacggtcccggaaggacccgacggtcgttggttaacg

SEQ ID NO: 94604 - DNA, 558 bp, Homo sapiens
  misc_feature: GYAE6OF01CJ6N8.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtcgtggggggaggcgtggtccagcctggggaggtccctgagactctcctgtgcagcgtctggattcaccttcaggagctatgacatcgcacgtcgggtccgccaggcctccgagggcaaggggctgggagtgggtgcagttatgtggtatgatggaagttataaatactatggagactcggtagaacgggtcgattccacatctacgagagactacttaccgaacgtaacgacggtagtactcgtacgacaaagtcgaaacgcggtaccgttacgaaggtacggacccgggaggaaccgaaccgggctgggtttacg

SEQ ID NO: 94605 - DNA, 587 bp, Homo sapiens
  misc_feature: GYAE6OF01BSE6T.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtcgtggggggaggcgtggtccagccgtgggaggtccctgagactcctcctgtcgcagcgtcgtggactttcacccttgaggagctatgacatgcacgtcgggtccgccagggcctccgaggcgaaggggctagggagtgggtggctagttatgtggtatgagtaggtaagtttaataaatacgtagtaggacgtacgtccggtaggaacgggtccgtattccacctacgtctaccgaagacgtacctaccttaccgaaagtaaccgtacggttagtactctacgaactaaagtcgaacacggccgttagaacgacggacccggaggaaccgacggtcgttggtacg

SEQ ID NO: 94606 - DNA, 715 bp, Homo sapiens
  misc_feature: GYAE6OF01CNHWQ.11.81.H04.1.454.CMB.1.raw
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
tcagcgagagataccacgaccggtgctcgatttagtagtgtagattcgcgggggctgccctttggctttggagatggttttctcgatgagcgtctgggacgaggacgcccagcactacgagtcggcgtgtttccattcggtgatcagcactgaacacagagactcaccagtggacgtttgggctgagtcgttcgggttttccncgttgcttcgtttaaggnggtctccagtgtcgaggtgaccaagtggtaggaagtcggtgggggacgtcgtcggtccaggtccgtaggggacgtccctaggacgtcctcgtcctggtcgcctagccgtacgtggtactttccaaccgttgaacggcgtacctatcggaactgtacggtccgtaccggttcgggtcccgacgtaaccgggccctacggacgggacccggaaaggggtcctaggggtacggtcggggtacgtacgtagtttagtaggtggtacgtggtaagtaggtaaagttaataaagtcgtaagtacggacgtacgttacggtaaggtacgggtaccctagttacccaacgttacgtaccgtaccggaagtaaccggtaaccttaaccggttaacgaaaacggtaccgtacgggttataacgtcgtaacgtaactaacggtacgtaacacggtacgtacggacggtaacccgacggaaccggtagtaccggtgtagttaccgg

SEQ ID NO: 94607 - DNA, 607 bp, Homo sapiens
  misc_feature: GYAE6OF01C2U4S.11.81.H04.1.454.CMB.1.raw
  modified_base (315)..(315): a, c, t, g, unknown or other
  misc_feature (315)..(315): n is a, c, g, or t
  modified_base (337)..(337): a, c, t, g, unknown or other
  misc_feature (337)..(337): n is a, c, g, or t
  modified_base (379)..(379): a, c, t, g, unknown or other
  misc_feature (379)..(379): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtcgtgggggagcgtggtccagcctgggacggtccctgagactctcctgtgcagcgtctggatcaccttcgaggnctatgacatgcacgtgggtccnccaggctccgaggcgaaggggctgggagtgggtgctagttanagtggtatgagtaggtaagttaataaatactagtgggataccgtcggtaggaacgggccgtattaccactactctaccgagtaacgacctaccgttaccaaagtaaccgtaggtacgttaactaccgttacgaacctaaaagtacggaaacctaacggtacccttaggaacggaaccgggtacccgggaaacgggacccgaaaccggggtccgtttaagggttaacgg

SEQ ID NO: 94608 - DNA, 655 bp, Homo sapiens
  misc_feature: GYAE6OF01BUB6U.11.81.H04.1.454.CMB.1.raw
  modified_base (229)..(229): a, c, t, g, unknown or other
  misc_feature (229)..(229): n is a, c, g, or t
  modified_base (322)..(322): a, c, t, g, unknown or other
  misc_feature (322)..(322): n is a, c, g, or t
  modified_base (349)..(349): a, c, t, g, unknown or other
  misc_feature (349)..(349): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtncaactggtggagtcgtgggggagcgtggtccagccgtggggacggtccctggagactctccgtgtgcagcgtctggacttcacctttcgaggngctatgacagtgccacgtcgggtcccncaggcctccgagggcgaaggggctagggaggtggggtgacgtagtttatagtggtatggagtaggtaagtttaataaaagtactaagtagggtaagtacccgttacggtacggaacggggtccctaagttacccgtaacctacttccgttacccgaaaggtaaccggtaacctaacccgtttacccgaaacggtaaacgtaccgggttacgttacttaccgtacgaaacgtaaaagtccgaaacgtacgggaccccgtaagacgggaacgtaccgggacggaaccgaccgggttcgtaggtttacg

SEQ ID NO: 94609 - DNA, 663 bp, Homo sapiens
  misc_feature: GYAE6OF01DDMF8.11.81.H04.1.454.CMB.1.raw
  modified_base (194)..(194): a, c, t, g, unknown or other
  misc_feature (194)..(194): n is a, c, g, or t
  modified_base (211)..(211): a, c, t, g, unknown or other
  misc_feature (211)..(211): n is a, c, g, or t
  modified_base (350)..(350): a, c, t, g, unknown or other
  misc_feature (350)..(350): n is a, c, g, or t
tcagcgagagataccacgaccggtgctcgatttagtagtgtagattcgcgggctgccctttggctttggagatggttttctcgatgagctctgggagaggagcccagcactagaagtcggcggtgtttccattcggtgatcagcactgaacacagaggactcaccatggagtttgggctgagctgggttttccncgttgcttcttttaagnggtgtccagtgtcaggtgcaacgtggtggagtcgtgggggagcgtggtccagccgtgggacggtccctgacgctctcctgtgcagtcgtctggacttccgaccttcgaggagtctatgacatgcctacgtcgggtcccncgaggcctaccgaggcgaaggggctgggaggtgggtgctagttatagtggtatgataggtaagttataaattacgtaagtggtaagtaccgtccggtaggaaacgggtcccgtaattcccgaacctacgttcctaccgaacggtacgtaaccctaaccgttaacccgaaagtaaacccgtacgggttaagttaacgtaccgtacggtaaactaaaacgttacggaaaaccgtaccgggtaccccttagggaaaccggtaccggtaacccggggaaacggtaccgtaacccggggtcgttaagggtttaccggg

SEQ ID NO: 94610 - DNA, 787 bp, Homo sapiens
  misc_feature: GYAE6OF01D6XHR.11.81.H04.1.454.CMB.1.raw
  modified_base (216)..(216): a, c, t, g, unknown or other
  misc_feature (216)..(216): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccagtggagtttgggctgagtcttgggttttcctcgttgcttacttttaagnggtgtccagtgtcgaggtgactaacgtggtggagtcggtggggggagcgtggtccaggccgtgggacggtccctggacgtacctccgtcgtgcgcgtagtcgtcgtggtaccttcctaccgttacgaggtacgtcttaagtacgacgtagttacggccgtaaccgggtccgggtaccccgaccggtaccgggtacccgtaacccgggaacgggaaccgggtaacggggtcggttacgggggtaagggtttcgggggtacggtaacgttagggtttaagttagggttagggttagtagggtaaggttaagggttaaactttaaagtaaacgttacgttagggtaacgggtaacgtacccgggttacgggtaaccgggtaaccggtacccttaacgtacccgtaacctacgtaacccgtaaccggtaaagaccccgtaaaccgttaaccccttaaaaccggaaacggttaacccggtagggttaactaccgttactaaccggaaacctaaacggtccgaaacgtccgtacggaggaacgtaccggacggaacggtacgcggttgtagttaacg

SEQ ID NO: 94611 - DNA, 649 bp, Homo sapiens
  misc_feature: GYAE6OF01CFXYZ.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtcgtgggggaggcgtggtccagcctgggaggtccctgagactctcctgtgcagcgtctggattcaccttcaggagctatgacatgcacgtgggtccgcaggctccaggcaaggggctggagtgggtgcgtagttatagtgggtatggagtagggtaaagtttaataaaattactaagtgggaagtaccgtccggttaggaacggggtacccgtaagtttccaacccgtattcctacccgaaggtaacgtaaccgtaccctttaacccgaaacgtaaccgtaaccgggttaggtaaacgttaccgttacgaaccgtaaaagttacggaaaacctaacgggccccgttaagggaacggaacggacccgggaaacgggacccggtaaccggggtccgttagggttaaccgg

SEQ ID NO: 94612 - DNA, 817 bp, Homo sapiens
  misc_feature: GYAE6OF01BGBJF.11.81.H04.1.454.CMB.1.raw
  modified_base (350)..(350): a, c, t, g, unknown or other
  misc_feature (350)..(350): n is a, c, g, or t
tcagcgagagataccacgaccggtgctcgatttagtagtgtagattcgcgggggctgccctttggactttggagatcggttttctcgatgagctctgggagaggagcccagcactagagtcggcggtgttccgattcggtgatcagcactgaacacagaggactcaccatcggagtttgggctgagtcgttgggttttcctcggttgcttacgttttaaaggaggtagtaccaggttggtccagggttgcaacgtgggtggtacgtcgtggggggaggcgtggtccaggcctggggacgttcccctagacgtaccttctcctgtgcagcgtctggattcgaccttgaggnctagtgaacattcgcgtacggttcggggcccacgtagggccttacccgaagggaccgtaaaggggggtcctaggggtaacgggttcgggggtacggtaccgtaaaggttttaactaaggttacggggttaagtagggtaaaggttacggggtaaacgttttaaacgttaaaaacgtttaacgttaaggttacggggtaaaccgttaacccggttaccgggggttaaggggaaacccggggttacccgtaacgtttaccccgaacccgttacgttacccgttaacccggtaaggtaaccggtaacccttaaacccggtttaacccgaaaacgggtaacccgttacgggttagttaacgttccgttacggaaacgtaaaagttccggtaaacgtaacgggtcccgttaaggaacggaaccggtaccggtaaacgggttacccgtacgggtaccgtttgggttaaaccgg

SEQ ID NO: 94613 - DNA, 630 bp, Homo sapiens
  misc_feature: GYAE6OF01C810H.11.81.H04.1.454.CMB.1.raw
  modified_base (192)..(192): a, c, t, g, unknown or other
  misc_feature (192)..(192): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (306)..(306): a, c, t, g, unknown or other
  misc_feature (306)..(306): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (576)..(576): a, c, t, g, unknown or other
  misc_feature (576)..(576): n is a, c, g, or t
tcagcgagagataccacgaccggtgctcgatttagtagtgtagattcgcgggctgccctttggctttggagatggttttctcgatgagctctgggagaggagcccagcactagaagtcggcggtgtttccattcggtgatcagcactgaacacagaggactcaccatggagtttgggctgagcgtggtttcncgttgctctttaagnggtntcagtgtcaggtgcatggtggagtcgtgggggagcgtggtccaggccgtgggacgtccctggacgtctctcctggtcgcagcgtctggacttccncttcgaggtanctagngaacagtcgacgacgtcgggtccaccgaggcctaccgaggcgaaggggctgggacggtgggtcgacgtagttatagtagtagtgtagtaggtaattaataaacgttacgtagtaggacgtaccgtcggtacgggaaacgggtcccgtaagtttccgaacctacgtacccgtaccgtaacgacgtaaccgttaaccgttaaccgaaacgtaaccgtacgggttagtacctagttacgaacttaaagtacggtaanaccggtcgtaacggcggtaacggaccggaacggaccgtacggtcgtgttaacgg

SEQ ID NO: 94614 - DNA, 723 bp, Homo sapiens
  misc_feature: GYAE6OF01BLHUA.11.81.H04.1.454.CMB.1.raw
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
  modified_base (331)..(331): a, c, t, g, unknown or other
  misc_feature (331)..(331): n is a, c, g, or t
  modified_base (715)..(715): a, c, t, g, unknown or other
  misc_feature (715)..(715): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttggctgagcttgggttttcatcgttgcttctttaagnggtgtcagtgtcaggtncgaactggtggagtcgtgggggagcgtggtccagccgtggggacgtccctgacgtactctcgtgtcgcaggcgttcgtggtacttccaccctttgagggtacncctaagtcgaacctagtgtccgtacgttcggggaccccgccgaacgggtcctacccggaagggacccggtaaaggggggtccttaaggggggtacggttgggggttacggacgttaaggtttagtacggttagggtaataggtaacgttaggtaaacgtttaaataaagttaccgtagttacgggaacgtaccgtttaccggtaaggtaacgggtcccgtaaatttcccgaaacctgtacccgtacgaacggtaacgtaaccctaccgttaaccgaaggtaacccgtacgggttagtacgttaccggtagtaaccgtaaagttcggaaaccttcggaccgttaagggaaccgtacgggaacccggtagggaaccgtaccgggtntttacggg

SEQ ID NO: 94615 - DNA, 653 bp, Homo sapiens
  misc_feature: GYAE6OF01CB4YK.11.81.H04.1.454.CMB.1.raw
  modified_base (194)..(194): a, c, t, g, unknown or other
  misc_feature (194)..(194): n is a, c, g, or t
  modified_base (211)..(211): a, c, t, g, unknown or other
  misc_feature (211)..(211): n is a, c, g, or t
tcagcgagagataccacgaccggtgctcgatttagtagtgtagattcgcgggctgccctttggctttggagatggttttctcgatgagctctgggagaggagcccagcactagaagtcggcggtgtttccattcggtgatcagcactgaacacagagactcaccatggagtttgggctgagcttgggttttccncgttgcttcgtttaagnggtgtccagtgtcaggtgacaacgtggtggagtcgtggggggagtcgtggtccaggccgtgggacgtccctagacgtacctctcctgtcgcaggtcgtctggactttccgaccttcgaggacgtctaagtgacagtgctacgtgggtcccgccgaggcctaccggaggccgaaggggctagggaggtgggtgctagttatagtggtatagtagtaggtaattaataaatacgtagtaggagtacgtcggtaggaacgggtacctagttaccaactacgtaccgtaccgaagtacgtaaccctaccgttaaccgaaacggtaacccgtacgggttacgttacgttaccgtacgtaacctaaaacgttacgaaacgtaaccggtcccgtaaggaacggaccggtaaccggaacgggaaccgtacgggtccgttaggttaaacgg

SEQ ID NO: 94616 - DNA, 618 bp, Homo sapiens
  misc_feature: GYAE6OF01CPOG0.11.81.H04.1.454.CMB.1.raw
  modified_base (195)..(195): a, c, t, g, unknown or other
  misc_feature (195)..(195): n is a, c, g, or t
  modified_base (315)..(315): a, c, t, g, unknown or other
  misc_feature (315)..(315): n is a, c, g, or t
  modified_base (340)..(340): a, c, t, g, unknown or other
  misc_feature (340)..(340): n is a, c, g, or t
  modified_base (382)..(382): a, c, t, g, unknown or other
  misc_feature (382)..(382): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttccncgttgctcttttaagaggtgtccagtgtcaggtgcaactggtggagtcgtggggggagcgtggtccagcctggggagtccctgagactctcctgtgcagcgtctggattcaccttcaggngctatgacatgccacgtgggtcccncaggcctccgaggcgaaggggctgggagtgggtgctagttanagtggtatgatagggtaattaataaatacgtaagtaggagtactccggtaggaacgggccgtattccgacctatctacccgagaacgaacctacttacccgaaaggtaaccctagggttacgtaacttccgtaggtacctaaaaagttcggaaaacctacggtaccccgttaagggaaacggtaaccggacccgggaaaacgggtacccgaaccggggtccgtttaggttaacggg

SEQ ID NO: 94617 - DNA, 520 bp, Homo sapiens
  misc_feature: GYAE6OF01DTCRL.11.81.H04.1.454.CMB.1.raw
  modified_base (310)..(310): a, c, t, g, unknown or other
  misc_feature (310)..(310): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
  modified_base (400)..(400): a, c, t, g, unknown or other
  misc_feature (400)..(400): n is a, c, g, or t
  modified_base (477)..(477): a, c, t, g, unknown or other
  misc_feature (477)..(477): n is a, c, g, or t
tcagcgagagataccacgaccggtgctcgatttagtagtgtagattcgcgggctgccctttggctttggagatggttttctcgatgagctctgggagaggagcccagcactagaagtcggcggtgtttccattcggtgatcagcactgaacacagaggactcaccatggagtttggctgagctgggttttcctcgttgctcttttaagaggtgtccagtgtcaggtgcaactggtggagtcgtgggggagcgtggtccagcctggggaggtccctgagtactctcctgtgcagcgtctggattcaccttnaggagctatgacatgcactgggtccncnggctcgagcgaagggctggagtggtgctagttatgtgtatgataggaagttataaatctagnggatctcgtagacggcattcacatctcagcgacacttaccaagtacctaggtatactcgtagaacaaagtcgaaacnggtcctaggacgacggtaccgaaggaccgcggtcgtggttacg

SEQ ID NO: 94618 - DNA, 621 bp, Homo sapiens
  misc_feature: GYAE6OF01CRO6A.11.81.H04.1.454.CMB.1.raw
  modified_base (442)..(442): a, c, t, g, unknown or other
  misc_feature (442)..(442): n is a, c, g, or t
tcagcgagagataccacgaccggtgctcgatttagtagtgtagattcgcggggctgccctttggctttggagatggttttctcgatgagctctgggagagagcccagcactagaagtcggcggtgtttccattcggtgatcagcactgaacacagaggactcaccatggagttgggctgagtcttgggttttcctcgttgcttcttttaagaggttgtccagtgtcaggtgctaacgtggtggagtcgtggggggagcggtggtccagcccgtggggacggtccctggacgactctccgtgtgcagcgtctggattccaccttcaggacgctatgacatcgactacgtggtccgccaggctcgaggcgaagggtctgggtaggtgggtagcgtagttatagtggtagtagagttaggtaagttaataaatacgtagtagganacgtacgtagaacgggaccgtagttccacgtactcgaccgaacgacgaactaccttaaccgaaacgtaaccgtacggtagttaacgtcgtaacgtacaaaagttacgaaacgtacggacccgtaagaaccgggtaacggacccggaaacgggaccgtaaccgggtcgttggttaaacgg

SEQ ID NO: 94619 - DNA, 767 bp, Homo sapiens
  misc_feature: GYAE6OF01CAZU1.11.81.H04.1.454.CMB.1.raw
  modified_base (361)..(361): a, c, t, g, unknown or other
  misc_feature (361)..(361): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcaacgtggtggagtcgtgggggagcgtggtccagccgtgggacggtccctgagactctcctgtgcagtcgtcgtggtattccaccttcgaggtagtctaatgactagttcgcctacgtcggggtacccnccgaagggtcctaccggaggccgaaagggggcctaggggaaggttggggtcggacttaaggtttagtaggttagggttaagtagggtagttagggtaaagttttaaataaaagtttaaccgttaaggtagggtaacgtaccgttaccgggttaaggaaaccggggttccccgtaagttttaccccgaaccgttaacgtttaccccgtacccgtaaacggtaaccgtaaaccccgttaaccgtttaaccccgaaaacggttaaacccggtaaccgggtttaagttaccgttaccgtaaggtaaacccgtaaaacgttaccggaaaccctaacggtcccgttaaggaaacgggaccggtaaccccgggaacgggtaaccccgtacgggtaccgttagggtttaaccgg

SEQ ID NO: 94620 - DNA, 610 bp, Homo sapiens
  misc_feature: GYAE6OF01BDL02.11.81.H04.1.454.CMB.1.raw
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcggtgttcgctagctcttagaggncngtgtcngtgcatggtgagtcgnggggagcgtggtccagcctgggnggtccctgagctctcctgtgcgagtcgtcgtggattcaccttcaggagctatgacatgccacgtcggccgcgaggcctcgaggacgaacgggctaggcgtcgggtgactagttatacgnggttancgaagtggaacgttataaactatagtgggaactaccgtccggtaaggaacgggtacccgtaagtttcccaaccgtactccgtaaccgaagacggaacctacgtttacccgaaagtaccgtaacgggttacgttagtacccgtagtaaccgaaacgttacggaaccctaacggcccgttaaggaacgacccggtaaccggaacggaaccgtcccgggtgttaggttaaccgg

SEQ ID NO: 94621 - DNA, 687 bp, Homo sapiens
  misc_feature: GYAE6OF01AUL6K.11.81.H04.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (332)..(332): a, c, t, g, unknown or other
  misc_feature (332)..(332): n is a, c, g, or t
tcagcgagagataccacgaccggtgctcgatttagtagtgtagattcgcgggctgccctttggctttggagatggttttctcgatgagctctgggagaggagcccagcactagaagtcggcggtgttccattcggtgatcagcactgaacacagaggactcaccatggagtttgggctgagtctgggtttcctcgttgcttcttttaagnggtctccagtgtcaggtncaacgtgggtggagtcgtgggggagcgtggtccagccgtggggacggtccctgacgacctcgtcctggtcgcgagtcgtcgtggtacttccacctttgaggtancttatgactatcgcctacgtcgggtcccgccgaggcctaccggagggacgaagggggtcctaggggaggtcggggtacggtaccgtaaggtttacgtaggttacgggttatggtaagttacgggtaaagtttaataaaacgttacgttagtacgggtaacgtaccggtaccggtaggaacgggtcccgtaagttacccaaccgttatccgtaccgaacggtacgtaacctaaccgttaaccgaaacgtaaccgtacgggttacgttaacgtaccgtaggtaacctaaaggtcgtaaaccgacggtccgtaggaacggacggtccgggaaacggaccgacgggtcgttggttaacg

SEQ ID NO: 94622 - DNA, 696 bp, Homo sapiens
  misc_feature: GYAE6OF01ESB84.11.81.H04.1.454.CMB.1.raw
  modified_base (195)..(195): a, c, t, g, unknown or other
  misc_feature (195)..(195): n is a, c, g, or t
  modified_base (211)..(211): a, c, t, g, unknown or other
  misc_feature (211)..(211): n is a, c, g, or t
  modified_base (310)..(310): a, c, t, g, unknown or other
  misc_feature (310)..(310): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttccncgttgctcttttaagnggtgtccagtgtcaggtgcaactggtggagtcgtgggggagcgtggtccagccctgggaggtccctgagactctcctgtgccagcgtctggatttccgnaccgttcgaggtagtctaatgacatcgcgtaccgtcgggtcccgccgacggccgtaccgaaggggccgaagggggcgttaggggtacggtggggtggtacgtaggttagttagtaggttagtaggtaagttaagggtaaagttaaagttaaatacgtagtacggtacggtacgtaccggtacggtaacgggtaccgtacgttacctaccgtactaccgtaccgtaacgtaacgtaaccgtaaccgttaacccgtaaaccggtaaccgtaaccggtacgttaacgtaccgtacgtaacgtaaaacgtaacggtaaccgtaaccggtaacccggtaacgggtaacgggaaccgggaacccgggaaaccggggtaaccgggtaaccggg

SEQ ID NO: 94623 - DNA, 579 bp, Homo sapiens
  misc_feature: GYAE6OF01A1EGO.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagtctgggtttttcctcgttgcttcttttaagaggtgtccagtgtcaggtgcaacgtggtggagtcgtggggggagcgtggtccagcctgggaggtccctgagactctcctgtgcagcgtctggattcaccttcaggagctatgacatgccacgtcgggtccgccaggcctccgaggcgaaggggctgggaggtgggtggcgagttatagtggtatgagtaggtaagttaataaatacgtaagtaggaagaccgtccggtaggaacgggccgtagttccacctactcctaccaagacgacctacgttaccgaacgaacgtacggtgtacgtcgtagactaaagtcgaacaggccctaggaacgacggaccggacgggacctacgggtcgtggttacgg

SEQ ID NO: 94624 - DNA, 596 bp, Homo sapiens
  misc_feature: GYAE6OF01EYJWH.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagttgggctgagcttgggttttcctcgttgcttcttttaagaggtgtccagtgtcaggtgcaacgtggtggagtcgtgggggagcggtggtccaggccgtggggaggtccctgagactctcctgtgcagtcgtctggattccaccttcgaggagtctatgactatgcctacgtcgggtcccgcgaggcctccgaggcgaaacggggctgggaggtggggtggactagttagtagtggtatgattaggtaaattataaaagtactaagtggaagtactacggtaggaacgggccgtattaccgacctatctaccgagacacctacttaccaaagaaccgtacggtagtactactacgaactaagtacgaacgacgcccgtaggaacgacggtaccggaacgggaccgtacgggtccgtaggttaacg

SEQ ID NO: 94625 - DNA, 681 bp, Homo sapiens
  misc_feature: GYAE6OF01ALEQS.11.81.H04.1.454.CMB.1.raw
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
  modified_base (320)..(320): a, c, t, g, unknown or other
  misc_feature (320)..(320): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcgtgggttttccncgttaggctctttaagaggtgtccagtgtcaggtgcaacgtggtggagtcgtggggggaggcgtgggtccaggcccgtgggaggtccctgagactcgtcctgtgcagcgtntggattcaccttnaggagctatgacagtcgcacgtgggtccgcaggctccgaggccgaaggggcctgggaggttcggggtggacgtaggtttaataggtagggtatggagttagggtaaaggtttaaattaaaagttacgttaagtagggtaacgtaacccgttccggtagggaaaccgggccgtaaagttcccgaaccaattcccgtaccgaacgggtaaccaaccgtaaccgttaacgaaaacgtaaccgtaccggttaaggtactacggttaggaacctaaaagtaccgggtaaaccaggtcccgtaacgaaacggaaccgggacccgggtaagggtaacccgtacggggtacccgttagggtttaaccgg

SEQ ID NO: 94626 - DNA, 563 bp, Homo sapiens
  misc_feature: GYAE6OF01B6V0Q.11.81.H04.1.454.CMB.1.raw
  modified_base (195)..(195): a, c, t, g, unknown or other
  misc_feature (195)..(195): n is a, c, g, or t
  modified_base (215)..(215): a, c, t, g, unknown or other
  misc_feature (215)..(215): n is a, c, g, or t
  modified_base (320)..(320): a, c, t, g, unknown or other
  misc_feature (320)..(320): n is a, c, g, or t
  modified_base (525)..(525): a, c, t, g, unknown or other
  misc_feature (525)..(525): n is a, c, g, or t
  modified_base (532)..(532): a, c, t, g, unknown or other
  misc_feature (532)..(532): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcgtggttttccncgttgctcttttaagaggtntccagtgtcaggtgcaacgtggtcggagtcgtgggggagcgtggtccagccgtgggagtccctgagactctcctgtcgcagcgtctggattcaccttcgaggtanctatgacatcgcacgtgggcccgcacggcctaccgagggccgaaggggctagggaggtggggtcggataggttatagtggtatgtagtaggtaagttataaatacgtaagtggacacgttccggtaaggacggtccgtatccgactactcctacgagacactacttaccaagaacgcgtagtactactagaacaaagtcgaaacngtaccgngacgacgaccggagaccgcggtcgtgttacg

SEQ ID NO: 94627 - DNA, 607 bp, Homo sapiens
  misc_feature: GYAE6OF01DEXOR.11.81.H04.1.454.CMB.1.raw
  modified_base (599)..(599): a, c, t, g, unknown or other
  misc_feature (599)..(599): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccagtggagtttgggctgagcttgggttttcctcgttgcttacgttttaaggaggttgtccagtgtcgaggtgcaacgtgggtggagtcggtggggggagcggtggtccaggccgtggggacggtccctgacgtacctctcctggtgcaggccgtctggactttccaaccttcgaggtacgtctagtcgaactagtcgcgtacggtcgggtccccgcgaggcctaccgagggcgaagggggctagggaggtgggtcggacttaggttataggtggtagtagtagtaggtaaagttataaagtacgtagtggacgtacgtcggtaggaacggtcgtactaccactatcgacagacgtacctaacgtacaacgaacgtcggtatatcgtataacaaagtcgtaacagtccgaagacgacgaccggaggacgacggtntggttacg

SEQ ID NO: 94628 - DNA, 582 bp, Homo sapiens
  misc_feature: GYAE6OF01ACVXD.11.81.H04.1.454.CMB.1.raw
  modified_base (195)..(195): a, c, t, g, unknown or other
  misc_feature (195)..(195): n is a, c, g, or t
  modified_base (324)..(324): a, c, t, g, unknown or other
  misc_feature (324)..(324): n is a, c, g, or t
  modified_base (348)..(348): a, c, t, g, unknown or other
  misc_feature (348)..(348): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttccncgttgctcttttaagaggtgtccagtgtcaggtgcaacgtggtggagtcgtggggggaggcgtggtccaggcccgtggggacggtccctgagactctcctgtgcagcgtctggacttcaccttcagganctatgacagtgcacgtcgggtccnccgaggcctccgaggcgaaggggctgggagtgggtggctaggttatagtggtatgagtggtaagttataaatactagtggaagaccgtacggtaggaacgggtccgattccaccatcctccgaagacgacctaccttaccaaacgaaccgacgggttagtactctacgactaaagtcggaaacacggcccttaggacgacggacccggaggaacccgacgggtcgtggttacgg

SEQ ID NO: 94629 - DNA, 674 bp, Homo sapiens
  misc_feature: GYAE6OF01CBXPN.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggtggagtcgtggggggaggcgtggtccaggcccgtgggaggtccctgagactctcctgtgcagcgtctggatttccaccttcgaggtagctatgacatgcacgtcgggtcccgcgaggcctaccgaggcgtaacgggggcgttaggggaggttggggtcggcttaaggtttataggttggtaagtggtaagttagggtaaagtttaataaaagttacgttagtacgggtaacgtaccgttaccggtagggaaacggggcccgttaacgtttacccaccctaacttccgtacccgaaggtacgtaaccctaaccttacccgaaaggtaaccgtaacggttgtaacgttcgtacgtaaccgaaaattaccggaaacgacggtacccgtaggaacggaaccggtccggaaacggaacccgtcgggtccgttagggttaacg

SEQ ID NO: 94630 - DNA, 683 bp, Homo sapiens
  misc_feature: GYAE6OF01DXSB9.11.81.H04.1.454.CMB.1.raw
  modified_base (196)..(196): a, c, t, g, unknown or other
  misc_feature (196)..(196): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttccncgttgcttctttaagaggtgtccagtgtcaggtgcaactggtggagtcgtgggggagcgtggtccagccgtgggacgtccctgacgtacctctccgtgtgcagtcgtctgggattccgaccttgaggagtctaagtgaactagtcgaccgtacgtcgggtcccgccgtagggcctaccgagggccgaaagggggcctaggggaggttcggggtaggactaaggtttatagttagggttaataggtagttaagggtaaacgtttaataaaagttacgtaaggtacgggaacgtacccgttaccgggtaaggaaccgggtccgttaactttaccgaaccctagttcctaaccgtaaggaacgaccctaaccgttaccgaaacggacgttaccgggtgtaacctccgtagaaacctaaagtacggaaacacggtacccgtaaggacgaaccgggaccggaacggaaccgtacgggtcgttaggttaacgg

SEQ ID NO: 94631 - DNA, 642 bp, Homo sapiens
  misc_feature: GYAE6OF01CY3RM.11.81.H04.1.454.CMB.1.raw
  modified_base (331)..(331): a, c, t, g, unknown or other
  misc_feature (331)..(331): n is a, c, g, or t
  modified_base (361)..(361): a, c, t, g, unknown or other
  misc_feature (361)..(361): n is a, c, g, or t
  modified_base (630)..(630): a, c, t, g, unknown or other
  misc_feature (630)..(630): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggtggagtcgtgggggaggcgtggtccaggccgtggggacggtccctggacgactctcctgtgcagtcgtcgtggtacttccaccttcgaaggngtctagtcgacatcgcgtacgtcgggtccncgaggcctaccgaggcgaaggggtcgtagggtaggtggggtgacgtagttataggttggtatggtagtagggtaaagttaataaagttacgtaaggtacgggaacgtaccgtaccggtagggtaacgggccctattacccaccgtactcgtaccgaagaacgtaccctaaccgttaccgaaacgtaaccgtacggttactaacgtcgtacgaactaaagtacgaaccgtagtcccgtaaggaacgacggaccggaaggaccgtaccggngttaggttaacg

SEQ ID NO: 94632 - DNA, 795 bp, Homo sapiens
  misc_feature: GYAE6OF01DHT8L.11.81.H04.1.454.CMB.1.raw
  modified_base (214)..(214): a, c, t, g, unknown or other
  misc_feature (214)..(214): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcacagtggagtttgggctgagtcgttggttttctcgttgtcttcgtttaagnggtgtccagtgtcaggtgcaacgtgggtggagtcggtgggggagcggtggtccagccgtgggacgtccgtgacgtactccgtcgtggtcgcaggtccgttgtacggtactttccgacccgtttagacgggtacgtactttagtacgaacctcgtacggaccgtaccggttccggggtacccgaccgacgggtccctaccgggaacggggccggtaaagggggtccggttagggggtacgggttcggggtaggtacggttaaggtttagtagggttacggttaagtgggtaacgtttagggtaaaatttaattaaaagttacgtaaggtacgggtaagttacccggtagggttaacgggaaccgggtacctacgtttaccaacctttacgtcccgtaacgaacggtaaccgtaaccttaacccggttaaccgaaacggtaacccggttacggttacgtttaacgtaaccgtaggtaaaacctaaaaggttccggtaaaccgacggttccgtaaacggggaaacccgtaaccgggaaccggggtaaacggacccggttaacggtggtttacggtttaaacggg

SEQ ID NO: 94633 - DNA, 775 bp, Homo sapiens
  misc_feature: GYAE6OF01D2PF3.11.81.H04.1.454.CMB.1.raw
  modified_base (139)..(139): a, c, t, g, unknown or other
  misc_feature (139)..(139): n is a, c, g, or t
  modified_base (229)..(229): a, c, t, g, unknown or other
  misc_feature (229)..(229): n is a, c, g, or t
tcagcgagagataccacgaccggtgctcgatttagtagtgtagattcgcgggctgccctttggctttggagatggttttctcgatgagctcgtgggagaggagcccagcactagaagtcggcggtgtttccattcggtnatcagcactgaacacagaggactcaccagtggtagtttgggctgacgtcgtttcgggtttttcctcgttgtcctttacgtttttaaaggnggttcgtcctaggttcgtcgaggtcgacgtaacggtgggtgggtacggttcgggtagggggggacggtcggttcgggtacccgacggtcccggtacgggggtaccggtacccccgtggacgttaccgttccgtccgttggtcggcgtacggttccgttcgtaggtactttccgtaacccttggacggtacgtacttaagtacgtactacgttcgccgtaccgggtaccggggtccccgcccgtaacgggtccctaacccgggacgggtaaccgggaacggggtcggtggggtacgggttgggggtacggtacggttaagtttagtaaccgttaggggttacgtaaggttaagttaaacggggttaaagtttaaacttaaaacggttaacgtaaggtaggtaaccgtacgttaccgggtagaacgggtactactacactactcgtacgaacgacgtacgtaaccaacgaacgtaacgtcgttagtactcgtatacgtaacgtgaaacgtagcctaggacgacgacgaagacgtacggtgtcggttag

SEQ ID NO: 94634 - DNA, 607 bp, Homo sapiens
  misc_feature: GYAE6OF01ALWTF.11.81.H04.1.454.CMB.1.raw
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (306)..(306): a, c, t, g, unknown or other
  misc_feature (306)..(306): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagagactcaccagtggtagtttgggctgagcggtcggttcgcgtagctacttaagagntcngtgtcagtncatggtgagtcgngggagngngtcngcgtggacgtcngacgtctctcngtcncgngtcctgtcgtactccacctgaggactntatgactgtcgactcggtcgccgacgtcgcgacgaggcgtagggcgtaggtggtggtacgtagtaggttaatggttagtgtaggtaacggttaagttaagttaactaaagttgtaagtacgggtaacctacgggtacccggttagggaaacggtccttaactacccgaacttccgaacccagtaacgtacctaacgtacctaacggtacacggttaccgaattcgtcgtaacgacaaggttccaaggtcccggaaacgagggaccgtaacgaccggaacgccggtacgttgtaggttaccg

SEQ ID NO: 94635 - DNA, 579 bp, Homo sapiens
  misc_feature: GYAE6OF01B5R44.11.81.H04.1.454.CMB.1.raw
  modified_base (347)..(347): a, c, t, g, unknown or other
  misc_feature (347)..(347): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggtggagtcgtgggggagcgtggtccaggcctgggacggtccctgagactctcctgtgcagcgtctggtacttccgaccttcgaggacgctatgacatgccacgtgggtccnccgaggctccgaggcgaaggggctggaggtgggtggctagttatagtggtatggagtaggtaagttaataaatactagtaggacgacgtccggtaggaacgggccgtacttcaacctatccgtaccaagacgacctactaccgaagaaccgtacggtgtacttcgtagaacgtaagtacgaacacggtccgtaggacggacgacccggaaggaccgacgggtcgtggttacg

SEQ ID NO: 94636 - DNA, 779 bp, Homo sapiens
  misc_feature: GYAE6OF01E2C9E.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccagtggtagtttgggctgagtcgttgggttttcctcgtttgcctttcgttttaaggaggttcgtacctaggttgtacgaggtgacctaacgtgggtaggaggtcggtggggggacgcggtcgggtcccgaggcccgttgggggaccggtccccgtggaacgtccttccgttccgtggtcgcgaggtccgtcgtggtactttccgaccttgaggagtcctatcgactatcgaccgtaccgtcgggtcccgacgacgggtcctaccggaacgggacggaacggggtcgtaggggtacgggttcggggtacggtacgttaaggtttaagttaggttagggtaacgttaggtaacggttaagggttaaagtttaaacgttaaaacgttaacgttaaggtacgggtaacgtaccggttaccgggtaacgggtaaccgggtaccgttacttaccgtaaccctagttaccctacgaacggtaccgtaacccttaccgttaaccgaaaggtaacccggtaggttacgttacgtaccgtacgtaaactaacgtacgaaaccgtacggtaccgtacggaacgaaccgggaccggaacgtaaccggtacggtcgttggttaacgg

SEQ ID NO: 94637 - DNA, 871 bp, Homo sapiens
  misc_feature: GYAE6OF01B184D.11.81.H04.1.454.CMB.1.raw
  modified_base (213)..(213): a, c, t, g, unknown or other
  misc_feature (213)..(213): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagagactcaccatggagtttgggctgagcttgggttttcctcgttgcttcgttttaagnggtgtccagtgtcaggtgacaacgtgggtggagtcgtggggggagcgtggtccaggccgtggggacggtcccctggacgtacctctcccttgtcggcaggccgttcgtggtaactttccgacccgtttcgaagggacggtccttaagttcgacctaagttcggaccgtaaccggttcgggggtaccccgcccgaacggggtcccttacccggaaaggggtaccggtaaacgggggggtccgttagggggtaacggggtttcgggggtacgggtaccgttaaaggggtttaacttaggggtttagggttaagttacgggtaaaggttttaaggggtaaaaggttttaaacgtttaaaacgttaaccgttaagggtacgggtaaacggttaacccggttacccggggttaagggaaaccgggggtacccgttaacgttacccgtaaacccttacgttacccttaacccggaacggtaaccgtaaacccgttaacccgttaaaccccggtaaagtaaacccgggtacggtttacggttaaccttacggtacggaaaaccgttaaacggtacggtaaaccggtacggtacccggttaacgggaaacggaaccgggtaccgggaacggtaacccgggaccggttccggttagggtttaaccgg

SEQ ID NO: 94638 - DNA, 815 bp, Homo sapiens
  misc_feature: GYAE6OF01BOB0H.11.81.H04.1.454.CMB.1.raw
tcagcgagagataccacgaccggtgctcgatttagtagtgtagattcgcggggctgccctttggctttggagattggtttttctcgatgagctcgtgggagaggagcccagcactagaagtcggcggtgtttccattcggtgatcagcactgaacacagaggactcacagtggtagtttggctgagtcgtttcgggttttcctcggtttcgtctttacgttttaagaggttcgtccgtaggttgtacgagggttcgacgtaacggttgggtaggtacggttcgggtgggggggaggtcggttcgggtccacgggtccggttagggggtaccggtcccgtaggacgtccgttccgtccgttgtcggcgacggtcgttcgtggtacctttccgaccgttgaggtagtcctagtacgaactagtcgaccgtaccgggttccgggccccgaccggtacggccctaccgggacggaccgggaacgggggtcgtaggggacggttggggacggtactaagggtttatagggttagggtaagtaggtacggttaaggttaaacgtttaaattaaagttacgttaaggtaaccgggtaagttaccggttaaccgggtaacggggaaccgggttaccgttaaccgtaccgtaacccgttactaacccgttaccgaaaccggttaaccgtaacccgttaaccgttaaaccggaaaacgttaacccggtagggtaccctagttacgacgaaaaccttaacgtaacgaacgtacgtcggaacggtacggaacggaccggtaggaaccgtcggttgtaaggtttaacg

SEQ ID NO: 94639 - DNA, 634 bp, Homo sapiens
  misc_feature: GYAE6OF01A6D2X.11.81.H04.1.454.CMB.1.raw
  modified_base (217)..(217): a, c, t, g, unknown or other
  misc_feature (217)..(217): n is a, c, g, or t
  modified_base (325)..(325): a, c, t, g, unknown or other
  misc_feature (325)..(325): n is a, c, g, or t
  modified_base (351)..(351): a, c, t, g, unknown or other
  misc_feature (351)..(351): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttcttttaagaggtntccagtgtcaggtgcaacgtggtggagtcggtgggggagcgtggtccagccgtgggacgtccctgagactctcctgtcgcagtcgtcgtggacttccaccttcgaggnctagtgacagtgctacgtcgggtccnccgaggtcctaccgaggaccgaaggggtctaggggacggtggggtgacgtagttatagtggtagtgtaacgtaggtaacgtttaataaagtacgtagtaggtacgtaccgtcggttagggacggtaccgtacgttacccaccgtacttaccgaccgaagtaccgtaacctaaccgttaaccgaaacgtaaccgtacggttacgtacgtacgtacgaactaaagtaccgaacgtacggacctaggaacgacggaccgaacgggaccgacggttcgtgttaacgg

SEQ ID NO: 94640 - DNA, 582 bp, Homo sapiens
  misc_feature: GYAE6OF01A6N3E.11.81.H04.1.454.CMB.1.raw
  modified_base (346)..(346): a, c, t, g, unknown or other
  misc_feature (346)..(346): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggtggagtcgtggggggaggcgtggtccagcctgggaggtccctgagactctcctgtgcagcgtctggattcacctttcgaggagctagtgactatgcacgtcgggtcccnccgaggcctccgaggcgaaggggtctgggagtggggtggctaggttatagtggtatgataggtaagttaataaagtatagtggagacgtccggtaggaacgggtccgtaattccaactactccgtaccgagacgtacctaccttaccaaacggtaacgtacggtagtaactctagaacgtaaagtacgaaccacgtccgtaggacgacgaccggacggacgaccggtgtggttacg

SEQ ID NO: 94641 - DNA, 789 bp, Homo sapiens
  misc_feature: GYAE6OF01DVLFS.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggttgtttccattcggtgatcagcactgaacacagaggactcaccagtggtagtttcggctgagtcgttgggttttcctcgttgctttacgtttaacggaggtcgtcctaggttcgtacgacgggttgacctaacggttggggtgggtacgtcgggttagggggggacggtcggttcggtacccacgggtccggtggggtaccggtcccgtaggacgtaccgttctccgtgtcgacgcgtcgtactggtacttcgtaccgttagagggtatctaagtgaacctagtcgaccgtcggtcggtccgcgtaggcctacggagggtacggaacgggtcggtaagggtcgggtggggtacggacttaaggttactaggttgggtaattcggtaagtttaacggtaaagttttaaaacttaagtaaccgtttagggacgtaaaccggttacccgttacggggtaaacgggaccgggtaacccttacgtaacctacccggtaactttaccaacggaacgttaacgaaaccccgttagttaaacccgaaggtaaccgtaacgggttctaacggttatacgaaaccgaacgttaacggaacccacggttaaccggtaacgggaaccggtacgggaaacccgggtacgtacccggaaacgttggttaacgttaacgg

SEQ ID NO: 94642 - DNA, 625 bp, Homo sapiens
  misc_feature: GYAE6OF01EAHCB.11.81.H04.1.454.CMB.1.raw
  modified_base (213)..(213): a, c, t, g, unknown or other
  misc_feature (213)..(213): n is a, c, g, or t
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
  modified_base (353)..(353): a, c, t, g, unknown or other
  misc_feature (353)..(353): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgcaacgtggtggagtcgtgggggagcgtggtccaggcccgtggggacggtccctgacgactctcctgtgcagcgtntggactttcaccttnaggagctatcgacatcgcctagtccgggtccnccgaggtcctacccgagggaccgaagggggctaggggaggtcggggtgacgtaggtttataggttgggtatggtagtaggtaagtttaataaagttacgtagtaggactacgtaccggtagaaccgggtctattaccacctatcctaccgaagtacgaacctaaccgttaaccgaaagtaaccgtacggttagtaactacgtacgaactaaagtcgaaacgacggtaccgtaggagtaccggaccgggacggaaccgcggtgttgttaacgg

SEQ ID NO: 94643 - DNA, 764 bp, Homo sapiens
  misc_feature: GYAE6OF01DOU7U.11.81.H04.1.454.CMB.1.raw
  modified_base (218)..(218): a, c, t, g, unknown or other
  misc_feature (218)..(218): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccagtggagtttgggctgagtcttgggttttcctcggttgcttacttttaaggnggttgtccagtgtcaggtgcaacgtgggtggagtcggtgggggagcggtggtccagtccgtgggacggtccctgacgtacctctccgtgtcgcgagtccgttcgtggtactttccacctttcgagggtagtcttagtacgacctaagttccgactacggttcgggtaccccgccgaacgggtcctacccggagggaccggtaaacgggggtcgtagggagggttcggggtacggtacgttaagtttagtaggttgggtagttaggtaagttaagggtaaagttttaaagtaaagtttaacgtaggtacggtaacgtacccgttaccggtagggaacgggtaccgtacgttacccgtaacgtacgttacccgtaccgaacggtacgacccgttaacttaccgaaacgttaacgtacggtacgttacttaccggtacgtaaacgaaacttacgggaaacctaccggtaaccccggttaaggaacgggtaaacccgggaaccgggtaaacgggtaaaccccgtcggggttaaccgttagggtttaaccg

SEQ ID NO: 94644 - DNA, 951 bp, Homo sapiens
  misc_feature: GYAE6OF01D2VIB.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggtagtttgggctgagtcgtttgggtttttcctcgttgtccttcttttaaggaggtcgtccgagtgtcgaggtgactaacgtgggtggaggtcgtgggggaggtcggtcggtccacgccgtgggacggtccctgacgtactctccgtgtcgacgacggtcgtcgtggtacttccctaccgtttcgaacggtacgtccgttagttacggaacctagttccggacctaccgggttccggggtccccgaccggtacgggtcccttacccgggaacgggtaccgggaacgggggtcggtagggtaggggtacgggggttgggaccgttaagggttttagtaacggtttaggggttaagtagggtaagtttaaggggttaaattttaaaagttaaaacgttaaccggttaaggtaacggggtaaccgttacccggttaccggggtaacggggtaaaaccggggtccccgtaaacgttttacccccggaaacccctaaccgtttccccgtaaaccccggtaaggtaaacccccggtaaaccctttaccccggtttaaaacccggaaaacggtttaaaccccggggttaccggggttaacgtttaaaaccggttcccggttaaacgggtaaaaacccttaaaacggggttaaaccgtaaaaccccgggtagggttaaacccccccgggttaagggggaaaccccggttaaacccgggggaaccccccggggtaaggggttaaaacccccgggttacggggtacccggttttaagggttttaaacccgggg

SEQ ID NO: 94645 - DNA, 773 bp, Homo sapiens
  misc_feature: GYAE6OF01BRQF2.11.81.H04.1.454.CMB.1.raw
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
  modified_base (248)..(248): a, c, t, g, unknown or other
  misc_feature (248)..(248): n is a, c, g, or t
tcagcgagagataccacgaccggtgctcgatttagtagtgtagattcgcggggctgccctttggctttggagatggtttctcgatgagctctgggagaggagcccagcactagaagtcgcggtgttccagttcggtgatcagcacttgaacacagaggactcaccatggagtttggctgagctgggtttccngttgctctttaagnggtcgccagtgtcagtgcaacgtggtcggagtcgtgggggancgtggtccagtcccgtgggacgtccctggacgtactcgtcctggtcgacacggtccgtcgtaggtactttaccgaccgtttacggaggtacggtccttaaggtcgtaaacgtcgttacggaccgtaaccggtttcggggaccccgccggtaacgggtaccttaacccgggtaaggggacccggttaaaggggggccttaagggggaccggttgggggttacggtacccgttaaaggtttacgtaaggtttacgggtaactacgggtaacttacgggttaaaagttacttaaaaccgtaacgttaggttacgggaacttacccggtacccggttaaggaacccgggtacctaacgtttacccgaacccgtagttacccgtaccgtaacggtaccgtaaccgtacccgttaaccgaaaccgtaacggtacgtacttacgttaaccgtgaaacctaagggtaccgaacggtacgtcccgtaaggaccgtacggccggaacggtacctacggtccgttggttaacccgg

SEQ ID NO: 94646 - DNA, 670 bp, Homo sapiens
  misc_feature: GYAE6OF01CD2HP.11.81.H04.1.454.CMB.1.raw
  modified_base (328)..(328): a, c, t, g, unknown or other
  misc_feature (328)..(328): n is a, c, g, or t
  modified_base (332)..(332): a, c, t, g, unknown or other
  misc_feature (332)..(332): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagttgggctgagtcttgggtttcctcgttgcttcttttaagaggtgtccagtgtcaggtgctaacgtggtggtagtcgtgggggagtcggtggtccgagcccgtgggtacgtcctgagtactctctggtcgcagtcgtctggtacttcaccgttgagnctangacatgacacgtggcccacgacggctaccgaggtcgaagggctagggacggtgggtcgacgtagttatagtaggtactagagtaggtaaagttaactaaatacgtagtacggagtacgtaccggtaggaaacgggtcctagttacccaactacgttaccgaaccgtagaaacggtacctaaacccgttaacccgaaaggtaacccgtaacgggttacgttaacgtaccgtaaacggaaaacctaaaggtaaccggtaaaactacccggtaacggttaacgacggaaaccggacccgggtaaacggaaccggtaaccgggttaagtcgggtttaaaacg

SEQ ID NO: 94647 - DNA, 675 bp, Homo sapiens
  misc_feature: GYAE6OF01ERAUA.11.81.H04.1.454.CMB.1.raw
  modified_base (210)..(210): a, c, t, g, unknown or other
  misc_feature (210)..(210): n is a, c, g, or t
  modified_base (214)..(214): a, c, t, g, unknown or other
  misc_feature (214)..(214): n is a, c, g, or t
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
  modified_base (338)..(338): a, c, t, g, unknown or other
  misc_feature (338)..(338): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggtttcctcgttgcttctttaagnggtntccagtgtcaggtgacaactggtggagtcgtgggggagcgtggtccagccgtgggagtcctgagctctctgngcagcgtcgtgacttcaccttcgaaggnctagtgacatgcacgtcgggtccnccgtacggcctcggaacgggtcggaaacgggggtctacggggtaggttacgggggtcgggtaacgtaaggttttaagaaggtttgggttaagtaagggtagttaagggttaaagtttaaataaaagttacgtaagttagggaacgtaacgttccggtaaggaagggtacccgtaagttaccaaccctataccgtaccaagtaaccgaacctaacgttaacccgaaacgaaccgtaccggttagtaacttccgtaacgaaccgtaaaagtccgaaaccgtcggaacgtacggaaggacggtaccccggaaggaacccggacggtacgttgggttaacg

SEQ ID NO: 94648 - DNA, 557 bp, Homo sapiens
  misc_feature: GYAE6OF01AUALP.11.81.H04.1.454.CMB.1.raw
  modified_base (318)..(318): a, c, t, g, unknown or other
  misc_feature (318)..(318): n is a, c, g, or t
  modified_base (340)..(340): a, c, t, g, unknown or other
  misc_feature (340)..(340): n is a, c, g, or t
  modified_base (455)..(455): a, c, t, g, unknown or other
  misc_feature (455)..(455): n is a, c, g, or t
  modified_base (490)..(490): a, c, t, g, unknown or other
  misc_feature (490)..(490): n is a, c, g, or t
  modified_base (509)..(509): a, c, t, g, unknown or other
  misc_feature (509)..(509): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtcgtggggggagcgtggtccagccctgggaggtccctgagactctcctgtgcagcgtctggattcaccttcgagganctatgacatgcactgggtcccncgaggctcccgagggccaaagggggcctagggaggtggggtgacgtagtttatagtgggtatggagtaggtaagttataaatactagtgagacgtcgtagaaggccgattcactntctccgagacgacacttaccaagtacacggtgtancgtagacaaatcgaaacgngtccgtaggacgacggacccggaacggaccgaccgggtctggttacgg

SEQ ID NO: 94649 - DNA, 880 bp, Homo sapiens
  misc_feature: GYAE6OF01EW3H5.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgttccattcggtgatcagcactgaacacagaggactcaccatggagttgggctgacgcgttgggttttccctcgtttgcttacgttttaaaggaggtcgttccaaggttcgtccgaagggttcgaccgtaaacgttggggtacggggtaacgggttccgggtaggggggggaaggggtccggttcggggttaccccgaagggtccccggttaggggggtaccgggttcccccgtaggtaacgacccgtttccgttcccgtggtcgccgaggtccgttcgtacgggtaactttcccgtaacccgtttcggagggtacgtccgttaaagtccggaactagtccggtacccgtaacggtttccgggccccggtaccccgacggggtacccgtacccgggaacgggaccgggaaacgggggttccggtagggggaaccggtttggggggcgtaaccgttaaggtttaagtaacggttagggttaagtacgggtaattaaggggtaaattttaaataaaacgttaacgtaggtacgggaacgttaaccgggttccgggtaaagggaacccgggtacccttaacgtacctaacccgtataaccccgtaccggaaacggtaacgtaaacccttaaccgttaacccggaaaagtaacccggtacggttacgtaaccgttacgtacggaaactaaacggtccgaaacgtcggaccgtacgggaaagcccgggtaacacggtaacgacccgggagttgttaacgg

SEQ ID NO: 94650 - DNA, 734 bp, Homo sapiens
  misc_feature: GYAE6OF01EF4XU.11.81.H04.1.454.CMB.1.raw
  modified_base (591)..(591): a, c, t, g, unknown or other
  misc_feature (591)..(591): n is a, c, g, or t
tcagcgagagataccacgaccggtgctcgatttagtagtgtagattcgcgggctgccctttggctttggagatggtttctcgatgagctctgggagaggagcccagcactagaagtcggcggtgttccattcggtgatcagcactgaacacagaggactcacatggagtttggctgagcttggtttcctcgttgcttcttttaagacggtcgtccgagtcgtcaggtgacctaacgtggtggacgtcgtcgggggagccggtcggtccagcccgtgggacgtccctggacgtaccttcgtcctggtcgcgagtccggttctggacttccgaacctttcgaggtaacgcttagtacgacgtaattcggcgtaacgttcgggtccgaccgaacgggtccgttaccgaacggtaccggaacgggggtctaacggggtaagggtttcggggacggtaaccgtaggtttaaaccttggtaacggttaggtacgaaggtttaacgggaaagttttaactaaagttacgtagtacggacgtacccgttacgggtacgtaaacggtccgttaacgtcccgtaaccgtattaccccgtanaacggtaccgtaaccgtacttaacccgaaaggttaacccgtacggttagtaccgttcggtaaccgtaagtaaacggtcaaacgtcggtaccttacgggaacgttccggaacgtaagtacccggaacggttcgtaggttaaccg

SEQ ID NO: 94651 - DNA, 563 bp, Homo sapiens
  misc_feature: GYAE6OF01DIPCT.11.81.H04.1.454.CMB.1.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (346)..(346): a, c, t, g, unknown or other
  misc_feature (346)..(346): n is a, c, g, or t
  modified_base (378)..(378): a, c, t, g, unknown or other
  misc_feature (378)..(378): n is a, c, g, or t
  modified_base (550)..(550): a, c, t, g, unknown or other
  misc_feature (550)..(550): n is a, c, g, or t
tcagcgagagataccacgaccggtgctcgatttagtagtgtagattcgcggggctgccctttggctttggagatggtttttctcgatgagctctgggagaggagcccagcactagaagtcggcggtgtttccattcggtgatcagcactgaacacagaggactcaccatggagtttgggctgagcttgggttttcctcgttgcttcttttaagaggtntccagtgtcaggtncaacgtggtggagtcgtggggggagcgtggtccagccgtgggacggtccctgagacctctcctgtgcagcgtctggcttcaccttcgagganctancgtacatgcacgtggccncgagctacgaggcgaagggctaggaggtgggngactagtatagtgtatagagtagtaagttaataaagtactagtaggacgacgtcggtaggaacgggtcacttcaactactctaccgaagacgacctactaccgaaagtaacgacggtatactaccgagtaactaaagtactaaacgacgtcgtagaggacgtacggaggacncggatggttaacg

SEQ ID NO: 94652 - DNA, 795 bp, Homo sapiens
  misc_feature: GYAE6OF01EKJJH.11.81.H04.1.454.CMB.1.raw
  modified_base (226)..(226): a, c, t, g, unknown or other
  misc_feature (226)..(226): n is a, c, g, or t
tcagcgagagataccacgaccggtgctcgatttagtagtgtagattcgcgggctgccctttggctttggagattggttttctcgatgagctcgtgggagaggagcccagcactagagtcggcggtgttccagttcggtgatcagcactagaacacgagacgtactcaccagtggtagttggctagtacgtcgtttggttttcctcgttcgtctttacgtttaaggnggttcgtccgtaggtgtacgtaggtacgaccgttaaggtgggtgggtacggtcgggtggggggacgtccggttcggtacccgtaggtccggtacggggtaccggtcccgtaggacgttaccctccgttcgtcgggttcgaccgtaggtcgtcgtaggtacctttaccgtacccgtgaacggtcacgttatacgactgtcgccgtcggtaccggcccgtacgacggtccacggtagggacggtagggcgtaggaccgggtagggtcgtacgtagttaacgtaggttagtaggtagttaggtaacggttaattaagtaaacgttcgtaaagttacggaaccgtaaccggttacgggtaacgggtaaccgttaccgtaacgtaccctaacgtaccgtaccgttaaccgacgaacccgttaaccgtaacccgtaaccgtaacgggtaacgttacggttacgtaaacctcggaagtaaacctaaaggtaccgtaaacggaccccggttaagaaacccgggcggtaaccgggtacccggaaacgtaccgggttcggtaacgttaggtttaaccgg

SEQ ID NO: 94653 - DNA, 639 bp, Homo sapiens
  misc_feature: GYAE6OF01EJVJ0.11.81.H04.1.454.CMB.1.raw
  modified_base (524)..(524): a, c, t, g, unknown or other
  misc_feature (524)..(524): n is a, c, g, or t
  modified_base (593)..(593): a, c, t, g, unknown or other
  misc_feature (593)..(593): n is a, c, g, or t
tcagcgagagataccacgaccggtgctcgatttagtagtgtagattcgcggggctgtcctttggctttggagatggttttctcgatgagctctgggagaggagcccagcactagaagtcggcggtgtttccattcggtgatcagcactgaacacagaggactcaccatggtagtttgggctgagtcttggggtttttcctcgtttgcttacgtttttaaaggaggttcgtccaggttgtccgagggtgaccaacgtgggtgggagtcggtggggggagcgtggtccaggccgtggggacgtccctgacgactctcctgtgcagcgtctggtattccaccgttcgaggactctagtcgactagttggacctacggtcggggtcccgaccgagggtccctaccgagggaccgaagggggctaggggtagtgggggtgcgtagttataggttggtagtagagttaggtaagttaactaaagtactagtaggacgtacgtcggtacgaagggccgtattccaaccgtntacccgtacaaggtacgaacctaccttaccgaaacgtacgacggttgtactctgaaactaagtacgaanacggtctaggacgaccggaccggagaccggtcggtcgttggtaacg

SEQ ID NO: 94654 - DNA, 823 bp, Homo sapiens
  misc_feature: GYAE6OF01EHD2X.11.81.H04.1.454.CMB.1.raw
tcagcgagagataccacgaccggtgctcgatttagtagtgtagattcgcggggctgccctttggctttggagattggtttttctcgatgagctcgtgggagaggagcccagcactagagtcggcggtgtttccattcggtgatcagcactgaacacagacggactccactagtggtaggtttgggctggacgtcgtttcgggtttttcctcgtttgtctttacgttttaaggagggttcgttccgtagttcggtccgtagggtgaccgtaacgttgggtaggtaggttcgggtggggggacggtcggttcggtccgacggccggttggggacggttcccgtaggtacggtaccttccgtccgtgtcgacgtacggttcgtccgttaggtacctttccgtacccgttaggaagggtagtacctagtacgactacgtcgaccgtaccggtccgggtcccgaccggacggtacccgtacccgggaacgggtaccggggtaacgggggtcggttagggggtacgggtcggggtacgtacgttaaggtttagtaggttaggttacgtaggtaaggttaagggttaaattttaaacgtaaagtttacgtaacggttagggtaacgtacccgggttaacgggtaaccgggaaccgggttaccttaccgtaccgtaacccgtctaccgaaccgaagaccgtaaccgtacccgttaaacgaaaccgtacggtacggttatacgtacgtacgtaacgtaaacggtcgtaaacgacggtcgtaagggaccgaacgggaccggaacggtaacccgtacggtggttcgttaacggg

SEQ ID NO: 94655 - DNA, 775 bp, Homo sapiens
  misc_feature: GYAE6OF01C547T.11.81.H04.1.454.CMB.1.raw
  modified_base (157)..(157): a, c, t, g, unknown or other
  misc_feature (157)..(157): n is a, c, g, or t
  modified_base (225)..(225): a, c, t, g, unknown or other
  misc_feature (225)..(225): n is a, c, g, or t
  modified_base (750)..(750): a, c, t, g, unknown or other
  misc_feature (750)..(750): n is a, c, g, or t
tcagcgagagataccacgaccggtgctcgatttagtagtgtagattcgcggggctgccctttggctttggagattggttttctcgatgagctcgtgggagaggagcccagcactagaagtcggcggtgtttccattcggtgatcagcactagaacanagagactcacagtggtagtttgggctgagtcgtttgggttttcctcgttgtcctttagttttaaaggnggttcgtaccgtaggttcggtaccagggttcgaccgtaaggttggggtagggacggttcgggtgggggggacggtcggttacgggcccgaagggtcccggtaggggtacggttcccgttaggacgtaccttccgtccgtggtcgcgaggtccgttgtagtactttccgtaccgttcgaagggtactacgttatcgaactcgtacgaccgttacggtcggggtccccacggacggtacctccggaaggacggtaacggggtcgtaggggtaggtgggtacgtagtagttataggtgttacgaggttagtaaggtaacgtttaaataaagttacgtaaggtaggtacgtaccggtttacggaagggtaaccgggtacttaacgttcccgaactacgtttacccgtaacggaacgtacggtaaacccttaaccgttaaacccggaaaaggtaacccgttaggttaaccgtacgtacttaaggaaactaaagtacgaaactcggacgtacggaacgacgaccggggaanaacccggtcgtaaagttggttaacg

SEQ ID NO: 94656 - DNA, 921 bp, Homo sapiens
  misc_feature: GYAE6OF01EAAEC.11.81.H04.1.454.CMB.1.raw
tcagcgagagataccacgaccggtgctcgatttagtagtgtagattcgcggggctgccctttggctttggagattggttttctcgatgagctctgggagaggagcccagcactagaagtcggcggtgtttccattcggtgatcagcactgaacacagaggactcacatggagtttgggctgagtcgttgggttttcctcggttgtcttcgttttaaggagggtcgtccgagttgtcgaagggttgaccgaacgtgggtggagttcggtggggggaggtcggtggtccaggccgtggggacggtccctgacgtacgttctccgtggtcgcgtaggccgttcgtgggtaactttcccgaacccgtttcggaacggggactccgttaagttacggaaactaagttcggaccgtaaccgggttccgggggtccccgtacccgagggtacccgtacccgggaacggggtaccgggaaacggggggtcttaggggggtaagggtttcgggggggtacggtacgttaagggttttaaagtaaggtttcggggttaagtaggttaaggttaaggggttaaaagttttaaacgtttaaaaagtttaaccgttaaggttaggggaaccggtttaacccggttacccgggttaaggggaaacccggggttaacccgttaaccttttaccccgtaacccgtaaccgtttaccccgtaacccggtaaaggtaaacccggtaaaccctaacccgtttaaacccggaaaacggtaaaccggttaacgggttaaccgttaaacgttaccggtaacgtaaaccgtaaaagggttacccgaaaaccggtaaccggtaccgttaaacgggaaaccgggacccggtaacccggggtaaacgggtaccccggtaacgggtaccggtttgggttaaacccggg

SEQ ID NO: 94657 - DNA, 760 bp, Homo sapiens
  misc_feature: GYAE6OF01CHU28.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagtcgttgggttttcctcgttgtcttcttttaaaggaggtcgtccagttgtcgagggtgactaacgtggtagggagtcggtaggggggaggtcgttcggtccgaggtccgtggggacgtccctggacgtacctctcctggtcgcgaggtcgttcgtggtacttccgaccgtttcgaggacgtcgtatcggacagtccgacgtaccggttcgggtcccgaccggtacgggtcctaacccggacggggacggaaacgggggtccggtaggggtaggggttcggggtaggtacgttaagggtttaacgtaggttagggttaagttaggtaaggtttaaggggttaaagtttaaagttaaaagttacgttaaggtaagggaacgtacggttacccgggtagggtaaccgggtacctacgtttacccgaaccttaccgtcgtacccgaaggtaacccgtaaccgtaacccgttaaccgaaacgtaacggtaccggtaacgttactaccgtaagtaacgtaaacgtacgtaaaccgacggtaccgtagacgacggaccggaaggacccgacggtcgtggttaacg

SEQ ID NO: 94658 - DNA, 845 bp, Homo sapiens
  misc_feature: GYAE6OF01ETDGS.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttcgttttaagaggtgtccagtgtcgaggtgcaacgtggtgagtcgtgggggaggcgtggtccagccgtgggacgtccctggacgactctcctgtgcaggcgttccgtgggtactttccgtaccgttcgaagggacgtccgttaatcggaacctaagttcggaccctaaccgggttccggggtccccgacccggaagggtccccttacccggaacgggtaccgggaaacggggggttcccgttagggggacggggtttacggggggtcgggaaccggtttaaggtttaacgttaagggttaggggtttaacgttaggtaacggttaagggttaaagtttaaacgttaaaagttaaccgtaaggtagggtaaccggtaccgttaaccggggtaaggtaaaccgggggtaccgtaacgtttacccgaacccgtacgtttaacccgacccgtaagggaacccgtaaacccgtttaacccgttaaacccggtaaaacggtaaccgtaaccggggttagttacttaacccggtacgtaaacctaaaacgggtcgtaaaaccgaccggtaacccgtaggggaaacccggtaccggggtaacccgggaaacgggtaaacccgggtccggttaacggttgggtttaaccgg

SEQ ID NO: 94659 - DNA, 823 bp, Homo sapiens
  misc_feature: GYAE6OF01ES5P7.11.81.H04.1.454.CMB.1.raw
tcagcgagagataccacgaccggtgctcgatttagtagtgtagattcgcggggctgccctttggctttggagatggtttttctcgatgagctcgtgggagaggagcccagcactagaagtcggcggtgtttccattcggtgatcagcactgaacacagaggactcaccatggtagtttggctgagtcgttgggttttcctcgttgtcttacgttttaaggaggttgtccaggtgttcgaggtcgacgtaacgttgggtaggtacggttcgggtgggggggtaggtccggttcgggttaccgagggtcccggttagggggtaccgttccctaggtacgtaccttcctccgtaggtcgctaggtcgttcgaggtactttccgaccgttaggaggtcgtactagtacgactagtcggaccgtacggttcgggtcccaccggaggtccctaacggacggggtaacgggaacggggtcgtaggggtacgggttacggggtacggtaacgtttaaggtttaatagggttagggttaagtagggttaagttaaggggttaaatttaaagttaaagttaccgttaaggtaccgggtaacgttaacccggtacgggtaacgggtaacggttacccgtaactttaccgaacccgttactaccggaacctaacgggtaacccttaaccgtaaccgttaaccccgaaaaggtacccgttaacggtacttacgttacggtaactaaacgtaaacgtaacggtaacgaccggttaacaacgggtaacgaaccgggaccgggtaacggtaacggtcccggttaggttaacgttacggg

SEQ ID NO: 94660 - DNA, 664 bp, Homo sapiens
  misc_feature: GYAE6OF01CEZVZ.11.81.H04.1.454.CMB.1.raw
  modified_base (196)..(196): a, c, t, g, unknown or other
  misc_feature (196)..(196): n is a, c, g, or t
  modified_base (353)..(353): a, c, t, g, unknown or other
  misc_feature (353)..(353): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttccncgttgcttcttttaagaggtcgtccagtgtcaggtgacaacgtggtggagtcggtgggggagcgtggccaggccgtggggacggtccctggagacctctcctgtgcagcgtctggattcaccttcgaggacgtctatgacatgctacgtcgggtccncgaggctcgaggcgaaggggctggagtgggtgcgtagttatagtggtatgtagtaggtaagttaataaagtacgtagtaggacgtaccgttacggtaggtaacggggtaccctaacgtttccaaccgtacgttacccgtaccgaacggtacgtaacccttaacccgttaaccgaaacggtaaccgtaccggggtttagtaaccgttcgtaacgtaacccgaaagtaccggaaaccacgggttaccctaagggaacccggtaacggacccgggtaacggtaaccggacccgggttcgttacgggttaaccgg

SEQ ID NO: 94661 - DNA, 642 bp, Homo sapiens
  misc_feature: GYAE6OF01ARDIU.11.81.H04.1.454.CMB.1.raw
  modified_base (195)..(195): a, c, t, g, unknown or other
  misc_feature (195)..(195): n is a, c, g, or t
  modified_base (238)..(238): a, c, t, g, unknown or other
  misc_feature (238)..(238): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttccncgttgctcttttaagaggtgtccagtgtcaggtgcaacgtggnggagtcgtgggggaggcgtggtccagccgtgggaggtccctgacgactctccgtgtacgcgagcgtcgtggacttccacttcgaggactctatcgacatgcacgtcggtccgccgaggcctccgaggaccgaaggggtctagggacggtggggtcgacgtaggttagtacgttggtagtagtagttagtaaagtttaataaattacgtagtacggacgtacgtacggtaggaacggtccgtaagttaccaacgtacgttccgaaccgaacggtacgtaaacccgtaccgttaaccgaaagtaaccgtacggtacgtacgttaccgtagaaccgtaaagtcgaaacgtacgccgttaacggaacggaccggtaaccgggacggaaccgtacggtcttcgggtacg

SEQ ID NO: 94662 - DNA, 705 bp, Homo sapiens
  misc_feature: GYAE6OF01CCL0E.11.81.H04.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (305)..(305): a, c, t, g, unknown or other
  misc_feature (305)..(305): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagagactcaccatggtagtttgggctgagtcgttcggtttcctcgttncttacgtttaagnggtctccagttgtcgaggtgaccgtaagtgggtggtaggtcggtgggggggagtccggttcggtccgacggcccgtggggacggttcccnggacgtactctcctgtgcagcgtgtggtacttccgtacctttacggaggtacgtctagtagtaacgtagttcgctaccggttcgggtccccgaaccggacggtcccgtaccgggaacggaccgggtaaacggggtccgtaggggtacgggtggggtacgacggtttaagttagttaggtacgtagtaggtagtagggttaaagttaataaagtcgtaagcggtaaacgtcgtaccggtaacgggaacgtaccgtacgtactacctactaccgtacgaagacctacctacgttaaaccgaaccgtaacggtcgtagtacttacgacgtaaataacgtacgaacgacgtacccgtagaacggtaccggaccggacggtaccgacggttggttagttaaccgg

SEQ ID NO: 94663 - DNA, 740 bp, Homo sapiens
  misc_feature: GYAE6OF01A14M3.11.81.H04.1.454.CMB.1.raw
  modified_base (730)..(730): a, c, t, g, unknown or other
  misc_feature (730)..(730): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagagactcaccatggagttggcgtgagtcgttcgggttttcctcgttgtcttcgttttaagaggtcgtccagttcgtcgaggtcgactaacgtggtggagtcggtgggggaggtcgtcggtccgacgtccggtgggacggttcctggacgtactcctcgtgtcgctacggtcgttcgtagtaccttaccgtaccgttcgagggacttccgtaagtcgaacgtcgttacgccgttaaccggtccgggttaccccggaccggtacggtacccgtacggacgggtaacgggtaacgggggtcgtacggggagggttcgggtaggacgttagttagtcggtaaggttgtacgtaggttaacggttaaattaagttaaatacgttaaggtacggtaaccgtacggttaccggtaacgggttaacggaccgttaactacccgtaacttaccgtaccgtacgtaaacgtaccgtaaccttacccgtaaaacccggtaagtaaaccgtccgtagtaccttaggactaaaccgaagttacaacgtacctcggtacggaagtaaccggcggaaacgccgtaacggngttaggtacg

SEQ ID NO: 94664 - DNA, 620 bp, Homo sapiens
  misc_feature: GYAE6OF01CLPBR.11.81.H04.1.454.CMB.1.raw
  modified_base (370)..(370): a, c, t, g, unknown or other
  misc_feature (370)..(370): n is a, c, g, or t
  modified_base (397)..(397): a, c, t, g, unknown or other
  misc_feature (397)..(397): n is a, c, g, or t
  modified_base (408)..(408): a, c, t, g, unknown or other
  misc_feature (408)..(408): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttcgttttaagaggtgtccagtgttcaggtgacgaacgttgggtggagttcggtgggggggacggcggttcgggtccaggcccgtggggacggtccctggacgtactctacctgtgcagcgtctggacttcaaccttcgaggactctatgacagtgacacgtgggccncaggctcgaggcgagggctggagtggnggctagtttanagtgtagtgtagtagggtaattataaatacgtagtacgggagtacctccgggtaggaaccggtacgtaacttccgaactcgttctaccgaagtacgtaacctacgttaccaaacgtaaccgtacgttagtaactacgtacgaagtaaacgtacgtaaacgacgtcccgtaggaacgacggtaccggaacgaccgacggtcgttggttaacgg

SEQ ID NO: 94665 - DNA, 757 bp, Homo sapiens
  misc_feature: GYAE6OF01A5ALA.11.81.H04.1.454.CMB.1.raw
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttcgttttaagnggtgtccagtgtcgaggtncgaacgtggtggagtcggtgggggagcgtggtccagccgtgggacgtcctgacgtacctcgtcctgtcgcgagtcgtgtggtacttccgaccgttcgaggacgtctagtcgactagtcgcgacggttcgggtccctcgacgggtcctccggacgggtacggaagggggtcctaggggaaggtcgggggtacgtacgttaacggtttaagtaggttagggttagttagggtaacgtttaaggggtaaacgttttaaagttaaaaacttaacgggttaagtacgggtaaacgggtaacccgttaccgggttaaacgggaacggggtacccgtaacgtttaccgtaaccgtaacgttacccgtaacgaacggtaaccggtaacccttaaccggtaacccgaaaggtaacccggtacggttacgttaacgtacgtacggaaactaaaaccgttggaaacccgtcggtaccggtaacggacgggtaacggacccgaacggggtacccgtgggtaccgtttggttaacgg

SEQ ID NO: 94666 - DNA, 644 bp, Homo sapiens
  misc_feature: GYAE6OF01D9FKI.11.81.H04.1.454.CMB.1.raw
  modified_base (361)..(361): a, c, t, g, unknown or other
  misc_feature (361)..(361): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttacttttaaggaggtgtccagtgtcaggtgcaacgtggtggagtcgtgggggagcgtggtccagccgtgggacggtccctgacgtactctccgtgtcgcgagtccgtcgtggtacttcaccgttgaggatctagtgactatgctacgtcgggccgccnggcctaccgaggcggaagggcgtagggaggtggggtcgacgtaagttacgtagttggtaagtaggtaagtagggtaaacgtttaagttaaaagttactaaggtaggtaacgtaccgtaccggttaggaaccgggtcctaacgttccgaacccgtataccgtaccgaacgtacgaacccgttaaccttaaccgaaacgaaccgtacggttagtacgtcgtacgaactaaagtccgaaacgcgtccgtagaacgacgtaccggacgaccgacggtgtcggttaag

SEQ ID NO: 94667 - DNA, 836 bp, Homo sapiens
  misc_feature: GYAE6OF01C7RJ2.11.81.H04.1.454.CMB.1.raw
tcagcgagagataccacgaccggtgctcgatttagtagtgtagattcgcggggctgccctttggctttggagattggttttctcgatgagctctgggagaggagcccagcactagagtcggcggtgtttccagttcggtgatcagcactgaacacagacggactcaccagtggtaggtttggcgtgagtcgtttgggtttttccctcggttcgtacttacgttttaaggaggttcgtccgtaggttgtaccgaggttcgacgtaacgtggggtacggtaggttcggggtagggggggtacggtcggttcgggtaccgaacggtcccggttaggggggtaaccggtccccgtaggtaaccgtaccgttcccgttccgttaggtcgacgacggtccgttacggtcggtaacttcctaaccgtttccggaagggtacgtaccttagtacggaacctagtccgtaccgtacggtccggggtcccgaccgtacgggtcccgacggacgggtaccggaaacgggggtcgtaggggtaggggttggggtacggtacgttaaggtttacgtaggttgggtaagttaggtaagtttaaagggttaaagttaaagttaaacgttaagtaggtaacgggtaacgtaccgttagggttaacggaacgggtaccttaacgttccgaaccgtcgttaccaacgtaacgtaaccgtaactaaccgttacgaaaacgtacgttacggttagtacttacgaacgtactaaagtaccgaagtacggtaccgtaacggggtaacgaccgggtaaccgggaacggtaaccgtccgggtaccggtttggtaaacccg

SEQ ID NO: 94668 - DNA, 669 bp, Homo sapiens
  misc_feature: GYAE6OF01EDQ6Q.11.81.H04.1.454.CMB.1.raw
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
  modified_base (402)..(402): a, c, t, g, unknown or other
  misc_feature (402)..(402): n is a, c, g, or t
  modified_base (431)..(431): a, c, t, g, unknown or other
  misc_feature (431)..(431): n is a, c, g, or t
  modified_base (474)..(474): a, c, t, g, unknown or other
  misc_feature (474)..(474): n is a, c, g, or t
  modified_base (516)..(516): a, c, t, g, unknown or other
  misc_feature (516)..(516): n is a, c, g, or t
  modified_base (579)..(579): a, c, t, g, unknown or other
  misc_feature (579)..(579): n is a, c, g, or t
  modified_base (609)..(609): a, c, t, g, unknown or other
  misc_feature (609)..(609): n is a, c, g, or t
  modified_base (648)..(648): a, c, t, g, unknown or other
  misc_feature (648)..(648): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagagactcaccagtggagtttggctgacgtcgtttcgggtttttcctcggtttgtacctttacgttttaaacggaggttcgtacctaggttcgtcgaaggtgactaacgtgggtaggacggtcggtggggggaggtccgtcggtccgagtccggttacggggtacggttccctaggaccgtacgttccgttcgngtacggcgtacgtccgttntaggtaccttacctaccgttgaaggtactcttaancgaacagtcgaccgtacgtccgggtaccncgagccgtaccgaaggtacggaacgggtcgtggaggttggggntacaagtttagagtaggtaatagagtaaggtaacgtttaaanaagtagtaagaggaacgtaccgtcgggtagaccggtctagtcccactacgtccaagacgaacncgtaaccttaagaaccgtagacgttcgtanacgaagacctaaagacacgtactacgaggacgaccgganaacgcgtagtcgtagttaacg

SEQ ID NO: 94669 - DNA, 922 bp, Homo sapiens
  misc_feature: GYAE6OF01DMXOS.11.81.H04.1.454.CMB.1.raw
tcagcgagagataccacgaccggtgctcgatttagtagtgtagattcgcggggctgtccctttggctttggagattggttttctcgatgagctcgtgggagaggacgcccagcaactagaagtccgggtcggttgtttccattcggtgactcagcaactagaacacgagaggacctcaccagtggtaggttggctgagtcgtttcgggttttcctcgttcgtctttacgtttaggacggttcgtaccgtaggttcgtacgaggtacggaccgtaacggttggggtacggtacggttcggggtaggggggtacggtcgggttaccggtccgacggtaccgggttcggggtaccggtcccgtaggtaaccgtcccgttccgttccggtgtacggtccgtcggttccggtacggtacggttaccttaccgtaccgttacggacggtactactagtcgaactagttccggaccgttaccggttccgggacccgaccggtaccgggacccggttaccgggaaccgggggtagggaaccggggtggttacgggggtacgggttacggggtcgggtaacgtttaaggtttaaacgtttagggttaagggttaaggttaacgggttaaggttaaggtttaaaacggtttaaacgtttaaaaggttaaacgttagggttaaccgggttaacggttaaccgggtaaccgggttaacgggtacgggttaccgttaaccgttaacccgtaaccggttacctaaccggtaaccgtaaccggtaaaccgtaccgtaaaccgtttaacccggaaacgttaacccggtacgttaacgttacgttacgaaacctaagtaaacgtaccgtaacgtaccggacgtacgggaacggaaccggtaccgggaacggaacccggtcgttaacggttaggttacgg

SEQ ID NO: 94670 - DNA, 845 bp, Homo sapiens
  misc_feature: GYAE6OF01BKWDA.11.81.H04.1.454.CMB.1.raw
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
tcagcgagagataccacgaccggtgctcgatttagtagtgtagattcgcggggctgccctttggctttggagatggttttctcgatgagctctgggagaggagcccagcactagaagtcggtcggtttttccattcggtgatcagcactgaacacagaggactcaccatggtagtttgggctgagcgttgggttttcctcgttgccttcgttttaagaggtgtccagttgtcagggtcgctaacgttgggtggagtcggtggggggaggcgtggtccaggccgtgggacggtccctgacgtacctctcgtgtcgcnggcgtcgtaggtnttcctaccgttcgaaggctaccgttagtcgaactagtcgtcgtaccggtcggggtaccccgccgacggtcctaccggaaggggtaccggaacgggggggtcgtggggtaagggtttcggggggtacgggtaaccgttaaaggttttaacgtaagttacgggggttaattacgggaagtttaagggttaaaggttttaaacgttaaaacgtttaacggttaaacggttacggggtaacggttacccgttaaccggggtaacgggtaaccggggttacccgttaacttaccccaacccgtacgtttaccccgtaaccggaaccgtaaccgtaaccctaaccgtttaacccggaaaccgttaaaccggtacgggttacgttaacgttactacgggtaaaactaaacgtaacgtaaaccgtacggtacccggtaaacggaaccgggaaccgggaaaccccgggtaacggggtaacccgggaaaccccggtttcggtttaaagggtttcgtttaaaccggg

SEQ ID NO: 94671 - DNA, 910 bp, Homo sapiens
  misc_feature: GYAE6OF01DNX1K.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgctcttttaagaggtgtccagtgtcgaggtgacaacgtggtggagtcgtgggggagcgtggtccaggccgtggggacggtccctgacgtacctcttccgtgtcgcacggtcgtacgtgggaactttccgaacctttcgaaggacgtccttaagtggaacctaagtcggtaccgtacgttcggggtccccgccgaaggggtcccttacccggaagggtaccggaaaaggggggtcctacgggggtagggtcgggggttacgggtacgtaaagggttttaaagtaggtttacggggttaacttagggtaaacggtttaagggggttaaaaggtttaaaaccgtttaaaaaagttaccggttaaaggtttaacggggtaacggtaaacccggtttccgggggttaacggaaaccggggggtacccttaacgttttaccccgaaaccccgtaagttccccgttaaccggaaacggtaaaccgggttaaccctaaaccccgtttaaccgggtaaaacggtaaacccggttaccggggtttaaaggttaacccttaccgggttaaccgggtaaaacctaaaaggttaccgggtaaaaaccgtaaccgggttaaccccggttaaacgggaaacccgggtaaaccggtaaaccccgggggtaaaacgggtaaccccgggtaaaccgggttccccggtttaaggggttttaaacccggg

SEQ ID NO: 94672 - DNA, 775 bp, Homo sapiens
  misc_feature: GYAE6OF01BSD9U.11.81.H04.1.454.CMB.1.raw
  modified_base (132)..(132): a, c, t, g, unknown or other
  misc_feature (132)..(132): n is a, c, g, or t
  modified_base (144)..(144): a, c, t, g, unknown or other
  misc_feature (144)..(144): n is a, c, g, or t
tcagcgagagataccacgaccggtgctcgatttagtagtgtagattcgcggggctgccctttggctttggagattggtttttctcgatgacgctcgtgggagaggacgcccagcactagaagtcggtcggtnttccattcggtnatcagcactagaacacagacggactccaacgtagtgggtagtttgggctggtacgtcgtttcggggttttcctcggttcgtacgtttacgtttaaggacggtcgtcctagttcgtagtacggtgactaacggttgggtcgggtaggtcgggtggggggacggtccggttcggtacccgtaggtcccggtacggggtaccggtcccgtaggaccgtaccttccgttcgtaggtcgcccgtagggtcccgtacgtcggtacttacccgtaccgttcggaaggtctacgtagacgtacctagttccgacgtcggttccgggccaccggtcggaccacgggtacggcggtacggggtgtacggggtcgggtggtacggtacgttagttacgttagggttgtaacggtggttaaggtaacggttaaagttaaacgttaagtaacggttcgtaggtaccggtaccgtggtaccgggtaacgtaccgttactccgtaacctaccgttacacgtaacgaacctaccgtacgtaaacccgtaaggtacgtacgtactacgtacgtaacgactaaggtaacccgtagtaaccgtagaccgaaggaccgtaacggacggtaccgtaggtctcgtttaacggg

SEQ ID NO: 94673 - DNA, 682 bp, Homo sapiens
  misc_feature: GYAE6OF01EBV7D.11.81.H04.1.454.CMB.1.raw
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
  modified_base (611)..(611): a, c, t, g, unknown or other
  misc_feature (611)..(611): n is a, c, g, or t
  modified_base (616)..(616): a, c, t, g, unknown or other
  misc_feature (616)..(616): n is a, c, g, or t
  modified_base (634)..(634): a, c, t, g, unknown or other
  misc_feature (634)..(634): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccagtggagtttggctgagtcgttgggttttcctcgttgcttacttttaagnggtgtccgagtgtcaggtcncaacgtgggtggaggtcggtagggggacggcgtcggtccaggtccgtggggaccgtccctagacgtaccttcctcgtgtcgcagtcgtcgtggtacttcccgtaccgttgaggtacgtctagtgaactagtcgaccgtacgtcgggtacccacgacggtcctaccggacggacggaacgggtccggtagggtacgggtgggtacggtaacgttaaggtttacttagggttacggttaagtagtaagttaacgggttaaatttaaacttaaagtaacgtaggtacggacgtacgtaccggtaaggaaccggtctactccaactctaccacgaagtaccaacgtaccttaaccgaaacgtaccggtacggtattacncgtanaaccgtaaagacgtaacncgtcgtaaggacgaaccggaccggaagacccgtacggtcgtagttacg

SEQ ID NO: 94674 - DNA, 751 bp, Homo sapiens
  misc_feature: GYAE6OF01A8S2Y.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttcttttaagaggtgtccagtgtcgaggtgcaacgtggtggagtcgtggggggaggcggtggtccaggtccgtggggacggtccctgacgtcctctccgtgtcgcagcgtctggtacttccaccgttcgagggtactctagtgactagtcgacgtacggtccgggtacccgccgacggcccgtaccggacgggtaccggaaacgggggtcgtaggggaacggggttggggtggtacgttaaggtttacgttaggttagggttaagtaggtaaggttaacgggttaaagtttaaacgttaaaagttacgttaaggtacggtaacgttaccggtaccgggtaagggtaaaccgggtacccgtaacgtttacccgaaccgtacgttaccgtaccgtaacggtaaccgaaccttaacccgttaaccgaaaacggtaaccgtacgggttagtaactaccgtacgaaaccgtaaacgtaaccggaacgtacggtacccgtaaggaaccggtaacggaaccggaacgggacccggtaacggtcgttagggttaacg

SEQ ID NO: 94675 - DNA, 637 bp, Homo sapiens
  misc_feature: GYAE6OF01A4H8L.11.81.H04.1.454.CMB.1.raw
  modified_base (194)..(194): a, c, t, g, unknown or other
  misc_feature (194)..(194): n is a, c, g, or t
  modified_base (211)..(211): a, c, t, g, unknown or other
  misc_feature (211)..(211): n is a, c, g, or t
  modified_base (328)..(328): a, c, t, g, unknown or other
  misc_feature (328)..(328): n is a, c, g, or t
  modified_base (356)..(356): a, c, t, g, unknown or other
  misc_feature (356)..(356): n is a, c, g, or t
  modified_base (422)..(422): a, c, t, g, unknown or other
  misc_feature (422)..(422): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttggctgagctgggttttccncgttgcttcttttaagnggttgtccagtgtcgaggtgctaacgtggtaggagtcgtgggggagcgtgggtccagccgtgggacgtccctgacgtactctccgtgtgcagcgtcgtggacttcaccttgacggtnctatgacagtcgccgtacgtcgggtccnccgtaagggccctaccgacggtacgaagggggcttaggggaaggttcgggtacggctaaggtttanaggttagggtactggtagttaggaaagttaagtaaactagtagtacggaacgtacgtaccggtaggtaacgggccgtacttcgaacctacgtccgtacaacggtactaaccgtaccttaaccgaaacgtaacgacggttagtacgtactgaaccgtaagtcgaaaccaggccctaggtaaccgacgacccgaggaaccaccgggcgttagttacg

SEQ ID NO: 94676 - DNA, 647 bp, Homo sapiens
  misc_feature: GYAE6OF01BBA9T.11.81.H04.1.454.CMB.1.raw
  modified_base (231)..(231): a, c, t, g, unknown or other
  misc_feature (231)..(231): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtnctaacgtggtggagtcgtgggggagcgtggtccagccgtgggaggtcccctggacgactcctccgtgtcgcagcgtcgtggactttccacctttagaggagtctatgacagtcgcacgtcggtccacgacggcctaccgaggccgaaggggtctagggtaggtgggtcgactaggtttatagttggtagtaggaagttaggtaaagttaattaaagttaacgtagtaggtacgtaccgtaccggttaggaacgggtaccgtacgttacccgaactaccgtcctaccgaacggtacgaccgtaaccttaccgaaacgtaacgtacggttagtacgttacctaagaccttaaagacgtaacgacggtacgtacggacgtaacggacccgaaggacccgtaccggtcgttacggttacg

SEQ ID NO: 94677 - DNA, 796 bp, Homo sapiens
  misc_feature: GYAE6OF01BJGNV.11.81.H04.1.454.CMB.1.raw
  modified_base (268)..(268): a, c, t, g, unknown or other
  misc_feature (268)..(268): n is a, c, g, or t
tcagcgagagataccacgaccggtgctcgatttagtagtgtagattcgcgggctgccctttggctttggagattggtttttctcgatgagctctgggagaggagcccagcactagaagtcggcggtgtttccattcggtgatcagcactgaacacaggaggactcaccatggagtttgggctgagtcgttgggtttttcctcgttgtctttcttttaaaggaggttcgtccgtagttgtcgaggtcgacgtaacgtggtggagttcgngggggagtcggtgtccgagtccgtgggacgtccctgacgctctcgtgcgcgagtcgtcgtggtacttccgaccgtttacgaggtacgtacgtagtacgactagtcgacgtacggtcgggtacccaccgacggtccgtaccggaacgggtcggtaaacggggtccgttaggggaacgggttcggggtacggtacgttaagggtttaagttaacggttaggggtttaagttagggttaaacgtttaaggggttaaaagttttaaagttaaaaagttaaccggtttaaggttacgggtaaacggttacccggttaaccgggttaagggaaacccgggttacccgttaacgtttacccgaacccgtaacgttacccgaaccgtaacggtaacgtaaccctaaacccgttaacgaaacccgttaaccggtacggttagtaaccgttcgtaaacgtaaacgtaaagtaccgtaacgtacggtaccctaggacggtaaccggacggaacggtaccgacggtacgttgttaaacgg

SEQ ID NO: 94678 - DNA, 795 bp, Homo sapiens
  misc_feature: GYAE6OF01APQ08.11.81.H04.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (351)..(351): a, c, t, g, unknown or other
  misc_feature (351)..(351): n is a, c, g, or t
  modified_base (405)..(405): a, c, t, g, unknown or other
  misc_feature (405)..(405): n is a, c, g, or t
  modified_base (522)..(522): a, c, t, g, unknown or other
  misc_feature (522)..(522): n is a, c, g, or t
  modified_base (757)..(757): a, c, t, g, unknown or other
  misc_feature (757)..(757): n is a, c, g, or t
tcagcgagagataccacgaccggtgctcgatttagtagtgtagattcgcggggctgccctttggctttggagattggttttctcgatgagctctgggagaggagcccagcactagaagtcggcggtgtttccattcggtgatcagctactgaacacagagactcacatggtagtttgggctggacgtcgtttgggttttccncgtttcgtctttacgtttttaaaggnggttgtcctaggtgttacgtagggttcgtacaacgttggggtacggaggttcggtggggggggtagccggttgggtccccaggtccggttcggggcgtcccgtaggagttccctcgttaccgnggtcgacctacgcggttactcggactttcccgtacgttcggagtacgtctttanacggatacgttccacggtacgttccggccgccgaggtcctaccggggaaaggttcgggaacggggttcgtagggggttacggttccgggggtagttaaccgttaaaggggtttttangggtttaagggtttacgttagggttaacggttaagggtttaaggtttaaacgtttaaaacgttacgggttaagggtacggttaaacggtacccgggtttttaccggaacgggtaaccggttacccggttaacttacccgtaacggtaactccgttaacggtacgtaacgtacccgtaaaccttaccggtaactaacggtacgttacgtactgtacgaacgttaacgagtaccganggtacaagacgcgacggaactcggttaactggttaacg

SEQ ID NO: 94679 - DNA, 648 bp, Homo sapiens
  misc_feature: GYAE6OF01EDP6C.11.81.H04.1.454.CMB.1.raw
  modified_base (196)..(196): a, c, t, g, unknown or other
  misc_feature (196)..(196): n is a, c, g, or t
  modified_base (305)..(305): a, c, t, g, unknown or other
  misc_feature (305)..(305): n is a, c, g, or t
  modified_base (358)..(358): a, c, t, g, unknown or other
  misc_feature (358)..(358): n is a, c, g, or t
  modified_base (625)..(625): a, c, t, g, unknown or other
  misc_feature (625)..(625): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagagactcaccatggagtttgggctgagtcttgggttttccncgttgcttacttttaagaggtgtccagtgtcaggtgcaacgtggtggagtcgtgggggagcgtggtccagccgtgggacgtccctgacgctctccgtgtcgcaggcgtntggacttccaccgttgaggtacgctagtgaacagtcgcgtacgtcgggtcccncgacggtcctaccggaggacgaacggggctggggaggtggggtcgacttagttttattcaagttagtgtaagttaggaaattaggttacgtactttctaacttcgaacgttaccttccgggtaggaaccgggtcccgtaagtttcccgaccgttcctacgaaggtaacgtaacctaaccttccgaacggaccaaccgtaccggtaccgttagacgttaccgtagtaaccgtaaatacggaacctacggtcccgtaagaccggtacgngtacgggaacgtacccgtacggg

SEQ ID NO: 94680 - DNA, 715 bp, Homo sapiens
  misc_feature: GYAE6OF01AP53F.11.81.H04.1.454.CMB.1.raw
  modified_base (265)..(265): a, c, t, g, unknown or other
  misc_feature (265)..(265): n is a, c, g, or t
  modified_base (314)..(314): a, c, t, g, unknown or other
  misc_feature (314)..(314): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagtcgttgggtttttcctcgttgtcttcgttttaaaggaggttgtccagttcgtcaggtgcaacgtgggtggagtcgtgggggnggcggtcggtcgaggcctgggaggtccctgagctctcctgtgcagcgtntggtacttcacctttcgaggacgtctatgacagtcgctacgtggggtcccgccgacggccttccgagggcgaacgggggtcgtagggtagggtcggggtgggcttagggtttatacggttaggggttagtggtaaggtttaaggggtaaacgtttaaagtaaaagtttaacgttaaggtagggtaacggtaacccgttaccgggttaagggaaccgggttacccggtaacgtttacccaaccccgttacgtaccttacccgaacggtaaccggtaacctaaccttacccgaaacgtaacctacgggtagtacctcgtagtaactaaacgtcggaaacccacgtcccggtaaggaaggacgggaacccggacgggaacccgtcgggtcgttcggtttaacgg

SEQ ID NO: 94681 - DNA, 837 bp, Homo sapiens
  misc_feature: GYAE6OF01DK1JL.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccagtggagtttgggctggagtcgttgggtttttcctcggttgtcttacgttttaagaggtgtccagtgtcgaggtgacacgtggtggagtcggtgggggagtcgtggtcgacgccgtgggtacgtccctgacgacctctcgtgtgctacggcgtcgtaggtacttccgacctttcgaggtacgtcttacgagacctagtcgaccgtcggttccggggtacccgaccggtacggtaccgtacccggaacggggtacggaaacggggggtcgttaggggtaggggttacgggggttcgggtaaccgtaagggttttaaattacgggttagggtaagtttacgggtaaaggttttaacgggttaaaagggtttaaacttaaaacggttttaaccggtaaagtttaagggggtaaccgttaaccggttccggggttaaaccgggtaaccgggggttacccgtaacgtttaaccccgtaacctaaccggttacccgtaaccgtacggtaaacccgttaaccgtaacccgtttaaacccgaaacggtaaacccgttagggttacgttaaccttcggtaaccgaaacgttaaaccggtaaaggaacccgttacggccgttaagggaaaccggaccggaccgggaaacgggaccttaccggggtagtttcgggttaaacg

SEQ ID NO: 94682 - DNA, 831 bp, Homo sapiens
  misc_feature: GYAE6OF01EZ5Z2.11.81.H04.1.454.CMB.1.raw
  modified_base (273)..(273): a, c, t, g, unknown or other
  misc_feature (273)..(273): n is a, c, g, or t
  modified_base (348)..(348): a, c, t, g, unknown or other
  misc_feature (348)..(348): n is a, c, g, or t
  modified_base (373)..(373): a, c, t, g, unknown or other
  misc_feature (373)..(373): n is a, c, g, or t
  modified_base (398)..(398): a, c, t, g, unknown or other
  misc_feature (398)..(398): n is a, c, g, or t
tcagcgagagataccacgaccggtgctcgatttagtagtgtagattcgcggggctgccctttggctttggagatggttttctcgatgagctctgggagaggagcccagcactagagtcggcggtgtttcattcggtgatcagcactgaacacagagactcaccatggtagtttgggctggagcgtttcgggtttcctcgttagtcttacgttttaagcggttcgtccaggttcgtacgaggtcgacgtaacggtgggttacggacgttcgggnggggggtacgtccgttcgggtccgtacggtccgtcggggtaaccggtccctggtacgtaccgttctccgtggtcncgtacggcgttcgtggtacgttacnccgttacggagggtactaccgttanacggtaacctaagtccgtaccggtaccggttccgggtaccccgtaccggtaggtccccgtacccgggtaacgggtaaccggtaagggggttaccggtaggggtacgggttggggtacggacgtttagttaacgttaggtacgttagttacggttacgttaagggttaaagttaaagttaacgttaagtaacggttgtaacggtacccggtacgggtaacggaacggtccgtaacgttacccgaccttaacgtaccgtaccgtaacgaccgtaacccgttaaccgttaaaccggaaccgttaacgtaccgggtacgttaccgttacggttaaccaaaccggttaaaacgtcggtaaacctaacgggttacccgacggaaacccgtccgggtaaaccggtacgtaaaccgttagggccggttaccgtttaacggg

SEQ ID NO: 94683 - DNA, 643 bp, Homo sapiens
  misc_feature: GYAE6OF01AV4O4.11.81.H04.1.454.CMB.1.raw
tcagcgagagataccacgaccggtgctcgatttagtagtgtagattcgcggggctgccctttggctttggagatggttttctcgatgagctctgggagaggagccccagcactagaagtcggcggtgtttccattcggtgatcagcactgaacacagaggactcaccatggagtttgggctgagctgggttttcctcgttgctcttttaagaggtgtccagtgtcaggtgcaacgtggtggagtcggtgggggaggcggtcggtccaggcccgtgggacggtccctgacgacctctccgtgtgcgagcgtctggtacttccaccttcgagggtacgtccttataggactagtcgccgtaccggttcggggtcccgaccgagggccctaccggagggacgaacgggggtcgtgggtagggtggggtcggtacgtaaggtttatagttgggtagtgtaaggtaggtaaatttaagtaaattacttaagtaggtacgtaccgtcgggtacggtaacggtaccgtaatcccgactactacctacgagtacgacctaccttaccgaacgtaaccgacggtatactcgagtacgtaactgaactacggccgtagaacgacggaccggaacggacgccggttgtggtacg

SEQ ID NO: 94684 - DNA, 812 bp, Homo sapiens
  misc_feature: GYAE6OF01DBYA2.11.81.H04.1.454.CMB.1.raw
  modified_base (184)..(184): a, c, t, g, unknown or other
  misc_feature (184)..(184): n is a, c, g, or t
  modified_base (226)..(226): a, c, t, g, unknown or other
  misc_feature (226)..(226): n is a, c, g, or t
  modified_base (382)..(382): a, c, t, g, unknown or other
  misc_feature (382)..(382): n is a, c, g, or t
  modified_base (758)..(758): a, c, t, g, unknown or other
  misc_feature (758)..(758): n is a, c, g, or t
tcagcgagagataccacgaccggtgctcgatttagtagtgtagattcgcggggctgccctttggctttggagattggttttctcgatgagctcgtgggagaggagcccagcactagaagtcggcggttgttccattcggtgatcagcactgaacacagacggactcaccagtggtagtttgggntgagtcgtttcgggttttcctcgttgtcttacgttttaaggnggttcgtccgtaggttcgggtcgggtagtaccgtaacgttgggtagggacgggttcgggtgggggggacggtcgggttcgggttacccgaacggtccggtagggggtaccgttccccgtaggtacggtacctttccctccggttggtcggtaccgnggtccggtttcgtacggttaacctttacccgttacccgttcggaagggtacgtaccttagtacggactagtccgtaccgtaccggtccgggtacccgccggaacggtccgtaccggacggggaccggtaagggggtcgacggggtaggtgggggtaggtacggtttaagttaaggttacggttaggttatagggttaagtaaggttaaatttaagtaaacttaacgttagtacgggtacgttccggtacggttacgggaaacggtcccgtaacgtttcccaacgttaactccgtaccgtaaaggacccttaactcccgttaaaccgaaacggtaaccgttcgtagtacactacgaaactaaacggacgtaacgacnccggtaaggacccgacggaaccgggtacgacgtacggtcttggttaacggtacg

SEQ ID NO: 94685 - DNA, 881 bp, Homo sapiens
  misc_feature: GYAE6OF01CZC11.11.81.H04.1.454.CMB.1.raw
  modified_base (227)..(227): a, c, t, g, unknown or other
  misc_feature (227)..(227): n is a, c, g, or t
tcagcgagagataccacgaccggtgctcgatttagtagtgtagattcgcggggctgccctttggctttggagatggttttctcgatgagctcgtgggagaggagcccagcactagaagtcggcggtgtttccattcggtgatcagcactgaacacagaggactcaccagtggagtttgggctgagtcgttgggtttttccctcggttcgtctttacgttttaaaggngggttcgttcccgtaaggttgtacgtagggttgacctaacggttgggtagggtacggttcggtgggggggacggtcggttcgggtcccaaggtcccggtgggggtaacggtcccctggtaacgtaccttccgttccgttggtcggacgacggtcggttccgtacggtacttcccgtaccgtttcgaagggtacgtactagtcgaactagtcgaccgtaaccggtcggggttaccccgcgacggtcccgtacggacgggacggaaacggggtcgtaggggtagggtcggggtacggtacgtaaggtttacgtaggttacgggttaagttaggtaagtttaacggggtaaagttttaaaacgtaaagtttaacgttaaggttacgggaacgtttaccggtacccgggttaagggtaaccggggtacccgttaacgttttacccgaacccgttaaccgttaccgttaacccgaacgggtaaaccgtaaaccttaacccgttaaaccgaaaacggttaaccggttacggttacgttaaccgttaccgtacggtaaacctaaacggttaaccgaaaccggttaacgaccggttaagggaaaccgaccggggtaaccggaaaccgggtaacccggtaccggtggtttaacggtttaacgg

SEQ ID NO: 94686 - DNA, 874 bp, Homo sapiens
  misc_feature: GYAE6OF01EKL5I.11.81.H04.1.454.CMB.1.raw
tcagcgagagataccacgaccggtgctcgatttagtagtgtagattcgcggggctgccctttggctttggagatggttttctcgatgagcctcgtgggagaggagcccagcactagaagtcggcggtgtttccattcggtgatcagcactgaacacagaggactcaccagtggtagtttcgggctggagtcgttcgggtttttccctacggtttgtctttcttttaaaggaggttcgtccgagttggtcaggtacgcctaacgtgggtggacggttcggtggggggacggtcggtggtcccgagtccggtggggacggttcccctaggacggtacctccgttcccagggttcgaccgtaaggtcccgttcggtacgggtacctttcccaacccgtttaccggagggaacggtcctttaacgtgaacctacgtggcccgtacgggttaccggggtccccggaccgtaagggcccgttacccggtaaggggaccgggtaaacgggggggtccttaggggggtaaccggggttgggggttaccgggtaccgtttaaagggtttaacgttacgggtttaaggggtttaagttagggttaaagttaagggggtaaaaagtttttaaagttaaaaacggtttaaacgtttaaggtacgggtaaacggttaccggtttacccgggttaacggggtaaaccggggtaccccggttaacgttacccgtaaccccgtaaccttcccgtaacccgtaaggaacccgtaccgtaacccgtaacccgtaaaacggtaaccgtaacgggtaacgttactacgtacgtaacaagtacgaacgacgccgtaggaacgtcgaaccggtagaaccgcggttagtcggttacg

SEQ ID NO: 94687 - DNA, 867 bp, Homo sapiens
  misc_feature: GYAE6OF01DURVS.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagtcgttgggtttttcctcgttgcttacttttaagaggtgtccagtgtctaggtcgcaacgtggtggagtcggtggggggaggcggttcggtccaggcccgtggggacggttcccgtgacgtacctccttccgtgtacgcacggtcgtcgtcggtacttccgtaccgttcgacgggagtctagtgaacgtagttcgaccgtacgttccggggtaccccgccgaacggtccgtacccgaacggggtacggaaacgggggtcgtaggggtacggggttgggtacggtacgttaaggtttagttagttaggggttaagttgggtaaaggtttaaggggttaaaagttttaaacgttaaaaaacgtttacgtttaacggttaacgggaacggttaaccccgtttaccgggtaacggggtaaaccgggggttacccgtaaacttttccccaaaccgttccgttaacccgttaccgaaacggtaaccggtaaccctaacccgttaaaccccggtaaaacggtaaacccggttaccgggtttagttaacccgtttacgtacgaaacccgttaaaaaggtaacccgtaaaaccgtaccgggtaacccgtaaaggggtaacggaaaccccccgggtaacggaaaacccggggaaccccgttaaaccgggggttagtttacgggttttaaaacggg

SEQ ID NO: 94688 - DNA, 841 bp, Homo sapiens
  misc_feature: GYAE6OF01E4KXW.11.81.H04.1.454.CMB.1.raw
  modified_base (225)..(225): a, c, t, g, unknown or other
  misc_feature (225)..(225): n is a, c, g, or t
tcagcgagagataccacgaccggtgctcgatttagtagtgtagattcgcggggctgccctttggctttggagattggttttctcgatgagctcgtgggagaggagccccagcaactagaagtcggcggttgtttccattcggtgatcagcactgaacacagacgactcaccagtggtaggtttggctgagtcgtttggttttcctcgttgtcttacgtttaaggnggttcgtctagtgtcgaggtgcgtaacgtggtaggtacggtgggtgggggacgtcggtcggtccgacggtccggtggggaccggttccctaggacgtacctccgttccgtgtcggctacggtccgtcgtggtacttccgtaccgttacgaggtagtaccgtgtacactacgtcgtacgtacggttccgggtccgacgaccggtccgtaccggacgggtacgggtacgggtcggtacgggtgggtacgggtgtaacggttagttaagttggtttacggttagtaggttaaaggttaaggtttaaaacgtttaaattaaacgtttaaacggttaaggttaacggtaacgtacccggttacgggtaaccggtaaccgggtacccgtttactaacccgtaaccgttaccgttacccgaacggttaaccgtaacgtaaccccgtttaaacccgtaaaccggtaaaccgttaaccgggtaacggtttaaccttaacggtaccgttaacgtaaaccgtaaacggtacgtaaaaccggtacggtacccggtaagggaaacccggtacggggtaaaccccggaacggttaaacccgggtcggttaaccgtgggttttaaaccggg

SEQ ID NO: 94689 - DNA, 770 bp, Homo sapiens
  misc_feature: GYAE6OF01CS35W.11.81.H04.1.454.CMB.1.raw
  modified_base (305)..(305): a, c, t, g, unknown or other
  misc_feature (305)..(305): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggacctcaccatggagtttgggctgagcttgggttttcctcgttgcttcgtttaagaggtgtccagtgtcgaggtcgacaacgtggtggagtcggtgggggagcgtggtcaggccgtggggacgtcctaggacgtacctcttccgtgnggccaggtcgttcgtcggtacttccgaccttcgaggacgtctagtgaacacgtgaccgtacgtacggggtccctccggacggccgttacccggaaggggtaccgaaggggtcggtacggggtaagggttcggggtacggacgttaggttttaagtaggtttgggtaagttggtaaggtttaaggggttaaacttttaaagtaaaacgtttacggtaaaggtacgggtaaccggtaccggttaaccgggtaacgggtaaccggggttaccccttaacgttacccgtaaccccgtaagtttaccccgaaccggtaaggtaaccgtaaccccttaaccggtttaacccgaaaaggttaaacccgttcgggttactaacgttacgtacgaactaaacggtacgaaccaccgggtcgtaggaacggtaacccggacgggtaaacggccgtaacgggttcgttggttaacg

SEQ ID NO: 94690 - DNA, 933 bp, Homo sapiens
  misc_feature: GYAE6OF01BQ5N4.11.81.H04.1.454.CMB.1.raw
tcagcgagagataccacgaccggtgctcgatttagtagtgtagattcgcggggctgccctttggctttggagattggttttctcgatgagctctgggagaggagcccagcatagaagtcggcggttgtttccattcggtgatcagcactgaacacagaggactcactagtggtagtttgggctggagtcgtttcgggttttcctggttacgtcctttacgttttaaggacgggttcgttaccgaggttggttacgagggttacgaccgtaacggttgggtagggtaggttccgggtaggggggacggtcggtcgggtaccaggtccggttaggggtaccggttccctggtaacgtaccctttcgtccgttgggtacgtccgaggtccgttacgttaggtacctttaccgtacccgttaggaacggacgtcttaacgacgtacgtactcggaacgttccgggtccgggcccgacgaacggttcccgtaccggaagggtaccggtaacggggggttgtaccggggtaaggggttggggtaccggtagtttaacggggtttaatttaggttaaccggggttagttaccgggttaaggtttaaacgggttaaacgttttaaacgttaaaacgttaacggtttaacggttaacgggttaaccggtttaacccgggttaccggggtaacgggttaaaccgggtacccgtttaaccggttaccctaaaccgttaccgtttaacccgtaaccgtaaccggtaaaccgttaaccgttaaccccggtttaaacgaaccgggtaaacgttacgggttaacttacggtaaccgttaacgaaaccgttaaagaaccggtaaacccgtacggttaacggaacgtaaccgggtaacccggtaaccgggacggtaacccgttacggggttacgtaacggttttaaccgg

SEQ ID NO: 94691 - DNA, 1029 bp, Homo sapiens
  misc_feature: GYAE6OF01CT57Y.11.81.H04.1.454.CMB.1.raw
tcagcgagagataccacgaccggtgctcgatttagtagtgtagattcgcggggctgccctttggctttggagtatgggttttctcgatgagctctggggagaggacgcccagacactagaagtcggtcggtgtttccattcggtgatcagcactgaacacagacggactcaccagtgggtaggtttgggactggacgtcgtttcggggtttttccctcggttgtaccgtttacgtttttaaagggacgggttacggttacccgtaaggttcggtaccggtaagggttcgtacctaaacgggttcggggttacggggtaacgggttcggggttacggggggggggaaggtcccggggtttcggggttaccccgtaacggggtcccccgggttacgggggggtaacccggggttcccccgtttacgggaacgggtaaccctttcccgtttccccggttagggttcggaaccgtacggtccggtttccggtacggggttacctttaccgtacccgtttacggaagggtacgtaccgttaagtacgtaacctacgttaacggccccgttaaccgggttaccgggggttcccccgaccggtaaccggggtccccgtaacccggggaaccgggggtaccggggaaacgggggggttccgtaggggggtaacggggttcggggggttacgggaccggttaaggtttaaacggttaggtttaggggttaagtagggtttaaagggttaaaggggtttaaacgtttaaaacgtttaaaaacggtttaaccggttaagggttaacgggggtaacggttacccgggttaaccggggttaacgggggtaaaaccggggtacccgttaacgtttaacccgaacccttaacgttcccgtaacccggaaggtaacccgtaaccctaccgttaaccggaaacgtaacggtacggtagtactacgtacgtaacgaaacggtacgaacgtcggaccgtagggaaacggaccggaccggaggaaccggcggtcgttacggttaacggg

SEQ ID NO: 94692 - DNA, 902 bp, Homo sapiens
  misc_feature: GYAE6OF01BTBZ3.11.81.H04.1.454.CMB.1.raw
  modified_base (235)..(235): a, c, t, g, unknown or other
  misc_feature (235)..(235): n is a, c, g, or t
tcagcgagagataccacgaccggtgctcgatttagtagtgtagattcgcgggctgccctttggctttggagattggttttctcgatgagctcgtgggagaggacgcccagcactaagaacggtcgggcggttcgtttccagttcggtgatcagcactagaacacgagacggactcacctagtggtaggttggctgacgttcgttcggttttcctcgttcgtctttacgtttaggnggttcgtccgtagtgtcgtaggtcgacgtaacggtgggtaggtaggttcggggtagggggtacggtcggttcgggtaccgtacgggtaccgggtcgggaccggttcccggtaggtaccggttaccttccgttccggtaggtcggtaccgcggtcccggtttacggtacgtaccgtttacccgtaacccggttgtaaacgggtacgtacgttacgtacgtaaccgtaggtccggtaccgttaccgggtacccgggccccgtaccggaccggtaccgtaccgggaacggggtaaccgggtaggggttacgtagggggtacggggttacggggtacgttaacggtttaaggtttaaaggttacggttaagggttaggtaaggttaaggttaaacggttaaagtttaaaacgtttaaaggttaacggtaacggttaacgggtaccggttaccgggtaaccgggtaacgggttaacccggtacccgttaccgtaaccgtaactacccggttaaacgacccgtaaacggtacccttaaacccgtaaaccttaaccggaaacggttaaccggtaccgtacgttaacgtacgtaacgtaaaccgtaacgaccgttaacgacggtaccgacggtacgaaccggtacggacggacttacgggtacgttcggtaacgg

SEQ ID NO: 94693 - DNA, 786 bp, Homo sapiens
  misc_feature: GYAE6OF01EX3CT.11.81.H04.1.454.CMB.1.raw
  modified_base (767)..(767): a, c, t, g, unknown or other
  misc_feature (767)..(767): n is a, c, g, or t
tcagcgagagataccacgaccggtgctcgatttagtagtgtagattcgcggggctgccctttggctttggagatggtttttctcgatgagctctgggagaggagccccagcactagaagtcggcggttgtttccattcggtgatcagcactgaacacagaggacctcaccagtggtagtttgggctgagtcgttggggtttttcctcgtttgtcttcgttttaaggagggttctccgtagttgtcgaggtgctaacgtggtggtaggtcggtggggggaggtcggtgggtccgacggtccggtcggggtacggttccccgtaggacgtacctccgttcccggtggtaccgcgtaccggttcgtacggtcgttaccttacccgtacgtacggacggtactagtacgtacacgtcgaccgtacgtcgggtcccggccgacggtaccgccgtacgggacgggaaggcgggtagggtggggtcgggtcgggtacgtaaggttaagtttaggtacgggttagtaaggtaacggtaaggtttaaacgttaaagttaaacgtaaaggtttaaggtacggtaacggtaccggtaccgtaacgggtaaccgggtccgttaacccgcttaaccccgactacgtacccgaagtaaaccggtacctaaacgttacccgtaaaggtaacccgttacggtacgttacgaccgttaataagtaaacgacggtaacgaaccgacgtacggaccgggaaggaccggtaaccgggacgtaccggnggtttcgtaggttaacccg

SEQ ID NO: 94694 - DNA, 612 bp, Homo sapiens
  misc_feature: GYAE6OF01AUEQ5.11.81.H04.1.454.CMB.1.raw
  modified_base (203)..(203): a, c, t, g, unknown or other
  misc_feature (203)..(203): n is a, c, g, or t
  modified_base (325)..(325): a, c, t, g, unknown or other
  misc_feature (325)..(325): n is a, c, g, or t
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
tcagcgagagataccacgaccggtgctcgatttagtagtgtagattcgcggggctgccctttggctttggagatggttttctcgatgagctctgggagacggagcccagcactagaagtcggcggtgtttccattcggtgatcagcaactgaacacagaggactcaccagtggagtttgggctagagcgttgggtttttcccngttgcttacttttaaggcggtgtccagtgtcaggtgacagtggtggagttcggtggggggagtcggtggtacccaggtcccgtaggggcctcccgtaggactctcctctgcgactgcgtcgnggtacttccaccgttgaggctctatcgactntcgctcgtcggccnccgagttccncgaggccggagggntgggngtgggagtnagttatgtgggtatagaaggttagaagtttaacctaaagttaccgtagaggttacgaacgtccgggtaagaccgggtcttactccgatacgtcacgaagtctaacctcgttacgaaccgaagtgtaccgtatggtactaggaaattcgaacccagtccgaggggtaacaccggtacggggcaaacggttcggacttggttaacg

SEQ ID NO: 94695 - DNA, 733 bp, Homo sapiens
  misc_feature: GYAE6OF01A9DHW.11.81.H04.1.454.CMB.1.raw
  modified_base (204)..(204): a, c, t, g, unknown or other
  misc_feature (204)..(204): n is a, c, g, or t
  modified_base (282)..(282): a, c, t, g, unknown or other
  misc_feature (282)..(282): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (409)..(409): a, c, t, g, unknown or other
  misc_feature (409)..(409): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagagactcaccatggagtttgggctgagcgttggggtttttccctggttntccttactttttaaggacgggttgtaccaggttgttccgagggtggacctaacgttgggtaggagtcggtaggggggngccgttggtccgaggtccggtggggacgtccctagacgtctcgtcgtgtgcagcgtgtgacttcgaccttgacggntctancgactatcggtaccncggtcgggtcccaccggtaggcccgtaccgngggaccggtaggggtcgtaggacgggttggggacgtacgtttagttacgtggttaacgggttagtagggttacgtaaggttaaacgttaaagttaaagttacttaagggtacggtaacgtaccggttaccgggtaacggtaaaccggggtccttaacgtacccgtaccaacgttcccgtacgaacggtaacgtaacccctaaccgttaacccaaacggtaacggtacggttaacgttcgtacgtacgaaacgtaacgtacgaacccgacgtcggacggaaccacgggtaccgaacgggtaaccggtcggtcgttaggttaaccg

SEQ ID NO: 94696 - DNA, 510 bp, Homo sapiens
  misc_feature: GYAE6OF01AOOGZ.11.81.H04.1.454.CMB.1.raw
  modified_base (195)..(195): a, c, t, g, unknown or other
  misc_feature (195)..(195): n is a, c, g, or t
  modified_base (337)..(337): a, c, t, g, unknown or other
  misc_feature (337)..(337): n is a, c, g, or t
  modified_base (377)..(377): a, c, t, g, unknown or other
  misc_feature (377)..(377): n is a, c, g, or t
  modified_base (451)..(451): a, c, t, g, unknown or other
  misc_feature (451)..(451): n is a, c, g, or t
  modified_base (470)..(470): a, c, t, g, unknown or other
  misc_feature (470)..(470): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttccncgttgctcttttaagaggtgtccagtgtcaggtgcaactggtggagtctggggggagcgtggtccagcctgggaggtccctgagactctcctgtgcagcgtctggattcaccttcaggagctatgacatgcacgtgggtccnccaggctccaggcaaggggctggagtgggtgctaggttanatgggtatgatggaattataaatctatggagactcgtgagggcattcacatctcagagactacttccaagaacncggtgtatctgacaaagtnaacagcctagacgacgaccgaggaaccacggtctggtacg

SEQ ID NO: 94697 - DNA, 821 bp, Homo sapiens
  misc_feature: GYAE6OF01C2XCT.11.81.H04.1.454.CMB.1.raw
  modified_base (126)..(126): a, c, t, g, unknown or other
  misc_feature (126)..(126): n is a, c, g, or t
  modified_base (217)..(217): a, c, t, g, unknown or other
  misc_feature (217)..(217): n is a, c, g, or t
  modified_base (335)..(335): a, c, t, g, unknown or other
  misc_feature (335)..(335): n is a, c, g, or t
tcagcgagagataccacgaccggtgctcgatttagtagtgtagattcgcggggctgccctttggctttggagatggttttctcgatgagctctgggagaggagcccagcactagaagtcggcggtntttccattcggtgatcagcactgaacacagagactcacatggtagttggctgacgtcgttcggttttcctcgttcgtcttacgtttaaggnggtcgtccagtcgtcgtaggtcgactaacgtgggtggtacggtcgggtaggggggacgtcggttcggtaccacggtccggtggggtacggtcccgtagaacgtcctcctcgtgtgacnggtccgtcgtcgtacttcccacgttacgaggtactaccgtagtacgaactgtcgtaccgtacgggttcggtacccgcgtaccggtcctaccggacggtacgggtaaacggggtcggtacggggtaacggggtcgggtacgggtaccgttaagtttaagtagggttaggttaacggttagggtaacggttaagggttaaagtttaaacgttaaacgtttaacggtaacggttacggtaaacggtttacccggttaccgggtaacgggaacccgggtaccgttaactttaaccccgaacgttacccgtaacccgtaaccggtaaccgtaaccggttaaccctaacccgttaaaccggaaacggttaaccggttacgggttattaaccgttacgaaaccggtaacgtaacgtaaacgaacggtaccgttaacggacggaaacggtccgaaacggtaacggtaacggtaccgtaggttacgttaaacggg

SEQ ID NO: 94698 - DNA, 732 bp, Homo sapiens
  misc_feature: GYAE6OF01DHU87.11.81.H04.1.454.CMB.1.raw
  modified_base (367)..(367): a, c, t, g, unknown or other
  misc_feature (367)..(367): n is a, c, g, or t
  modified_base (687)..(687): a, c, t, g, unknown or other
  misc_feature (687)..(687): n is a, c, g, or t
tcagcgagagataccacgaccggtgctcgatttagtagtgtagattcgcgggctgccctttggctttggagatggttttctcgatgagctcgtggagagagcccagcactagagtcggcggtgttccattcggtgatcagcacgtgaacacgagagactcacgagtggtagttggctgacgtcgtttcggtttttcctcgttcgtctttacgttttaaaggcggttcgtacccgtaaggttcgttaccgaagggttcgaccgtaaacggttggggtagggacggtttcgggaggggggacggtccggttacgggtccgaacggtccggtacggggtaccggtccccgtagtacgtccgtccgttcgngtcgacgcggtcgttcgtacgtaccttcctaccgttgaacggcgttagtatacgacagttcgaccgtacgttcggaccgtccggagtcccgtaacggaccggtacgggaacgggtccgtagggtacggtggggtactagttagttagtagtgtaagtgtacgttaagttaataagttaaagtagtagtacggaacgttacccggtggtaaccggtacgaccttaccgtactaacccgtgtacccgtaacgagaccgtacctaacgtaacgaacgtaacggtcgtagttaccgtacgtaacgacgtaaagtacaaaccgtnaccccggagtagacccgtaccggacggacgtacgtgtgttaacgg

SEQ ID NO: 94699 - DNA, 955 bp, Homo sapiens
  misc_feature: GYAE6OF01EI05Y.11.81.H04.1.454.CMB.1.raw
  modified_base (208)..(208): a, c, t, g, unknown or other
  misc_feature (208)..(208): n is a, c, g, or t
tcagcgagagataccacgaccggtgctcgatttagtagtgtagattcgcggggctgccctttggctttggagatggtttttctcgatgagctctgggagaggagcccagcactagaagtcggcggttgtttccatttcggtgatcagcactgaacacagacggactcaccagtggtaggtttgggctggagtcgtttgggtttttccncggtttgtctttacgtttttaaaggagggttccgtccgtagttcggttacgtaagggtcgaccgttaaacgtgggggttaggggtaggttccggggttgggggggaacggtccggtgggtaccccgaggtcccggtggggaccgttccccgtaggaccgtacttccgtccttgggtacgcacggttaccggtcgtggtactttacccgaccgtttacggaacgggtacgtacgttaactcggaaccttagtcggcctaacccggggtttccggggaccccgcccggaacgggtacccgtaccggaaggggtaaccggggtaaacgggggtcgtagggggtacggggtttaggggggtcgtaacggttaaggtttaaagttacgggttaggggtaaattcggtaagggttaaagggttaaaagttttaaacggttaaaacttaaccgggttggttaaacgggacggtaaccccggttaccggggttaaacggggaacgggtaccccgttactttaacccgaacccttaacggtaaccctaccgtaaacggtaaaccgttaacccgttaaaccggtaacctaaaccgggaaccggttaaacgggttacgttaaccgttacttaaccgggaaaactaaaacccggttaaggtaaacccggacggtaaccccgggttaaaggacccggggaaacccggtacccgggtaaacccgggaacggtaccccgggtggttaaaggttttaaccggg

SEQ ID NO: 94700 - DNA, 696 bp, Homo sapiens
  misc_feature: GYAE6OF01DT20Y.11.81.H04.1.454.CMB.1.raw
  modified_base (145)..(145): a, c, t, g, unknown or other
  misc_feature (145)..(145): n is a, c, g, or t
  modified_base (179)..(179): a, c, t, g, unknown or other
  misc_feature (179)..(179): n is a, c, g, or t
  modified_base (220)..(220): a, c, t, g, unknown or other
  misc_feature (220)..(220): n is a, c, g, or t
  modified_base (474)..(474): a, c, t, g, unknown or other
  misc_feature (474)..(474): n is a, c, g, or t
  modified_base (624)..(624): a, c, t, g, unknown or other
  misc_feature (624)..(624): n is a, c, g, or t
tcagcgagagataccacgaccggtgctcgatttagtagtgtagattcgcggggctgccctttggctttggagattggtttttctcgatgagctctgggagaggagcccagcactagaagtcggcggtgttccattcggtgatcancactgaacacagagactcacagtggtagtttggntgagtcgttgggttttcctcggttgtctttcgttttaaggnggtcgtaccgtaggttgtacgagggttcgacgtaacggttgggtaggtacggtcgggtggggggacggtcggttcggtccgaggtccgtaggggtaccggtccctgacgtacttcctcgtggtcgcgtacggtctcgtggtacttccgtaaccgttcgaagggtcctagttcgagactagtcgacgtaccggtcggtcccgtacgtcggtccgacggacgggtacggagggtggtagggtcggggtgggtacgngttaagttagtagttggtagtaggtagtaacggttaattaattaagtacgtagagtacggtaccgtacggtacggaacggtccgtacttaccgaccgtcttcgaaccgtataaccgtaacgtaccctaacgaaacgttacgtacggttanaccgtacgataacgtaagtcgaaactcggtaagtacgaacgcgaccggaacgacggtacggtcgtagttacg

SEQ ID NO: 94701 - DNA, 738 bp, Homo sapiens
  misc_feature: GYAE6OF01A8RQS.11.81.H04.1.454.CMB.1.raw
  modified_base (210)..(210): a, c, t, g, unknown or other
  misc_feature (210)..(210): n is a, c, g, or t
  modified_base (251)..(251): a, c, t, g, unknown or other
  misc_feature (251)..(251): n is a, c, g, or t
tcagcgagagataccacgaccggtgctcgatttagtagtgtagattcgcggggctgccctttggctttggagatggttttctcgatgagctcgtgggagaggagcccagcactagaagtcggcggtgtttccattcgtgatcagcactgaacacagagactcacatggagttggctgagtcttgggttttcctcgttgcttactttaagnggtgtccagtgtcaggtgcaagtggtaggagtggtgggggngcgtcgggtccgaggccgtggggacggtccctgagtacttccgtcctgtacgccaggtcgttcgtacggtattacctaccctttacggaacgggtaacgtcttaagtacgtaacctaagttccggacgtaccggtccgggtacccgtaccggtacggccctacccgacggggtaccgaaaggggttccggtaggggtacgggttagggggtagaccgttaaggttaacggttggttaggtagtaggtagttagggtaaagtttaaagtaaattaagtaaggtacggtaacggtaccgtaccgggttaaggaaaccgggttcgtaaccgttacgtaacctcgtacctaacgtaacgacggtaacctaaccgttaacccgtaaagaaccggtacggtacgttaacgttacgtaagtaactaagtaacgtaacgacggtaacgaggtaacggaccgtaacggaaccggtacggtacgttcgtgttaacgg

SEQ ID NO: 94702 - DNA, 782 bp, Homo sapiens
  misc_feature: GYAE6OF01AKSNN.11.81.H04.1.454.CMB.1.raw
  modified_base (126)..(126): a, c, t, g, unknown or other
  misc_feature (126)..(126): n is a, c, g, or t
  modified_base (207)..(207): a, c, t, g, unknown or other
  misc_feature (207)..(207): n is a, c, g, or t
  modified_base (658)..(658): a, c, t, g, unknown or other
  misc_feature (658)..(658): n is a, c, g, or t
tcagcgagagataccacgaccggtgctcgatttagtagtgtagattcgcggggctgccctttggctttggagatggttttctcgatgagctctgggagaggagcccagcactagaagtcggcggtnttccagttcggtgatcagcactagaacacagacggtactcaccagtgggtagtttgggctggagtcgttggggtttttccncggtttgtaccgttacttttaaggacggttcgttcccgaggttcgtcgaagggttcgaccgtaacgttggggtcgggtacggtcggggttaggggggcggtccggttacggtccgtacggtcccggtagggggtaccggttccccgtaggtacgtaccgtttccgtcgttggtaccggcgtaaccggtccggttacggttcggtaacctttccgtaaccgttcggaagtcggtactaacgtgaaccgttagaccgtacgtaccggtccgggtcccacggtaaccggtccgtaaccgggacggaaccggtacggggtcgtacggggtacggttcggggtacggtcgttaagttcgtacggttaggttcgttaggtacgttaagggttaattaggtaaacttacgtaggtacggtacgtaccggtacggagggtaaccgtcgtagtaccctanacgtaccgaacgtagtaaccgacccgtaagttaaccaacgtacccgtagttacgtactcgtacgtaacaacgtacgacgtacgtaccaggtacggacgacggacgaaacgcgggtataaggtcg

SEQ ID NO: 94703 - DNA, 762 bp, Homo sapiens
  misc_feature: GYAE6OF02IHDH2.11.81.H04.1.454.CMB.1.raw
  modified_base (303)..(303): a, c, t, g, unknown or other
  misc_feature (303)..(303): n is a, c, g, or t
tcagcgagagataccacgaccggtgctcgatttagtagtgtagattcgcggggctgccctttggctttggagatggtttctccgatgagctctgggagaggagcccagcacttagaagtcggcggtgtttccacttcggtgtatcgagcgactgaacacagaggactcacatggagtttgggctgagctgggttttcctcgttgctcttttaagaggtgtccagtgtcgaggtgcaacgtgggtggagtccgtgggggagcgtggtctagcgtgggacggtcctgagtcgtcctcgtgtcgcncgtcgtcgtcggtacttccgtaccgttcgaggagtcttagtcgaacctagttcgacctacggttcgggtcccgaccgacgggtcctacccggagggacggaaacgggggtccgttaggggagggttgggggtacggtaccgttaaggttttagttacggttagggttaacgttagggtaacgttaagggttaaaaggtttaaactaaaacgtttacgtaaggtagggtacggtacgttacccggggtaaggaaacggggttccgtaacgtttaccgacccagttaccgtaccgaaaggtaccgaaccttaacccgttaacccggaaacgtaaaccggtaggttaccgttaagtccgtaccgaaccgtaaacgtaacggtaaaccgccggttaccggtaacgaacgggaccgggtaacccgggaacgggaacccgtacgggtcccgttagggtttaaccg

SEQ ID NO: 94704 - DNA, 556 bp, Homo sapiens
  misc_feature: GYAE6OF02GFG2I.11.81.H04.1.454.CMB.1.raw
  modified_base (338)..(338): a, c, t, g, unknown or other
  misc_feature (338)..(338): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtctgggggaggcgtggtccagcctggggaggtccctgagactctcctgtgcagcgtctggattcaccttcaggagctatgacatgcacgtgggtccncaggctccaggcaaggggctggagtgggtgcagttactagtggtatgataggaagttaataaatactagtggagtacgtccggtagaacgggccgtagttcacctatcctaccgaagacgactacttaccgaaagaacctacggtagtatctagactaaagtcgaaacacggaccctaggacgacggacccggaagggaccgacgggtctggtaacgg

SEQ ID NO: 94705 - DNA, 208 bp, Homo sapiens
  misc_feature: GYAE6OF02HAIRX.11.81.H04.1.454.CMB.1.raw
  modified_base (204)..(208): a, c, t, g, unknown or other
  misc_feature (204)..(208): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcgggctggcaaggcgcatagnnnnn

SEQ ID NO: 94706 - DNA, 517 bp, Homo sapiens
  misc_feature: GYAE6OF02IE21F.11.81.H04.1.454.CMB.1.raw
  modified_base (213)..(213): a, c, t, g, unknown or other
  misc_feature (213)..(213): n is a, c, g, or t
  modified_base (317)..(317): a, c, t, g, unknown or other
  misc_feature (317)..(317): n is a, c, g, or t
  modified_base (339)..(339): a, c, t, g, unknown or other
  misc_feature (339)..(339): n is a, c, g, or t
  modified_base (416)..(416): a, c, t, g, unknown or other
  misc_feature (416)..(416): n is a, c, g, or t
  modified_base (442)..(442): a, c, t, g, unknown or other
  misc_feature (442)..(442): n is a, c, g, or t
  modified_base (475)..(475): a, c, t, g, unknown or other
  misc_feature (475)..(475): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
  modified_base (512)..(512): a, c, t, g, unknown or other
  misc_feature (512)..(512): n is a, c, g, or t
tcagcgagagataccacgaccggtgctcgatttagtagtgtagattcgcggggcgtgccctttggctttggagatggttttctcgatgagctctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcaactggtggagtcgtggggggagcgtggtccagcctgggaggtcctgagactctcctgtgcagcgtctggattcaccttcagganctatgacatgcacgtgggtccnccaggctccagggcaaggggcttgggagtggggtggctagttatagtgtatgatggaaagttataaatactatgganactcgtgaaggccgattcacctatcnccagacgactacttaccaagaacaggtgtatcngacaangaacanctagagacgaccgaggaccacggtntgtag

SEQ ID NO: 94707 - DNA, 513 bp, Homo sapiens
  misc_feature: GYAE6OF02JF17E.11.81.H04.1.454.CMB.1.raw
  modified_base (210)..(210): a, c, t, g, unknown or other
  misc_feature (210)..(210): n is a, c, g, or t
  modified_base (380)..(380): a, c, t, g, unknown or other
  misc_feature (380)..(380): n is a, c, g, or t
tcagcgagagataccacgaccggtgctcgatttagtagtgtagattcgcggggctgccctttggctttggagatggtttctcgatgagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcaactggtggagtctgggggagcgtggtccagcctgggaggtccctgagactctcctgtgcagcgtctggattcaccttcaggagctatgacatgcacgtgggtcccgcagggcctccgaggcaaggggctgggagtggggtgctaggttanagtggtatgatggaagttataatactagtggagactcgtagacgggcattcacatctcagagacacttacgaagaacacggtgtatctgacaagtgaacagcctagagacgaccgaggacgacggtctgtacg

SEQ ID NO: 94708 - DNA, 524 bp, Homo sapiens
  misc_feature: GYAE6OF02IHLSX.11.81.H04.1.454.CMB.1.raw
  modified_base (344)..(344): a, c, t, g, unknown or other
  misc_feature (344)..(344): n is a, c, g, or t
tcagcgagagataccacgaccggtgctcgatttagtagtgtagattcgcggggctgggagaggagcccagcactagaagtcggcggtgtttccattcggtgatcagcactgaacacagaggactcaccatggagtttgggctgagctgggttttcctcgttgctcttttaagagcaggtgtccagtgtcaggtgcaactggtggagtctgggggaggcgtggtccagcctgggaggtccctgagactctcctgtgcagcgtctggattcaccttcaggagctatgacatgcactggggtccgccaggctccgaggcaagggggctgggagtggggtgcagttanagtggtatgatggaagttataaattactagtggagactcgtgaagggccgatcacatctcagacgacacttccaagaacgacggtgtatctgactaaatcgaacagcctagagacgaccgaggacgacggctaggtgtattacgtgtggacggaaggggaacagacgagcgtaggaccgg

SEQ ID NO: 94709 - DNA, 508 bp, Homo sapiens
  misc_feature: GYAE6OF02F43WE.11.81.H04.1.454.CMB.1.raw
  modified_base (335)..(335): a, c, t, g, unknown or other
  misc_feature (335)..(335): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggtttcctcgttgctcttttaagaggtgtccagtgtcaggtgcaactggtggagtctgggggaggcgtggtccagcctgggaggtccctgagactctcctgtgcagcgtctggattcaccttcaggagctatgacatgcactgggtccnccaggctccaggcaaggggctgggagtggggtggcagttatagtggtatgatggaagttataaatatatggagactcgtagaagggcgattcaccatctccagagactacttaccaagaacacggtgtatctagacaatgaacagcctagagacgcgaggacacggctgtacg

SEQ ID NO: 94710 - DNA, 613 bp, Homo sapiens
  misc_feature: GYAE6OF02GY75U.11.81.H04.1.454.CMB.1.raw
  modified_base (316)..(316): a, c, t, g, unknown or other
  misc_feature (316)..(316): n is a, c, g, or t
  modified_base (339)..(339): a, c, t, g, unknown or other
  misc_feature (339)..(339): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggtggagtcgtgggggagcgtggtccagcctgggaggtccctgagactctcctgtgcagcgtctggattcaccttcgaggngctatgacatgcacgtgggtccnccgaggcctccgaggcgaaggggctgggagtggggtggctagttatagtggtatggagtagggtaaagtttaataaagtacgtagtgggaacgtacgttaccggtagaacggggtcccgtaattaccaacctatcctaccaaggacgaacctacttacccgaaagtaaccgtacggttacgtatccgtaggaacctaaagtcggaaaccgtacggtacccgtaggaacggtaacggacccggaacgggaccgaacgggtccgttaggttaacgg

SEQ ID NO: 94711 - DNA, 569 bp, Homo sapiens
  misc_feature: GYAE6OF02IHFFY.11.81.H04.1.454.CMB.1.raw
  modified_base (210)..(210): a, c, t, g, unknown or other
  misc_feature (210)..(210): n is a, c, g, or t
tcagcgagagataccacgaccggtgctcgatttagtagtgtagattcgcggggctgccctttggctttggagatggttttctcgatgagctctgggagaggagcccagcactagaagtcggcggtgttccattcggtgatcagcactgaacacagaggactcaccatggagtttgggctgagctgggttttcctcgttgctcttttaagnggtgtccagtgtcaggtgcaactggtggagtcgtgggggaggcgtggtccagcctgggaggtccctgagactctcctgtgcagcgtctggattcaccttcaggagctatgacatgcacgtgggtccgccaggctccgaggcgaaggggctgggagtggggtggcgtagttagtagtgggtatggatgggtaaagttaataaaattactaagtagggaagtaccgttccggtaggaacgggtccgaatttccgacctactcgtaccagacgtacgaccttaccaaacgtaaaccacggtagtatacgtagacaaagtcgaacagcctagagacgaccggaggaccgacggtctaggtacg

SEQ ID NO: 94712 - DNA, 565 bp, Homo sapiens
  misc_feature: GYAE6OF02IOXOR.11.81.H04.1.454.CMB.1.raw
  modified_base (212)..(212): a, c, t, g, unknown or other
  misc_feature (212)..(212): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcaactgggtggagtcgtgggggaggcgtggtccaggcctggggagtccctgagactctcctgtgcagcgtctggatttccaccttcgaggagctatgacatgcacgtgggtccgccgaggcctccgaggcgaaggggctgggaggtgggtggctaggttatagtgggtatgaagtgggaatttaataaattactagtaggacgtacgttcggtaggaacgggtcctaagttccaccacttcctaccgaagagacctacttaccgaaagtaaaccgtcggtatactcgtagacaatcgaaactcgcctagagcgaccggagacgacggtctgtacg

SEQ ID NO: 94713 - DNA, 610 bp, Homo sapiens
  misc_feature: GYAE6OF02FXPID.11.81.H04.1.454.CMB.1.raw
  modified_base (341)..(341): a, c, t, g, unknown or other
  misc_feature (341)..(341): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggtggagtcgtgggggaggcgtggtccagcctggggagtccctgagactctcctgtgcaggcgtctggattccaccttcaggagctatgacatgcactgggtcccncaggcctccgaggcgaaggggctggagtgggtgctagttatagtggtatgataggtaattataaatctagtaggagtacgttaccggtaggaacgggcccgtattccaacctactccgttaccgaaggaacgtaaccctaaccttacccgaaacggtaaaccgtacgggttagttaacgttccgtaggaacctaaagtcggaaaccacggtacccgtaggaacggtaaccggaccggaacgggtacgaaccgggtacttaggttaacgg

SEQ ID NO: 94714 - DNA, 523 bp, Homo sapiens
  misc_feature: GYAE6OF02HTOBG.11.81.H04.1.454.CMB.1.raw
  modified_base (210)..(210): a, c, t, g, unknown or other
  misc_feature (210)..(210): n is a, c, g, or t
  modified_base (337)..(337): a, c, t, g, unknown or other
  misc_feature (337)..(337): n is a, c, g, or t
tcagcgagagataccacgaccggtgctcgatttagtagtgtagattcgcggggctgccctttggctttggagatggttttctcgatgagctctgggagaggagcccagcactagaagtcggcggtgttccattcggtgatcagcactgaacacagaggactcaccatggagtttgggctgagctgggttttcctcgttgctcttttaagnggtgtccagtgtcaggtgcaactggtggagtctgggggagcgtggtccagcctggggagtccctgagactctcctgtgcagcgtctgggattccaaccttcaggagctatgacatgcagtgggtccnccaggctcgaggcgaaggggctgggagtggggtggcagttatagtggtatgatggaaagttataaatactatggagactcgtagaagggcgtattcaccatctccagagacacttaccaagaacacggtatagtctagaacaagtagaacagacctagagacgaccggagacgacggcgtagtacg

SEQ ID NO: 94715 - DNA, 552 bp, Homo sapiens
  misc_feature: GYAE6OF02GPDPQ.11.81.H04.1.454.CMB.1.raw
  modified_base (315)..(315): a, c, t, g, unknown or other
  misc_feature (315)..(315): n is a, c, g, or t
  modified_base (500)..(500): a, c, t, g, unknown or other
  misc_feature (500)..(500): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcgtggtttcgcgtagcgtctttaagaggtgtcagtgtcaggtgcaacgtggtggagtctggggaggcgtggtccaggcctgggaggtccctgacgctctcctgtgcagcgtctggattcaccgttcaggacnctatgacatgcgacgtggtccgcaggcctaccgaggcgaagggctgggagtggtcggactagttatagttaggtagtagtagtacgtaaatttaagtaaattacgtagtaggacgtactccggtagaacggcgtattcgactacttcacgatacgacgtacctagaacgaacgtcgtatcgtacngaacgtaagtacgaactcgactagagacggacgagaccgagtcgtagttacg

SEQ ID NO: 94716 - DNA, 505 bp, Homo sapiens
  misc_feature: GYAE6OF02IPN6I.11.81.H04.1.454.CMB.1.raw
  modified_base (374)..(374): a, c, t, g, unknown or other
  misc_feature (374)..(374): n is a, c, g, or t
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
  modified_base (499)..(499): a, c, t, g, unknown or other
  misc_feature (499)..(499): n is a, c, g, or t
tcagcgagagataccacgaccggtgctcgatttagtagtgtagattcgcggggctgggagaggagcccagcactagaagtcggcggtgtttccattcggtgatcagcactgaacacagaggactcaccatggagtttgggctgagctgggttttcctcgttgctcttttaagagcaggtgtccagtgtcaggtgcaactggtggagtctgggtgaggcgtggtccagcctgggaggtcccctgagactctcctgtgcagcgtctggattcaccttcaggagctatgacatgcactggggtccgccaggctccaggcaaggggctggagtgggtggcagttatatggtatgatggaagttataaatactatgganactccgtgaaggcgatcacatctccaganacacttccaagaacacggtntatctgacaatgaacagacctgagacgcgaggacgacggctgtgtattacgtgtgcggaaggggaaacaggacagntacggg

SEQ ID NO: 94717 - DNA, 552 bp, Homo sapiens
  misc_feature: GYAE6OF02JD55I.11.81.H04.1.454.CMB.1.raw
  modified_base (336)..(336): a, c, t, g, unknown or other
  misc_feature (336)..(336): n is a, c, g, or t
  modified_base (486)..(486): a, c, t, g, unknown or other
  misc_feature (486)..(486): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcgtggtttccgcgtagctcttttaagaggtgtccagtgtcaggtgcaactggtggagtctgggggagcgtggtccagcctgggagtccctgagactctcctgtgcagcgtctggacttcaccttcaggagctagtgacatgcacgtgggtccnccgaggcctcgaggctaaggggctggacgtgggtggctaggttatagtggtatggtatgggtaagttagaaattacgtagtaggtacgacttcggtagaacgggccgtattcacgtagtctcgagacgacacttaccaagacgtacggtntatcgtagactaagtcgaaccgtagccgtagtaacgacggaccgaggacgtaccggtctaggtacg

SEQ ID NO: 94718 - DNA, 524 bp, Homo sapiens
  misc_feature: GYAE6OF02F0QW2.11.81.H04.1.454.CMB.1.raw
  modified_base (335)..(335): a, c, t, g, unknown or other
  misc_feature (335)..(335): n is a, c, g, or t
  modified_base (471)..(471): a, c, t, g, unknown or other
  misc_feature (471)..(471): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggtttcctcgttgctctttaagaggtgtccagtgtcaggtgcaactggtggagtctgggggaggcgtggtccagcctgggaggtccctgagactctcctgtgcagcgtctggattcaccttcaggagctatgacatgcacgtgggtccnccaggctccaggcaaggggctgggagtggggtgcagttatagtggtatgagtgggaaagttataaatactagtggagacgtccggtagaagggccgattcacctatctccagagacacttaccgaagaacacggtntatctagacaagtgaacagacctagagacgaccggaggacacgggtctgtacg

SEQ ID NO: 94719 - DNA, 561 bp, Homo sapiens
  misc_feature: GYAE6OF02INLXB.11.81.H04.1.454.CMB.1.raw
  modified_base (212)..(212): a, c, t, g, unknown or other
  misc_feature (212)..(212): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcaactggtggagtcgtgggggagcgtggtccaggccgtgggaggtccctggagactctcctgtgcagcgtctggattccaccttgaggagctatgacatgcacgtcgggtccgccgaggcctccgaggcgaaggggctgggagtgggtggctaggttatagttggtatgagtgggtaattaagtaaatactaagtaggagtacgtccggtaggaacgggccgtattccgaccattcctccaagacgactaccgtaccaaagaccgacggtgtatcgtagacaagtcgaaccacgtccgtagagacggaccgaggaccgacggtctggtacg

SEQ ID NO: 94720 - DNA, 537 bp, Homo sapiens
  misc_feature: GYAE6OF02IG1IL.11.81.H04.1.454.CMB.1.raw
  modified_base (209)..(209): a, c, t, g, unknown or other
  misc_feature (209)..(209): n is a, c, g, or t
  modified_base (336)..(336): a, c, t, g, unknown or other
  misc_feature (336)..(336): n is a, c, g, or t
  modified_base (486)..(486): a, c, t, g, unknown or other
  misc_feature (486)..(486): n is a, c, g, or t
tcagcgagagataccacgaccggtgctcgatttagtagtgtagattcgcggggctgccctttggctttggagatggtttctcgatgagctctgggagaggagcccagcactagaagtcggcggtgtttccattcggtgatcagcactgaacacagaggactcaccatggagtttgggctgagctgggttttcctcgttgctctttaagnggtgtccagtgtcaggtgcaactgggtggagtctgggggaggcgtggtccagcctggggagtccctgagctctcctgtgcagcgtctggattcaccttcaggacgctatgacatgcacgtgggtccnccgaggcctccgaggcaaagggggctggggagtggggtggctaggtttatagtgggtatggagtgggaattaataaatactagtggagacgtccgtaggaagggccgaattccaccatctaccaagacgactactccaaagaacacggtntatctagacaatgaacacggcctagaggacgccgaaggacacggctgtacg

SEQ ID NO: 94721 - DNA, 535 bp, Homo sapiens
  misc_feature: GYAE6OF02HNQMK.11.81.H04.1.454.CMB.1.raw
  modified_base (319)..(319): a, c, t, g, unknown or other
  misc_feature (319)..(319): n is a, c, g, or t
  modified_base (341)..(341): a, c, t, g, unknown or other
  misc_feature (341)..(341): n is a, c, g, or t
tcagcgagagataccacgaccggtgctcgatttagtagtgtagattcgcggggcgtgccctttggctttggagatggttttctcgatgagctctgggagaggagcccagcactagaagtcggcggtgtttccattcggtgatcagcactgaacacagaggactcaccatggagtttgggctgagctgggttttcctcgttgctctttaagaggtgtccagtgtcaggtgcaactggtggagtcgtgggggaggcgtgggtccagcctggggaggtccctgagactctcctgtgcagcgtctgggattccaccttcaggngctatgacatgcactgggtccnccaggctcgaggcgaaggggctggagtggggtgcaggttatagtggtatgatggtaagttataatactagtggagtacgtcggtagacgggaccgtattcgaccatcctacgagacacacttaccaagaacgacggtattatctagactaaagtcgaacagcctaggagacgccgaaggaccacggctgttacg

SEQ ID NO: 94722 - DNA, 541 bp, Homo sapiens
  misc_feature: GYAE6OF02FVTRI.11.81.H04.1.454.CMB.1.raw
  modified_base (211)..(211): a, c, t, g, unknown or other
  misc_feature (211)..(211): n is a, c, g, or t
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
  modified_base (440)..(440): a, c, t, g, unknown or other
  misc_feature (440)..(440): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcaactggtggagtcgtgggggagcgtggtccagcctggggaggtccctgagactctcctgtgcagcgtctggattcaccttcgagganctatgacatgcactgggtccnccagggctccgaggcaaggggctgggagtggggtgctagttatagtggtatgagtggaattataaatagtatggagctcggtagacgggctattcactatcncagagactacttaccgaaagaaccgaggtatacgtctagactaagtcgaacgacgaccttaggaggacggaccggaacgggaccacgggtcttaggttacg

SEQ ID NO: 94723 - DNA, 675 bp, Homo sapiens
  misc_feature: GYAE6OF02H4JSS.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggtggagtcgtgggggagcgtggtccaggcccgtgggaggtccctggagactctcctgtgcagcgtctggatttcaccttcaggagctatgacatgcacgtcgggtccgccaggcctccgagggcaaggggctagggagtgggtggcgtaggttatagttgggttatggtagtagggtaaagtttaataaaagttacgtaagttagggaagtacgttccggtaggaacggggtaccgtaacgtttaccgaacctaacgttcgtaccccgtaaggaacgtaaccctaccgtttaacccgaaaacgtaaaccgtaacgggttacgttaacttaccgttagaaccgtaaaacgtcggtaaaaccgacgggtaccccgttaaggaacggtacggtacccgggaaacgggaaccgtaaccggggttacccgtaggtttaaccggg

SEQ ID NO: 94724 - DNA, 528 bp, Homo sapiens
  misc_feature: GYAE6OF02FQXAY.11.81.H04.1.454.CMB.1.raw
  modified_base (338)..(338): a, c, t, g, unknown or other
  misc_feature (338)..(338): n is a, c, g, or t
  modified_base (380)..(380): a, c, t, g, unknown or other
  misc_feature (380)..(380): n is a, c, g, or t
  modified_base (496)..(496): a, c, t, g, unknown or other
  misc_feature (496)..(496): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtcgtgggggaggcgtggtccagcctgggaggtccctgagactctcctgtgcagcgtctggattcaccttcaggagctatgacatgcacgtgggtccnccaggctccgaggcaaggggctgggagtggggtgctagttanagtggtatgagtggaagttataaatactatggagactcgtagagggccattcacctatctaccagacgactaccttaccaaagaacctacggtagtactctagacaaagtcgaacnggcctagagacgacggaggacacggtctgtag

SEQ ID NO: 94725 - DNA, 522 bp, Homo sapiens
  misc_feature: GYAE6OF02HX2Z2.11.81.H04.1.454.CMB.1.raw
  modified_base (337)..(337): a, c, t, g, unknown or other
  misc_feature (337)..(337): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggtggagtcgtgggggagcgtggtccagcctgggagtccctgagactctcctgtgcagcgtctggattcaccttcaggagctatgacatgcacgtgggtccnccaggcctccgaggcaaggggctgggagtgggtgctagttatagtggtatgatggaagtttataaatactatggagactccgtgaagggccgattcaccatctaccgagacgactacttaccaagaaccacggtgtatctagacaaagtcgaacagcctagagacgccgaggacacggctgtacg

SEQ ID NO: 94726 - DNA, 591 bp, Homo sapiens
  misc_feature: GYAE6OF02FULD6.11.81.H04.1.454.CMB.1.raw
  modified_base (344)..(344): a, c, t, g, unknown or other
  misc_feature (344)..(344): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcaactggtggagtcgtgggggaggcgtggtccagccgtggggacgtccctgagactctcctgtgcagcgtctggacttcaccttcaggtagctatgacatgcacgtgggtcccncgaggcctccgaggacgaaggggctgggagtcggggtgacgtagttatagtggtataggagtaggtaagtttaataaatcgtagtggaactacgtcggtaggacgggcctaattcacctactaccgtaccgaggtacgacctaccttaccgaaagtaaccgtacggttagttactcgtagaacctaaagtcgaaaccgacgaccgtaggacggacggaccggaaggaccgtacggtcttaggttacg

SEQ ID NO: 94727 - DNA, 615 bp, Homo sapiens
  misc_feature: GYAE6OF02FKMPI.11.81.H04.1.454.CMB.1.raw
  modified_base (335)..(335): a, c, t, g, unknown or other
  misc_feature (335)..(335): n is a, c, g, or t
  modified_base (383)..(383): a, c, t, g, unknown or other
  misc_feature (383)..(383): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggtttcctcgttgctcttttaagaggtgtccagtgtcaggtgcaactgggtgagtctgggggagcgtggtccagcctgggagtccctgagactctcctgtgcagcgtctggattcaccttcaggagctatgacatgcacgtgggtcccncgaggcctccgagggccgaagggggctagggagtggggtggcagttanagtggtagtgagtggtaagttaagttaaatacgtagtaggagtaccgtccgggtaggaacgggtcccggtaattcgaaccctatcctaccgaagacgacctaaccttaccgaaacgaaccgtaccggttagttacgtacgtacggaactaaacgtaacggaaaccgacgtacccgtaggaacggtacggacccggtaaagggacccggaaccgggtacggttaggttaacgg

SEQ ID NO: 94728 - DNA, 529 bp, Homo sapiens
  misc_feature: GYAE6OF02HPBTR.11.81.H04.1.454.CMB.1.raw
  modified_base (195)..(195): a, c, t, g, unknown or other
  misc_feature (195)..(195): n is a, c, g, or t
  modified_base (210)..(210): a, c, t, g, unknown or other
  misc_feature (210)..(210): n is a, c, g, or t
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
  modified_base (378)..(378): a, c, t, g, unknown or other
  misc_feature (378)..(378): n is a, c, g, or t
  modified_base (442)..(442): a, c, t, g, unknown or other
  misc_feature (442)..(442): n is a, c, g, or t
tcagcgagagataccacgaccggtgctcgatttagtagtgtagattcgcggggcgtgccctttggctttggagatggtttctcgatgagctctgggagaggagcccagcactagaagtcggcggtgtttccattcggtgatcagcactgaacacagaggactcaccatggagtttgggctgagctgggttttccncgttgctctttaagnggtgtccagtgtcaggtgcaactgggtggagtcgtgggggagcgtggtccagcctgggagtccctgagactctcctgtgcagcgtntggattcaccttgaggagctatgacatgcacgtgggcccncaggctccgagggcaaggggctgggagtggggtgctagttanagtggtatgatgggaagttataaatactatggagactcgtagaacggcatcacatcaccgaganacacttaccaaagaacacggtatatcgtagacaaagtcgaaacacggacctggaagacggccggaagggaccacgggtctaggtacg

SEQ ID NO: 94729 - DNA, 580 bp, Homo sapiens
  misc_feature: GYAE6OF02GQWRI.11.81.H04.1.454.CMB.1.raw
  modified_base (350)..(350): a, c, t, g, unknown or other
  misc_feature (350)..(350): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtgggtggagtcgtggggggaggcgtggtccagccgtgggacggtccctgagactctcctgtgcagtcgtctggacttcaccttgaggagtctatgacagtcgctacgtgggtccncgaggctccgaggcgaaggggctgggaggtgggtgactaggttatagtggtatggtatagggtaagttaataaatatagtggaagacgtcggtaggaacggtccgtattcacctatcctacgagtacgactacttaccgaaagaacgtggtaagtatacgtagaactaaagtacgaaacgacgtccgtaggaacgacggaccggaggaaccggtacggcgttagttacgg

SEQ ID NO: 94730 - DNA, 599 bp, Homo sapiens
  misc_feature: GYAE6OF02GKQ0D.11.81.H04.1.454.CMB.1.raw
  modified_base (345)..(345): a, c, t, g, unknown or other
  misc_feature (345)..(345): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttcttttaagaggtgtccagttgtcaggtgcaacgtggtggagtcgtgggggagcgtggtccagccgtggggaggtccctgagactctcctgtgcagcgtctggattcaccttcgaggagctatgacagtgcacgtgggtccncgaggcctccgaggcgaaagggggctgggaggtgggtggactaggttatagtggtatgagtagggtaaagtttaataaaattacgtaagtagggaacgtacgtaccggtaggtaacgggccgtaacgttccaacctatccgtaccgaaggtacgactaacccttaccgaaacgtaacgacggttagtactcgtagaactaagtacgaacacgtaccgtagagacggccggaaggaccgacggtcgtaggttacg

SEQ ID NO: 94731 - DNA, 618 bp, Homo sapiens
  misc_feature: GYAE6OF02HY5QS.11.81.H04.1.454.CMB.1.raw
  modified_base (313)..(313): a, c, t, g, unknown or other
  misc_feature (313)..(313): n is a, c, g, or t
  modified_base (335)..(335): a, c, t, g, unknown or other
  misc_feature (335)..(335): n is a, c, g, or t
  modified_base (377)..(377): a, c, t, g, unknown or other
  misc_feature (377)..(377): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctctttaagaggtgtccagtgtcaggtgcaactggtggagtcgtgggggagcgtggtccagcctgggagtccctgagactctcctgtgcagcgtctggattcaccttcagganctatgacatgcacgtgggtccncgaggctccaggcgaaggggctgggagtggggtgctagttanagtggtatgtagtagggtaaagtttaataaatacgttaagtggacgtacttaccggtaggaacgggaccgtagttccaacctattcctaccgagtaacgacctaaccgttacccaaaggtaacccgtaacggttacgttaacttccgttacggtaacctaaaagtacggaaacctaggtaccccgttaggaacggacgggtaccccggaaagggaacccgacgggtccttaggttaaccgg

SEQ ID NO: 94732 - DNA, 640 bp, Homo sapiens
  misc_feature: GYAE6OF02HG0MY.11.81.H04.1.454.CMB.1.raw
  modified_base (230)..(230): a, c, t, g, unknown or other
  misc_feature (230)..(230): n is a, c, g, or t
  modified_base (516)..(516): a, c, t, g, unknown or other
  misc_feature (516)..(516): n is a, c, g, or t
tcagcgagagataccacgaccggtgctcgatttagtagtgtagattcgcgggctgccctttggctttggagatggttttctcgatgagctctgggagaggagcccagcactagaagtcggcggtgtttccattcggtgatcagcactgaacacagaggactcaccatggagtttgggctgagctgggttttcctcgttgtcttctttaagaggtgtccagtgtcgaggtnctaacgtggtggagtcgtgggggagcggtggtccagccgtgggacgtccctgagcctctccgtgtgcagcgtctggtacttcaccgttcgaggtacgtctaagtcgactagtcgacctacgtcggggtcccaccgagggtcctaccggagggccggaaaggggtcgtaggggaaggttcggggtcgtacgtaggtttataggttggtaagtggaagttaggtaaagtttaaataaatacgtaagtggtaacgtaccgtcgggtaaggacggtcctaattaccactntcctacgaagactaacctaaccgtaaccgaagtaacgtacggtattacgtcgtagaactaaacgtgaaacctacgaccgtaggaacgtaccggaccggaacgaccggtacggtcgtaggttaag

SEQ ID NO: 94733 - DNA, 678 bp, Homo sapiens
  misc_feature: GYAE6OF02HOR6R.11.81.H04.1.454.CMB.1.raw
  modified_base (216)..(216): a, c, t, g, unknown or other
  misc_feature (216)..(216): n is a, c, g, or t
tcagcgagagataccacgaccggtgctcgatttagtagtgtagattcgcggggctgccctttggctttggagattggttttctcgatgagctcgtgggagaggagcccagcactagaagtcggcggtgtttccattcggtgatcagcactgaacacagaggactcaccatggagtttgggctgagtcttgggttttcctcgttgcttcttttaagnggttgtccaggttgtcagggtgactaacgtgggtggagtcgtgggggagtcgtggtccaggccgtggggacggtccctgagctctcctgtgcagcgtctggtacttcaccttcgaggatctagtgaacagtcgctacgtcgggtcccgccgacgggtcctccggagggccgaaagggggtctaggggacggggttggggtcggacgtaagttttagtaggttagggtattaggtagttaagggtaaagtttaaagttaaaattacgttaagtgggaacgtaccgttccggtaagggtaacgggtccgtaacgttaccaccgtaccttaccgtaccgaagaccgtaacctaccgttaaccaaaggtaaccgtagggtacttatcgtagaactaaacgtagaaccgtacgcccgtagaacggacgtaccggaacggacccggtaccggtacgttaggttaacgg

SEQ ID NO: 94734 - DNA, 717 bp, Homo sapiens
  misc_feature: GYAE6OF02INUPV.11.81.H04.1.454.CMB.1.raw
  modified_base (156)..(156): a, c, t, g, unknown or other
  misc_feature (156)..(156): n is a, c, g, or t
  modified_base (172)..(172): a, c, t, g, unknown or other
  misc_feature (172)..(172): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (420)..(420): a, c, t, g, unknown or other
  misc_feature (420)..(420): n is a, c, g, or t
  modified_base (590)..(590): a, c, t, g, unknown or other
  misc_feature (590)..(590): n is a, c, g, or t
tcagcgagagataccacgaccggtgctcgatttagtagtgtagattcgcggggctgggagaggagcccagcactagaagtcggcggtgtttccattcggtgatcagcactgaacacagaggactcaccatggagtttggctgagctgggttttccncgttgctcttttaagngtcaggtgtccagtgtcaggtgcaacgtggtggagtcgtgggggagcgtaggtccagccgtgggcggtccctgagactctcgngtgacgngcgtctaggtacttccgtaccgtttcgaaggtgaccttaagttcggaaccttagtcgaccgtaaccggttcggggtccccgaccgaacgggtcctaccccgagggaaccggtaaagggggcctggggtacggtcgggggttaggactaacggttttanaagtttgggttaacgtaggtagttaggggtaaatttaaacttaaaaagttccgtaaggttacgggaacgtaacccgttaccgggaaggttaaacggccggtaaacttccgtaacgtaaccgtcgtaccgggaagacgtaacctacttaaccgaaagaacgtacgtagtanctacgtaacaacgtagaacgacgtaccgttaagagaaccggacgtacgaccgtagggtcctagggtacgttagttacgtaggtacgaacgggaacggtaacgacggacgtacggaccgcgggtacgg

SEQ ID NO: 94735 - DNA, 636 bp, Homo sapiens
  misc_feature: GYAE6OF02JEOZ6.11.81.H04.1.454.CMB.1.raw
  modified_base (310)..(310): a, c, t, g, unknown or other
  misc_feature (310)..(310): n is a, c, g, or t
  modified_base (346)..(346): a, c, t, g, unknown or other
  misc_feature (346)..(346): n is a, c, g, or t
tcagcgagagataccacgaccggtgctcgatttagtagtgtagattcgcggggctgccctttggctttggagatggttttctcgatgagctctgggagaggaggcccagcactagaagtcggcggtgtttccattcggtgatcagcactgaacacagaggactcaccatggagtttgggctgagctgggttttcctcgttgctcttttaagaggtgtccagtgtcaggtgcaactgggtggagtcgtgggggaggcgtggtccagcctggggaggtcccctgagactctcctgtgcagcgtctggattcnccttcgaggacgctatgacatgcaccgttgggtccnccaggcctccgagggtccgaaacggggccttaggggacggttgggggtcgggtcaacggttttagtaagttggggttaatggtaaggttacggtaaaggtttaattaaagttaacgtattagggaacgtacgttaccggttacgaacggggtcccgtattccgaacctataccgtcctaaggacgactacttaccgaagtaactacggtagtacgttctacggactaaacgttcgaacctacggtaccgtaggtacggaacgccggaacgcggacggtccgtagttacgg

SEQ ID NO: 94736 - DNA, 580 bp, Homo sapiens
  misc_feature: GYAE6OF02FKSVG.11.81.H04.1.454.CMB.1.raw
  modified_base (320)..(320): a, c, t, g, unknown or other
  misc_feature (320)..(320): n is a, c, g, or t
  modified_base (346)..(346): a, c, t, g, unknown or other
  misc_feature (346)..(346): n is a, c, g, or t
  modified_base (389)..(389): a, c, t, g, unknown or other
  misc_feature (389)..(389): n is a, c, g, or t
  modified_base (412)..(412): a, c, t, g, unknown or other
  misc_feature (412)..(412): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcaacgtggtggagtcgtgggggaggcgtggtccagccgtggggagtccctgagactctctgtgcagcgtcgtggattccaccttcgaggngctatcgacatgctacgtcgggtccnccgaggcctacgaggcgaagggctgggagtgggtgctagttangtgtatgagtggaattaataaanactagtaggacacgtcggaggaacggctatccactatcctacgagacgtacctacttaccgaaagaaccgacggttagtaacgtctagaacgtaaagtacgaaaccgtacggtccttaaggacgtacggtaaccggacggaacccggtacggtcgttaggttaaccgg

SEQ ID NO: 94737 - DNA, 627 bp, Homo sapiens
  misc_feature: GYAE6OF02HL2II.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgcttctttaagaggtgtccagtgtcaggtgcaacgtggtggagtcgtgggggagcgtggtccagcctgggaggtccctgacgactctcctgtgcagcgtctggacttccgacctttcgagggtagccttaagtcgaacagttgaccacgttcggggtcccgcccgaagggcctccgaagggccgaaaggggcctaggggacggtggggtcgacgtaggtttatagttggtatgtagttagggtaaagtttaataaagtactagtaggaagtaccgtccggtaggacgggtaccgtattccaacctactctaccgagactacctaaccgttaccaaacgtaaccgtacggtagtactcgtagaactaaagtcgaaccacgtaccgtaggaacgacggacccggaggaacccgacggtacgtagttacgg

SEQ ID NO: 94738 - DNA, 648 bp, Homo sapiens
  misc_feature: GYAE6OF02J0CWW.11.81.H04.1.454.CMB.1.raw
  modified_base (245)..(245): a, c, t, g, unknown or other
  misc_feature (245)..(245): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
  modified_base (327)..(327): a, c, t, g, unknown or other
  misc_feature (327)..(327): n is a, c, g, or t
  modified_base (445)..(445): a, c, t, g, unknown or other
  misc_feature (445)..(445): n is a, c, g, or t
  modified_base (465)..(465): a, c, t, g, unknown or other
  misc_feature (465)..(465): n is a, c, g, or t
  modified_base (583)..(583): a, c, t, g, unknown or other
  misc_feature (583)..(583): n is a, c, g, or t
tcagcgagagataccacgaccggtgctcgatttagtagtgtagattcgcggggcgtgccctttggctttggagatggttttctcgatgagctctgggagaggagcccagcactagaagtcggcggtgttccattcggtgatcagcactgaacacagaggactcaccatggagtttgggctgagctggttttcctcgttgctctttaagaggtgtccagtgtcaggtgcaacgtggtggagttcgngggggaggtcgtggtccagccgtgggaggtccctgagctctccngtgnagcgtcgnggtattccaccttgaggacgtntagngtacatgaccacgtgggtcccgcgtacggcctaccgagggtaccgaggggggcttaggggacgggtgggggttcggacgttaaggttattagttagggtatgaagttggaaagtttanaaattacgtaagtgggtaanacccggtaggttacgggtaaacgggccggtaaacttccgtaacctacgttccaccgtaagaacgtaaccgtaccttaacccgaaagaccgtacggttagatttaccgcgaacttaaanacggtaacacgcccgtaaggaacgagtacccggaacgggtacaccgggttactggtttaaaccgg

SEQ ID NO: 94739 - DNA, 572 bp, Homo sapiens
  misc_feature: GYAE6OF02G5J3U.11.81.H04.1.454.CMB.1.raw
  modified_base (230)..(230): a, c, t, g, unknown or other
  misc_feature (230)..(230): n is a, c, g, or t
  modified_base (338)..(338): a, c, t, g, unknown or other
  misc_feature (338)..(338): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtncaactggtggagtcgtgggggagcgtggtccagcctgggagtccctgagactctcctgtgcagcgtctggattcaccttcaggacgctatgacatgcacgtgggtccnccgaggcctcgaggcaaggggctgggagtgggngctagttanagtggtatgatggaagttataaattctaagtggagtacctcggtaggaacgggtccgtagttaccaacctattacctaccaaggtacgacctacctaccaaacgaaccgtacggtatacgtcgtacgtaacaaagtacggaaccacgtaccgtagaacggacgaccggaaggacccgacggtctgttaacgg

SEQ ID NO: 94740 - DNA, 641 bp, Homo sapiens
  misc_feature: GYAE6OF02FNMJV.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtctgggggagcgtggtccagccgtggggggtccctgagactctcctgtgcagcgtctggattcaccttcgaggagctagtgacatgcacgtgggtccgccaggctccgaggcgaaggggctgggagtggggtggcgagttatagtggtatgaagtggtaagttaataaatacttagtacggagtaccgtaccggtaggtaaacgggccgtaacgtttaccaacctacttacccgtacccgaaggaacgtaacctaacccgtttaacccgaaaaggtaaacccgtaaccgggttacgttaacgttccgtacggtaccaaaacgtcggaaaaccgtacggacccttaagggaacggtaacggacccggaacggtaccgaaccgggtcttacggttgttaacg

SEQ ID NO: 94741 - DNA, 805 bp, Homo sapiens
  misc_feature: GYAE6OF02J06DE.11.81.H04.1.454.CMB.1.raw
tcagcgagagataccacgaccggtgctcgatttagtagtgtagattcgcggggctgccctttggctttggagatggttttctcgatgagctctgggagaggagccccagcactagaagtcggcggtgttccacttagtgtagtactgacgactacgtacaacaacgaggactcctaccgaacgtggtaggttgggtcgtgtaggtcgttcgggtttcggtttccgttcgttacgttccgtttaaggttagggtgttccgtacgtgtcgtacggtggtacgtacgtacggtgggtaggtacggtcgggggtagggcgtcggttccgaccggtaccggtcgggtagggttcccggtacgtaggaacccgttcgttcccgttcggttcggacggaccgtttaccggtcggtacggttttccgaacccgttttccgaaaccgggtttaccggtacggtaacgttccggttaacgacgtaccggtactccggtacggttccggcccggtacgcccgtaaccgcggtacgaggggtccggacggtgtgggggctcgggtagtacgtaagttgtagtgtagtgtaagtagtaagttaacgtaagttagtagtacggtacgtacggtacggtacggtacggtacctacgtactacctcgtaccgtacgaacgtaactaaccgtaacgtaacccgtaacgtaccgtaagtcctacgtaccgtaacgtaacggtaaaccgttacgaaccgtaaccggtacggtacggaaccggtacgggaccggtaaccgggtaaccgtacggttacggttacgg

SEQ ID NO: 94742 - DNA, 590 bp, Homo sapiens
  misc_feature: GYAE6OF02HTWRU.11.81.H04.1.454.CMB.1.raw
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
  modified_base (383)..(383): a, c, t, g, unknown or other
  misc_feature (383)..(383): n is a, c, g, or t
tcagcgagagataccacgaccggtgctcgatttagtagtgtagattcgcggggctgccctttggctttggagatggtttttctcgatgagctctgggagaggagcccagcactagaagtcggcggtgtttccattcggtgatcagcactgaacacagaggactcaccatggagtttgggctgagctgggtttttcctcggttgcttcttttaaggaggttgtccagtgtcaggtgcaactggtggagtcgtgggggagcgtggtccgagccgtgggaggtccctgagactctcctgtgcagcgtctggacttcaccttcgaggngctatgacntgctgtcgggccgcgaggcctccgaggccgaaggggtctgggaggtgggnggctagttatagtgtatgagtaggtaaagttaataatatagtaggacgtacgtccggtaggacggccgtacttacacctactctaccgagtacgaactacgtaccgaaagtaaccgagttacgtattccgagaactaagtacgaacgacgcccgtaaggacggtacggaacccggaagggtaacccctagggtaccttggttaacgg

SEQ ID NO: 94743 - DNA, 532 bp, Homo sapiens
  misc_feature: GYAE6OF02GA89Y.11.81.H04.1.454.CMB.1.raw
  modified_base (211)..(211): a, c, t, g, unknown or other
  misc_feature (211)..(211): n is a, c, g, or t
  modified_base (322)..(322): a, c, t, g, unknown or other
  misc_feature (322)..(322): n is a, c, g, or t
  modified_base (336)..(336): a, c, t, g, unknown or other
  misc_feature (336)..(336): n is a, c, g, or t
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
tcagcgagagataccacgaccggtgctcgatttagtagtgtagattcgcggggctgcccttcggctttggagatggttttctcgatgagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcaactggtggagtctgggggagcgtggtccagcctgggagtccctgagactctcctgtgcagcgtctggattcaccttcgaggagctatgacntgcacgtgggtccncaggctccgaggcgaagggctgggagtgggngcagttangtggtatgagtggaagttataaagtactagtaggagacgtcggtagaagggccgtattacaccactctcacgacgacacttaccaacgaactacggtgtatactagactaagtgaaccagcctagagacgaccggacggacggacggtcgtgtacgg

SEQ ID NO: 94744 - DNA, 613 bp, Homo sapiens
  misc_feature: GYAE6OF02IZNVN.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctgttgcttcttttaagaggtgtccagtgtcaggtgcaactgggtggagtcgtgggggaggcgtggtccaggcctggggacggtccctggagactctcctgtgcagtcgtctggatttccaccgtttcgagggtacgtctagtgaactattcgctacgtcggggtcccgccgaggcctccggaggcgaaggggctagggagtggggtgctaggttatagtggtatgagtaggtaagttaataatacgtagtggagaccgttcggtaggaacgggcctaattaccaacctattccgtaccgaacgtaacgacctaaccgttaccgaaagtaaccgtacggttagttactcgtagacgtaaactcggaaacctaggtacctggaacggacggcccggaaggaccgacgggtctaggttacgg

SEQ ID NO: 94745 - DNA, 615 bp, Homo sapiens
  misc_feature: GYAE6OF02GGEU0.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggtggagtcgtgggggaggcgtggtccgagccgtgggacggtccctggagactctctgtgcaggtcgtcgtggtacttcctaccgttcgaggtagctagtcgactagtcgcacgtcgggtcccgccaggcctccgagggacgaaggggctagggagtggggtgcgtagttagtagtggtagtgagtaggtaagttaataaatacgtagtaggacgtacgtccggtaggaacgggtccgtaatccaacctactccgtaccgaacgacgtaaccgtaccttaaccgaaacgtaaccgtacggttaactacgtccgtagaactaaacgtacgaacgtacgaccgtagaacggacggaccggaagacgaccggtcgtaggtacg

SEQ ID NO: 94746 - DNA, 636 bp, Homo sapiens
  misc_feature: GYAE6OF02GID91.11.81.H04.1.454.CMB.1.raw
  modified_base (213)..(213): a, c, t, g, unknown or other
  misc_feature (213)..(213): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgacaacgtgggtggagtcgtgggggaggcgtcggtccagccgtgggagtccctgagactctctgtgcagcgtctggattcaccttgaggatctatgactagtcgactacgtcgggtcccgcgagggcctaccggaggcgtaaacgggggctaggggaggttggggtgacgtaaggtttatagttagggtagtaggtaagtagggtaaagtttaataaaagttacgtagtaggtaacgaccgtcggtaaggacgggtacctagttaccactactaccgtaccgaaggtacgaccgttaacgttaccgaaacgtaacgtacggttacgtaactcgtacgaactaagtacgaacgtacgtaccgtacggaaggaccgtacggacggaccggtacggtcgtagttaacgg

SEQ ID NO: 94747 - DNA, 581 bp, Homo sapiens
  misc_feature: GYAE6OF02GBB4W.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtctgggggagcgtggtccagcctgggaggtccctgagactctcctgtgcagcgtctggattcaccttcaggagctatgacatgcacgtgggccgcaggcctccgaggcgaagggctgggagtgggtgcgtagttatagtggtatgtagtagggtaagttataaatacgtagtaggacgtacgttccggtaggaacgggccgtaagttccacctagttaccgtaccgaggaacgtacctaaccgttacccgaaagaaccgtacggtagttactcgtagacaaagtacgaacctacgaccgtagacgacggtccggaaggtaccgacggtcgtaggttacgg

SEQ ID NO: 94748 - DNA, 694 bp, Homo sapiens
  misc_feature: GYAE6OF02G3RGO.11.81.H04.1.454.CMB.1.raw
  modified_base (221)..(221): a, c, t, g, unknown or other
  misc_feature (221)..(221): n is a, c, g, or t
  modified_base (318)..(318): a, c, t, g, unknown or other
  misc_feature (318)..(318): n is a, c, g, or t
tcagcgagagataccacgaccggtgctcgatttagtagtgtagattcgcggggctgccctttggctttggagatggttttctcgatgagctctgggagaggagcccagcactagaagtcggcggtgttccattcggtgatcagcactgaacacagaggactcaccatggagtttgggctgagctgggttttcctcgttgctcttttaagaggtgtccagtntcgaggtgcaactggtggagtcgtgggggaggcgtggtccagccgtgggacgtccctgacgactctcgtgtgcagcgtcgtggattcaccttgaggngctatgacatcgcacggtgggtcccgcgaggcctccgaggcgaacggggctgggagggtgggtgacgtaaggttataagtggtacgttaggaagttaagggtaaacgtttaagttaaaacgtacgttaaagtacgggtaacggtaaccgttccgggtaagaaacgggggtcccgttaacgtttacccgaaacccgttaacgttccgttaaccgaaacggtaacgtaaacccgtaaccgtttaacccgaaaaagtaacccggtaaccggttacgtacgttacctacggaacctaaagttaaccggaaaccacggtaccctaaggaaccggtacggaacccgggaaggtaacccggaacggtaccggttagttaacgg

SEQ ID NO: 94749 - DNA, 743 bp, Homo sapiens
  misc_feature: GYAE6OF02HMO9B.11.81.H04.1.454.CMB.1.raw
  modified_base (218)..(218): a, c, t, g, unknown or other
  misc_feature (218)..(218): n is a, c, g, or t
tcagcgagagataccacgaccggtgctcgatttagtagtgtagattcgcggggctgccctttggctttggagattggttttctcgatgagctctgggagaggagcccagcactagaagtcggcggtgtttccattcggtgatcagcactgaacacagaggactcaccatggagtttgggctgagtcgttgggttttcctcgttgcttcttttaaaggnggtgtccagtgtcaggtgacaacgtgggtggagtcgtgggggagcgtggtccaggccgtggggacgtcccgtggacgtacctctccgtggtgcagcgtcgtggtacttccaccttcgaggacgcttagtgactagtcgcctacggtcgggtcccgaccgacgggcctaccggagggccgaaagggggtctaggggtaggttggggtcggacgttaaggtttaagttacggttaggttagttagggtaagttaagggttaaaagttttaaattaaaagttaaccgttaaggttacgggaacgttaccggttaccgggttaagggtaacccggggtaccgttaaccgtttaaccgaaccctacgttcccgtaccgtaacggtaccgtaacctacccgttaacccgaaacggtaaccgtaacgggttattaaccgttcgtacgtaacgtaaacggtaacggaaccgtacgtacgtaaggaacggtaccggaccgggtaacggtacccgacggttacgttacggtaacg

SEQ ID NO: 94750 - DNA, 654 bp, Homo sapiens
  misc_feature: GYAE6OF02F485K.11.81.H04.1.454.CMB.1.raw
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
  modified_base (336)..(336): a, c, t, g, unknown or other
  misc_feature (336)..(336): n is a, c, g, or t
  modified_base (639)..(639): a, c, t, g, unknown or other
  misc_feature (639)..(639): n is a, c, g, or t
tcagcgagagataccacgaccggtgctcgatttagtagtgtagattcgcggggctgccctttggctttggagatggttttctcgatgagctctgggagaggagcccagcactagaagtcggcggtgttccattcggtgatcagcactgaacacagaggactcaccatggagttgggctgagcttgggttttcctcgttgcttcttttaaggnggtgtccagtgtcaggtncaacgtggtggagtcgtgggggagtcgtggtccagccgtgggacggtccctgagactctctgtgcagcgtctaggacttcgaccttcgaggtagctaatcgaactntcgacctacgtgggtcccgcgaacggtcctaccgaggccgtaaaggggcgtagggacggtggggtcgccggtaagtttacgtaagtggtaatacggtaagttaggtaaacgtttaagtaaacgttagtaacgtaggaacgtacgtcggttacggaaacgggtccggtacttacgaacctacgtacgtccgtaaagacgtaaacctaccgttaaccgaaagggtaaccctaacgggtacttaagtcgtacgtaacctaagttacgaacctacgtcccgaggtaacgtacgtaccggaggaaccncggtccgtagttacg

SEQ ID NO: 94751 - DNA, 677 bp, Homo sapiens
  misc_feature: GYAE6OF02JBMLY.11.81.H04.1.454.CMB.1.raw
  modified_base (353)..(353): a, c, t, g, unknown or other
  misc_feature (353)..(353): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgaaatcagcactgaacacagagactcaccatggagtttggctgagcgttggttttccgtcgttgtcttcgttttaagaggtgtccgagtgtcaggtcgactaacgtggtggagtcgtggggaggcgtggcctaggccgtggggacggtcccctaggacgtacttccgtccgtgtcgcgaggcgttcgtggtattccgaccttcgaggacgtctanagacagtgctacgtgggtcccgccaggcctaccgaaggcgaaacggggtcgtagggtaggtggggtcggtacgtagttttagtaagttgggtactaggtacgttaggtaaaacgtttaaataaacgtacgttagtagggtaactaccgtccggtagggaacgggtcctaacgttcctaacctagttccgtaccgtaagtaactaaccgttaaaccgttaacgaaacggtaaacccgtggtaacgttataccgtgaaacctaagtaacaaacgtacgacccgtaggaacgtacgaccggaacggtacgacggtccgttaggtacg

SEQ ID NO: 94752 - DNA, 700 bp, Homo sapiens
  misc_feature: GYAE6OF02GH1JH.11.81.H04.1.454.CMB.1.raw
  modified_base (98)..(98): a, c, t, g, unknown or other
  misc_feature (98)..(98): n is a, c, g, or t
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
  modified_base (362)..(362): a, c, t, g, unknown or other
  misc_feature (362)..(362): n is a, c, g, or t
tcagcgagagataccacgaccggtgctcgatttagtagtgtagattcgcgggctgccctttggctttggagatggtttctcgatgagcctctgggagnggtagcccagcacgtagaagtcggcggtgtttccattcggtgatcagcactgaacacagtaggactcaccatggagtttgggctgagctggtttcncgttgctctttagngtgtcagtgcaggtgcaactggtggacgtcgtgggggagtcgtggtccagtccgtgggacggttccctagaagtctctccgtgtcgcagcgtctggtacttcaccttacgaaggtacgtacctatcgaacattcggactaccgttggggtcccnccgtaagggtcctacccggagggtaccgaaagggggtctggggaacggttggggtacggtaccttaaggtttaactaggttagggtacgttaggtaagttaagggtaaacggtttaaataaaacgttacgtaacggttacgggaacgtaccgttaccgggtacggtaaacgggggtccctaacgtttacccgaacctacgtacccgtacgaacggtacgtaacccgtacgttacccgaaaacgtaaccgtacggttacgaacgttcacgactaaagtacgaaacgtcgaaccgtcgtaacggacgtaccggaaggcccgtaacggtccgttagtaacg

SEQ ID NO: 94753 - DNA, 599 bp, Homo sapiens
  misc_feature: GYAE6OF02IFXL1.11.81.H04.1.454.CMB.1.raw
  modified_base (195)..(195): a, c, t, g, unknown or other
  misc_feature (195)..(195): n is a, c, g, or t
  modified_base (211)..(211): a, c, t, g, unknown or other
  misc_feature (211)..(211): n is a, c, g, or t
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
  modified_base (352)..(352): a, c, t, g, unknown or other
  misc_feature (352)..(352): n is a, c, g, or t
tcagcgagagataccacgaccggtgctcgatttagtagtgtagattcgcgggggctgccctttggctttggagatggtttctcgatgagctctgggagaggagcccagcactagaagtcggcggtgtttccattcggtgatcagcactgaacacagaggactcaccatggagtttgggctgagctgggttttccncgttgctcttttaagnggtgtccagtgtcaggtgcaaactgggtggagtcgtgggggagcgtggtccagccgtgggaggtccctgagacctctcctgtgcagtcgtctggattccacctttcgagggacnctaagtgaaccntggcacgtcgggccnccgacgggctccgaggccgaaagggggctagggacgtggggtacgccgtagttagtacgtggtagtggtaagtagggtaaagttaagttaaaacgtacgttagtagggaagtaccgtcgtaggtaacgggtccgtattacaccatcgacagacgacaacttcgacgtccacgacgtcgtagtactcgtacgacaaagtcggaaaccacgtaccgtaggaacggcgtacgtaggaccggacgtaccgg

SEQ ID NO: 94754 - DNA, 613 bp, Homo sapiens
  misc_feature: GYAE6OF02FQFB8.11.81.H04.1.454.CMB.1.raw
  modified_base (281)..(281): a, c, t, g, unknown or other
  misc_feature (281)..(281): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggtggagtcgtgggggaggcgtggtccaggccgtgggacgtcccngacgactctctgtgcaggcgtcgtggacttcaccttcgaggagctaatgactatgcctacgtcgggtccgaccgacggcctaccgaggaccggaaggggtcgtagggaggttggggcggtacgtaggtttactagtggttagtaggtagtagggtaagttaataaattaacgtagtaggacgtaccgtcggtaaggaacgggtccgtaattccgacctagtaccctacgacgtacgacctaacgtaccgaagaacctacggtagtactcgtagaacaagtacgaacgacgacgtagaacggacggaccggacggaccgcggtctaggttacg

SEQ ID NO: 94755 - DNA, 576 bp, Homo sapiens
  misc_feature: GYAE6OF02HE96Y.11.81.H04.1.454.CMB.1.raw
  modified_base (473)..(473): a, c, t, g, unknown or other
  misc_feature (473)..(473): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggtttcctcgttgcttctttaagaggtgtccagtgtcaggtgcaactggtggagtcgtgggggaggcgtggtccagccgtggggacggtccctgagactctcctgtgcagcgtctggtattctaccttcaggagctatgactatcgacacgttcgggtccgccacgggctaccgagggccaaggggctggggacggtggggtggctaggttatagtggtatggatgggtaaattaataaatactagtgggaatacgtccggtaggaacgggcctattccgacattcnccgaagacgacctaacgttaccgaaagaactacggtgtaactctagtacctaaagtgaacctagcccttagacacggaccgaggacccgacggctaggttacg

SEQ ID NO: 94756 - DNA, 546 bp, Homo sapiens
  misc_feature: GYAE6OF02FL7JB.11.81.H04.1.454.CMB.1.raw
  modified_base (385)..(385): a, c, t, g, unknown or other
  misc_feature (385)..(385): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggtggagtcgtgggggaggcgtggtccagcctgggaggtccctgagactctcctgtgcagcgtctggattcaccttcaggagctatgacatgcacgtcgggtccgcgaggcctccgaggcgaaggggctgggaggtggggtggcagttanagtggtatgatggaagttataaatactagtggagacgtcgtaggacgggcctattccaccatctacagacgactacttaccgaaagtaacgacggttagtactcgtagactaaagtcgaacagtcctaggagacgcggaaggaccgacggtcgtagttacg

SEQ ID NO: 94757 - DNA, 852 bp, Homo sapiens
  misc_feature: GYAE6OF02IA5MH.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggtttcctcgttgcttcttttaagaggtgtccagtgtcgaggtgcaacgtggtggagtcgtgggggagcgtggtccagccgtggggacggtccctggagtacctctccgtgtcgcgtaggcgtcgtggtactttccaccttcgacggtacgtctaagtcgactagtcgccgtacggttcgggtcccgaccggacgggtcctaccccggaaggggccggtaaacgggggtcgtaggggtacgggttcggggtacgggtaccgttaaggttttagtttaagggttagggtttaagtagggtaagttaaggggtaaaacgtttttaaattaaaaagtttaacgtaaggttacggggaacggttacccgtttacccggggttaaaggggtaaaccggggtacccgttaacgttttaacccgaaccccgttaaacgtttaccccgttaaccggaaaacggtaaccgtaaaccccgttaaacccgtttaacccgaaaaacggtaaaacccggtaaccggggttacttaaccggttacccggtacggtaaaccttaaaaggcccggtaaaacgaaccggttaccccggttaagggaaccgggttaacccgggaacccggggtaaacggggtaaacccccggtacggggttacccgtttgggtttaaacccgg

SEQ ID NO: 94758 - DNA, 556 bp, Homo sapiens
  misc_feature: GYAE6OF02F302P.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctctttaagaggtgtccagtgtcaggtgcaactggtggagtcgtgggggaggcgtggtccagcctgggacggtccctgagactctcctgtgcagctctggattcaccttcgaggagtctatgacatgcacgtcgggtcccgccgaggcctaccgaggcgaaggggctgggagtggggtgctagttatagtgtatgagtaggaattagtaaatacgtagtggagtacgtcgtaggaggtcgtacgttcactactctcgagacgactacgtacaacgactacggtatactctgactaagtacgaacgacgtaccgtaggacgacggtaccgaacggaccgtaccggtacgtgttaacg

SEQ ID NO: 94759 - DNA, 634 bp, Homo sapiens
  misc_feature: GYAE6OF02JF11Y.11.81.H04.1.454.CMB.1.raw
  modified_base (340)..(340): a, c, t, g, unknown or other
  misc_feature (340)..(340): n is a, c, g, or t
  modified_base (421)..(421): a, c, t, g, unknown or other
  misc_feature (421)..(421): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgctcttttaagagtgtccagtgtcaggtgcaactggtggagtcgtggggagcgtggtccagcctgggagtccctgagactctcctgtgcagcgtctggacttcgaccttgaggagctatcgacatgcacgtcgggtcccnccgaggcctacgaggcgaaggggctagggacggtggggtgacgtagttacgtagtggtatggtagtaggtaaacgtttaanaaaagttactaacgttgggaacgtaccgtttaccgggtaggtaaacggggtcccgtaatttaccgaaccgtacttcctaccggaagaaccggtactaccgttaacccaaaggtaacgtaccggtagtacttcacgtaactaaacgtcgaaaccgtagtcccgtaaggtagaaccgggaccggaacggacgtaacccgggtcttaggttaaccg

SEQ ID NO: 94760 - DNA, 637 bp, Homo sapiens
  misc_feature: GYAE6OF02GHWKC.11.81.H04.1.454.CMB.1.raw
  modified_base (346)..(346): a, c, t, g, unknown or other
  misc_feature (346)..(346): n is a, c, g, or t
  modified_base (362)..(362): a, c, t, g, unknown or other
  misc_feature (362)..(362): n is a, c, g, or t
  modified_base (579)..(579): a, c, t, g, unknown or other
  misc_feature (579)..(579): n is a, c, g, or t
  modified_base (587)..(587): a, c, t, g, unknown or other
  misc_feature (587)..(587): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcgggtgatcagcactgaacacagaggactcaccatggagtttgggctgagcgttgggttttcctcgttgcttacttttaaggaggttgtccagtgtcgaggtgactaacgtgggtggagttcggtggggggaggtcggtggtccgaggccgtggggacggtcccctggagtactctccctgtgcaggcgtctggattccaccttcgaggtancttagtcgacatgacncgtcggggtcccaccgaggcctcggagggcggaaggggcgtaggggagtggggtggactaggttaatacggtggtagtaggtagtagggtaatttaaataaagttactagtcggaagtacgtcggtaggacgggtactgttaccgaccgtatcctacgaagtaccgtacctaccttaccgaaagtaaccaacgggttatacgtacctagaccgtaancggaaacncggcctaaggagacggtacccggaacggacgtaccggtcgtagggttacg

SEQ ID NO: 94761 - DNA, 638 bp, Homo sapiens
  misc_feature: GYAE6OF02JUN4K.11.81.H04.1.454.CMB.1.raw
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttggggctgagctgggtttcctcgttgcttctttaagaggtcgtccaggtgtcaggtgcacgtggtggagtcgtgggggagcggtgtccagccgtgggacggtccctgagtacctctccgtgtgcagcgtcgtggacttcaccttcgaggcgtctagcgacntcgcgtacgtcgggtccnccgacggtccaccgtagggacgaaggggcgtgggaggtcggggtaggcgtaaggttagacggttagggtattggaagtacgggttaaagttaagttaaatacgtagttagggattaccgaccggttaggaaaccgggtccgtattacccgactaacgttccgaacacggtaatacccgtaacgtaccgaacgtacggtacggttacgtattaccgtagaccttaaggacgtaacgacgtccgacgtaggaaccggcggtaacgcccggtacggagttcgttacgg

SEQ ID NO: 94762 - DNA, 710 bp, Homo sapiens
  misc_feature: GYAE6OF02FTPKS.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggtggagtcgtgggggaggcgtggtccagcctgggaggtccctgagactctctgtgcagcgtctggattcaccttcgaggagctatgacatgctactcgggtcccgaccgaggcctaccgaggacggaagggggctggggaggtgggggtcggacgtaggtttaacgtagttagggtagttaggagttagggtaaagtttaattaaaagttacgttaagtaggtaacgtaccgttaccgggttagggaacggggtacccgtacgtttacccgaaccgtaacttcccgtaccgaacggtaaccggaacccttaaccgttaacccgaaaacggtaaaccggtaaccgggttagttaaccgtaccgttacgaacgttaaaaccgtacggtaaacccgtaacggtacccgttaagggaaccggaaccggacccgggtaaacgggaacccggaccgggttaccgttagggtttaaccgg

SEQ ID NO: 94763 - DNA, 597 bp, Homo sapiens
  misc_feature: GYAE6OF02H6Y4F.11.81.H04.1.454.CMB.1.raw
  modified_base (210)..(210): a, c, t, g, unknown or other
  misc_feature (210)..(210): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctgttgcttctttaagnggtgtccagtgtcaggtgcaacgtggtggagtcgtgggggagcgtggtccagccgtgggagtccctgacgactctccgtgtgcagcgtcgtggatttccgaccttcgaggagtcctagtgacatgacctacgtgggtcccacgaggcctaccgaggacgaagggggtctgggaggttgggtgctaaggtttatagtggtataggagttaggtaagttaataaatacgtaagtggacgtactcgtagggtaaaggcccgtattccaacctagttcccgtacgaagactacctacgttaccaaagtaaccgacggttagtacgtactagactaaagtcgaaacctgccttaagacgacggacccggaggaaccgacggtctagttacgg

SEQ ID NO: 94764 - DNA, 748 bp, Homo sapiens
  misc_feature: GYAE6OF02ICRR9.11.81.H04.1.454.CMB.1.raw
  modified_base (181)..(181): a, c, t, g, unknown or other
  misc_feature (181)..(181): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagagactcaccatggagtttgggctgngcttgggttttcctcgttgcttcttttaaagaggtgtccagtgtcaggtgcaacgtgggtggagtcgtggggagtcgtggtccagccgtggggacgtcctgacgctctcctgtgccagtccgtcgtaggtacttcctacccgttcgaggtacgctaagtcaacattcggaccaccggttcggggtccccggccgaacgggtccgtcccgaagggaccggaaagggggtctacgggggtaggttcgggggtagtaccgtaaggtttaagttaggttgggttaacgtggtaaggttagggtaaagttttaaataaacgttaaacgtaagtaaggtaacgtaccgttacccgggtagggtaacgggcccgttaattaccgacctaacttcccgtaccgaaacggtaactaaccgtaaccgttaaccgaaaagtaacccgtacgggtttacgttaacttcgtaccgaactaaaacggacgtaaaacccggtacggtaccgttaacgggaaaccgccgggggtaaacccggtacgggaaacccgggttacggggacccgttaggtttaacgg

SEQ ID NO: 94765 - DNA, 784 bp, Homo sapiens
  misc_feature: GYAE6OF02JK985.11.81.H04.1.454.CMB.1.raw
  modified_base (213)..(213): a, c, t, g, unknown or other
  misc_feature (213)..(213): n is a, c, g, or t
  modified_base (365)..(365): a, c, t, g, unknown or other
  misc_feature (365)..(365): n is a, c, g, or t
tcagcgagagataccacgaccggtgctcgatttagtagtgtagattcgcgggcgtgccctttggtctttggagatggtttctcgatgagctctgggagaggagcccagcactagaagtcggcggtgtttccattcggtgatcagcactgaacacagaggactcaaccatggagtttgggctgagtctgggttttcctgttgcttcttttaagnggtgtccagtgtcaggtgcaacgtgggtgagttcgtggggggagcgtagggtcccaggccgttggggacgtccccgtggacgtaccgtgtccccgtggtggccacggtccgtacgtggaactttccgaccctttacgaggtaacgccttaancggtaacagttggcctcggttacggggtccccgaccgtagggtcccccttaccgggaagggtacccggtaaaggggggtccttaggggggtaaacggtttcggggggttccggggaattaaaggggtttaaccttaacggggttggttaacggttacgggtaaaggttagggtaaaaggttttaaagtttaaaacgttacgttaaaggtacgggtaacgtaacccggttacggtaacgggtaacgggtacccggtaacgttaccgtaacccgtacgttaccgttaccgtaacggtaacgtaccgttaaccgttacccgtaaagtaaccgtaacggtacgtaagtcgttagtacgtaacgtacgtaacgtacgaccgttagaacgtacggtacggacggtacgacgggtctacggttacg

SEQ ID NO: 94766 - DNA, 577 bp, Homo sapiens
  misc_feature: GYAE6OF02JIWRH.11.81.H04.1.454.CMB.1.raw
  modified_base (194)..(194): a, c, t, g, unknown or other
  misc_feature (194)..(194): n is a, c, g, or t
  modified_base (365)..(365): a, c, t, g, unknown or other
  misc_feature (365)..(365): n is a, c, g, or t
  modified_base (452)..(452): a, c, t, g, unknown or other
  misc_feature (452)..(452): n is a, c, g, or t
  modified_base (476)..(476): a, c, t, g, unknown or other
  misc_feature (476)..(476): n is a, c, g, or t
  modified_base (486)..(486): a, c, t, g, unknown or other
  misc_feature (486)..(486): n is a, c, g, or t
tcagcgagagataccacgaccggtgctcgatttagtagtgtagattcgcggggcgtgcccttggctttggagatggtttctcgatgagctctgggagaggagcccagcactagaagtcggcggtgtttccattcggtgatcagcactgaacacagaggactcaccatggagtttgggctgagttgggttttccncgttgctcttttaagaggtctccaggtgtcaggtgactaactgggtggagtcgtgggggagtcgtggtccagccgtggggagtccctggagactctcctgtgcagccgttctggtacttcctaccgttcgaagggactactagtcggaactgtcggctacgtcggggtccnccgaggcctcgagggccaaaggggtctgggagttgggcgactaagttagtatggtagtgtagtaggtaagttataaagtctagtagngacgtcgtagacggctagtcactntctacagacnctaactacgaagaacgtgtacgaatcgtagactaagtcgaacgacgtcgagacggacggccgaacggccgtaacggcgtaggtcgttaacg

SEQ ID NO: 94767 - DNA, 718 bp, Homo sapiens
  misc_feature: GYAE6OF02IVMVU.11.81.H04.1.454.CMB.1.raw
  modified_base (362)..(362): a, c, t, g, unknown or other
  misc_feature (362)..(362): n is a, c, g, or t
  modified_base (452)..(452): a, c, t, g, unknown or other
  misc_feature (452)..(452): n is a, c, g, or t
tcagcgagagataccacgaccggtgctcgatttagtagtgtagattcgcggggctgccctttggctttggagatggtttctcgatgagctctgggagaggagcccagcactagaagtcggcggtgtttccattcggtgatcagcactgaacacagaggactcaccatggagtttggctgagcgttgggttttcctcgttgcttacttttaaggaggttgtccagttgtcgaggtgcaacgtgggtggagtcggtggggggagtcggtcggtccaggtccgtggggacggtcccctggacgtacctcctcccgttggtcgacgaggtccgttacgtgggtactttccgaccctttgaacgggngtactagtcgaacagttggcctacggttccgggtcccgccgaggtccctaccggagggtaccgaagggggtctagggagggttcgggggngtcgtaaggtttaattaggtggttagtaggtagttaagggtaaatttaaagtaaacttacgtaggtaggacgtaccgttcggtacgggtaacggtacccttacgttacccaccctaacgtcctacgaacgtacgtaacctaccgtaacccgtaaaggtaaccgtacggttataacgttacgtacgtaaccgtaaaggtaacgaaaccggtaccgtacggtaggaacgtacggaccggaaggaccggtaccggttagtcgttaacgg

SEQ ID NO: 94768 - DNA, 633 bp, Homo sapiens
  misc_feature: GYAE6OF02GQCFB.11.81.H04.1.454.CMB.1.raw
  modified_base (336)..(336): a, c, t, g, unknown or other
  misc_feature (336)..(336): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttacgttttaagaggttgtccagttgtcaggtgctaactgggtggagtcggtgggggagtcgtggtccagccgtggggacgtccctgacgtactctcctgtcgcagtcgtctggtattccgaccttcgaggtancttagtgacagtgcctacgtcgggtcccgccgacggcctcgaggacggaagggtcgtagggaggtgggacggtactaggtttagtagttgtagtagtagtaaggtaattaagtaaatacgtagtagacgtacgtcggaggacggtacgtatccactctaccgtacgaagtacgtaactaccgtaacgaacgtaacgtacggtaagtacgttacgacgtaactaacggtaacgaaccgtacggtaccgtaaggacggaccggaccggaaggtacccgtacggttacgttaggttaacg

SEQ ID NO: 94769 - DNA, 621 bp, Homo sapiens
  misc_feature: GYAE6OF02G4LA7.11.81.H04.1.454.CMB.1.raw
  modified_base (352)..(352): a, c, t, g, unknown or other
  misc_feature (352)..(352): n is a, c, g, or t
  modified_base (393)..(393): a, c, t, g, unknown or other
  misc_feature (393)..(393): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggtggagtcgtgggggagcgtggtccagccgtggggacgtccctgagactctccctgtgcagtcgtcgtggacttccgaccttcgaggacgtctatgacatcgcacgtcgggtcccnccgaggcctaccgagggaccgaaggggctgggaggtggggngtcaggttatagtggtatgtagtaggtaagttataaatatagtggtaagacgtcggtaggaacgggtccgtaattaccactactctaccgaaggtacgtaaccgtaccttaccgaaaagtaaccgtacggtagttacgttacctaggtaacctaaaagtcggaaactaccggaccgttacggaacggaaggtacccgggaacggtaccgacgggttctagggttaacg

SEQ ID NO: 94770 - DNA, 732 bp, Homo sapiens
  misc_feature: GYAE6OF02FJP0R.11.81.H04.1.454.CMB.1.raw
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
tcagcgagagataccacgaccggtgctcgatttagtagtgtagattcgcggggctgccctttggctttggagatggtttctcgatgagctctgggagaggagcccagcactagaagtcggcggtgttccattcggtgatcagcactgaacacagaggactcaccatggagtttgggctgagctgggtttcctcgttgctctttaagnggtntccagtgtcaggtncaagtggtggagtcgtggggggagcgtggtccagcctggggacgtcccctggacgactctccgtgtgcacgtcggtctcggtattcctaccttcgaggtacgtcgtaatgaacagttcgcctaacgtcgggtccgccgagggcctcccgaaggaccgaacgggggctgggacggtaggggtcgtctacggtttatacgtggtaacgtggtaagtacgggtaaagttaacgttaaaattaccgttaagtacgggtaacgtaccgttaccgggttacgggtaaacggggtacccggtaactttaccgtacccgtaaacgttaccgtacccgtaacgggtaaccgtaaacctaacccgttttaacccgaaaacggtaaaccgtaaacccgggttagttaaccgttacgttacggaaccgtaaacgtaacggtaaaccgacggtacccgttaaggaacggacggtaacccgggaacgggttaaccgtacccgggtcgttagggttaaccgg

SEQ ID NO: 94771 - DNA, 613 bp, Homo sapiens
  misc_feature: GYAE6OF02IHOMT.11.81.H04.1.454.CMB.1.raw
  modified_base (519)..(519): a, c, t, g, unknown or other
  misc_feature (519)..(519): n is a, c, g, or t
tcagcgagagataccacgaccggtgctcgatttagtagtgtagattcgcggggctgccctttggctttggagatggttttctcgatgagctctgggagaggacgcccagcactagaagtcggcggtgtttccattcggtgatcagcactgaacacagaggactcaccatggagtttgggctgagctgggttttcctcgttgccttcttttaaggaggtgtccagtgtcaggtgcaactggtggagtcgtgggggagcgtggtccagccgtgggacgtcctgacgactctccgtgtcgcagcgtcgtggtattccaccttcgagggatcgtatggactatcgacgtcgtcgggtcccgcgacggtcctccgaggggacgaagggggtctagggtaggtggggtggaccttaaggttacgttagtagggtagtgtaggtagggtaaagtttaataaagttacgtaaggtggacgtaccgtcggtaggacgggtaccgtagtaccacctactcgacgacganacctacttaccaacgtaccgtacgtagtactactgaagtaactcgaaccacggcctaaggacgacggaccggacggacgacggtcgtgttaacg

SEQ ID NO: 94772 - DNA, 699 bp, Homo sapiens
  misc_feature: GYAE6OF02I51LX.11.81.H04.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
  modified_base (629)..(629): a, c, t, g, unknown or other
  misc_feature (629)..(629): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagagactcaccatggtagttgggctgagctgggtttcctcgttgtccttntttaagaggttgtccagttgtacagggtnacaacgtgggtggagtcggtgggggagtcggtgccagccggtggacgttcccnggacnctcctcctgtancgtagcgtcgtggtacttccgtacccttggaaggactntaacgtgactagtcgtcgtcggtcgggtcccaccgacggtcccttacggaacggccgggtaaacgggtcgtagggtagggtccgggtaggtactaagggtttaattcggtaggttacgttaggtaattaaacggggtaagttttaaataaaacgtttacgtaagttacgggtaaccgtacccggtacggtacgggtaaacgggttaccctaagtttaacccgctacctcgtaaccgagttacgacccgtaagttaacccggaaagaccgttaggacttataacgttanaacgtacgtaacgtaacgactccggtagaacggaccgtccggaaacggtccgtaccggtattggttaacg

SEQ ID NO: 94773 - DNA, 649 bp, Homo sapiens
  misc_feature: GYAE6OF02IZMYV.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgtcttcttttaaggaggtgtccagtgtctaggtgcaacgtggtggagtcgtagggggaggcgtggtccagccgtagggacggtccctgagtactctcgtgtgcagcgtcgtagtacttcctaccgttcgaggtacgcttaatcgaactagtcgacgacgtcgggtcccaccgaggacctaccggaggaccggaaggggtcgtgggtaagggtcggggtggacgttaggttaacgtaagttcgggtaagttcggtaagttaacggttaaagtttaaataaaacgttacgtaaggttacggaacggttaccgtaaccggtacggtaacggggacctacgttaccaacgtactctaccgagacactactacgaaacgacgtacgtatatcgtacgaactaagacgtaaccagactagaacgacggacgaggaccgtacggtctaggttaacg

SEQ ID NO: 94774 - DNA, 696 bp, Homo sapiens
  misc_feature: GYAE6OF02F1OLP.11.81.H04.1.454.CMB.1.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
tcagcgagagataccacgaccggtgctcgatttagtagtgtagattcgcggggctgccctttggctttggagatggtttctcgatgagctctgggagaggagcccagcactagaagtcggcggtgtttccattcggtgatcagcactgaacacagaggactcaccagtggagtttgggctggagcttgggttttcctcgttgcttactttaagaggtntccagtgtcaggtnctaacgtggtggagtcgtgggggagcgtggtccaggccgtgggacgtcctgacgtactctccgtgtgcagtcgttcgtggacttccaccgttcgaggtctacttagtgactagtcggctaccggttcgggtccctcgacgggtcctaccggagggtacggaacgggggctaggggagggtcggggtagacgttaagtttacgtagttaggtacgttaggagttagggtaaacgtttaaagtaaaacgttacgtaaggtagggaacgtaccgttacggtaacgggaaaccgggtccgtaacttacccgacctacgttaccaccgaagtaccgaaccgtaaccttaaccggaaacgtaacggtacggttacgtaacgtccgtacgtaacgtaagtaacggaacgtaacggtcccgttaaggaacggtaccggtacggaacggaccggtacggttcgtagttaccgg

SEQ ID NO: 94775 - DNA, 609 bp, Homo sapiens
  misc_feature: GYAE6OF02GOWH9.11.81.H04.1.454.CMB.1.raw
  modified_base (211)..(211): a, c, t, g, unknown or other
  misc_feature (211)..(211): n is a, c, g, or t
  modified_base (351)..(351): a, c, t, g, unknown or other
  misc_feature (351)..(351): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagnggtgtccagtgtcaggtgcaacgtggtggagtcgtgggggaggcgtggtccaggccgtggggacggttccctggagacctctcctggtcgcagcgtctggattcaccttcaggatctatgacagtgcacgtcgggtcccnccgaggcctacaggcgaaggggctgggaggtgggtgctaggtttactagttgggtatacggagttagggtaaagtttaacgtaaattacgtagtagggaactaccgtcggtaggaacgggtcctagttccacgtactccgtccaagacgtactaccttaaccgaagaacgtacggttagtactcgagaacaaagtcgaaacctgcccgtaagacggacggtacccgggaaggtaacccgacgggtacgttcggttaag

SEQ ID NO: 94776 - DNA, 574 bp, Homo sapiens
  misc_feature: GYAE6OF02GX7M4.11.81.H04.1.454.CMB.1.raw
  modified_base (194)..(194): a, c, t, g, unknown or other
  misc_feature (194)..(194): n is a, c, g, or t
  modified_base (227)..(227): a, c, t, g, unknown or other
  misc_feature (227)..(227): n is a, c, g, or t
  modified_base (332)..(332): a, c, t, g, unknown or other
  misc_feature (332)..(332): n is a, c, g, or t
  modified_base (496)..(496): a, c, t, g, unknown or other
  misc_feature (496)..(496): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcagtgatcagcactgaacacagaggactcaccatggagtttgggctgagcgtggtttccncgttgctctttaagaggtgtccagtgtcaggtncaactggtggagtcgtgggggagcgtggccagcctggggagtccctgacgactctcctgtgcagcgtctggatcacttcaggagctatgacatgcactgggtccncgaggcctccgaggcgaaggggctggaggtggggtcgcgtagtttatagtcggtatggagtagggaagttaataatactagtgggacgtaccgttcggtaggaacgggccattccaccgtatcgaccgaggacgacctaacgttaccaagtaaacgacgggttntagttaccgtgtaacgaaacttcgaacgtaccggcctaaggacggacgaccccggaaggacccgaccggtcttaacgg

SEQ ID NO: 94777 - DNA, 787 bp, Homo sapiens
  misc_feature: GYAE6OF02F3SWX.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccagtggtagtttgggctgagtcgttgggttttcctcgttgcttacgtttttaaaggagggttcgtaccctaggttcggtcgtagggtcgccaaacgttgggtcgggagttcggtgggggggaggtcggtcggtccaggcccgtgggggacgtcccctaggacgtacccttccgttcgtggtcgacggtacggtccgttaggtacggtaccttcccgttaccgttacggaacggacgttacgttagtacgacgtagtcgaccgttacgggtccgggtcccacggtacgccgtacggaacgggtacgggagggtcggtagggacggggtgggtcgtacgttagttagttacggtaggttagtggtaacggttaaggttaaactttaaagtaacgttacgtaaggtacgggtaaccgttccgggttacggtaaacggggtacgttcccgttaacttaccccgtaactaccgtacccgtaagaacggtaacctacccgttaacctaacgaaaccgtacggttacggttataacgtactagtaaaccgtagtaaccgtacggacgttaccggagtaacgggaaccgaccgggtaaccgaccggttacggttcggttagttaacccgg

SEQ ID NO: 94778 - DNA, 771 bp, Homo sapiens
  misc_feature: GYAE6OF02I4P33.11.81.H04.1.454.CMB.1.raw
  modified_base (208)..(208): a, c, t, g, unknown or other
  misc_feature (208)..(208): n is a, c, g, or t
  modified_base (359)..(359): a, c, t, g, unknown or other
  misc_feature (359)..(359): n is a, c, g, or t
tcagcgagagataccacgaccggtgctcgatttagtagtgtagattcgcggggctgccctttggctttggagatggtttctcgatgagctctgggagaggagcccagcactagaagtcggcggtgtttccattcggtgatcagcactgaacacagaggactcaccatggagtttgggctgagctgggtttcctcgttgctctttaagnggtgtccagtgtcaggtgcaacgtggtggagtcgtgggggagcgtggtccagccgtgggacgtccctgacgactcgtcctgtcgcaggtcgtcgtggacttccaccttcgaggagtcctagtcgactagtcggactacgtcggggtacccnccgtacgggtcctaccgagggtaccggaaaggggtccgttaggggacggttcgggggttacggtaccgtaaagggttttaacgtacgggttggggttaacgttagggtaacgttaaggggttaaaagttttaaacgttaaaacgttaacgttaggttaacgggaacggttaacccggtttaccgggtaacgggtaaaccgggtacccggttacgtttaacccgaaccgtaacgttacccgtaaccgtacggtaaccgtaacccgttaaccgttaacccgaaaggtaaacccggtacggttcgttaacgttaccgtaggtaacgtaaacgtacggaaacctcgggtacccgtaaggaaccggtaccggtaccgggtaaccggaacgttaccgggtacgttacgggtttaacgg

SEQ ID NO: 94779 - DNA, 609 bp, Homo sapiens
  misc_feature: GYAE6OF02GPGFT.11.81.H04.1.454.CMB.1.raw
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggtttcctcgttgctcttttaagaggtgtccagtgtcaggtgcaacgtggtggagtcgtgggggaggcggtggtccagccgtgggagtcccgtagacgactctcctgtgcagctcgtggattcaccttnagganctatgactatgcacgtcgggtccgcagccgtacagggcgaaggggctagggaggtggggtagcgtagttagtagttggtagtgagttagggtaaatttaactaaagttactagtaggacgtacgtccggtaggtacggtaccgtaattccaacctataccgtaccgaacgacgtaacctaccttaccgaaacggtactaacgggttacgtacgtacgtacgaactaacgtaacgaactacggtccgtaagacggaccgacggaggaccgacggtaccttaggttaccgg

SEQ ID NO: 94780 - DNA, 629 bp, Homo sapiens
  misc_feature: GYAE6OF02G8CU8.11.81.H04.1.454.CMB.1.raw
  modified_base (210)..(210): a, c, t, g, unknown or other
  misc_feature (210)..(210): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctctttaagnggtgtccagtgtcaggtgcaactggtgagtcgtgggggagcgtggtccagcctggggaggtccctgagactctcctgtgcagcgtctggattcaccttcgaggagctatgacatcgctacgtcgggtcccgccgagggcctccgacggacgaaggggctgggaggtggggtgcgtagttactagttggtatgtagtaggtaagttaataaagtacttagtagggtataccgtacggttaggaacggggccgttaattcccgacctacgttacctaccgaagtacgtaacctaccgttaaccgaaacgtaaaccgtacgggttagtaacttccgtagtaaccgtaaagtacgaaaccgacggtacctaagggtacggacggacccgggaaggtaacccgcgggtaccgttggttaaccgg

SEQ ID NO: 94781 - DNA, 648 bp, Homo sapiens
  misc_feature: GYAE6OF02FMNKV.11.81.H04.1.454.CMB.1.raw
  modified_base (330)..(330): a, c, t, g, unknown or other
  misc_feature (330)..(330): n is a, c, g, or t
  modified_base (352)..(352): a, c, t, g, unknown or other
  misc_feature (352)..(352): n is a, c, g, or t
  modified_base (407)..(407): a, c, t, g, unknown or other
  misc_feature (407)..(407): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggtggagtcgtgggggaggcgtggtccagccgtgggagtccctgacgactctcctgtgcagcgtcgtggtattccaccttcgagggacgtctangacagtgcctacgtcgggcccncgacggcctaccggaggaccgaaggggctagggaggtggggtcgacgtagtttanagttgtagtgagttaggtaagttaataaatacgtagtaggtacgtaccgttcggtagaacgggtcctaagtcccaactacgttaccgttaccgaagtaccgtaccgtaaccgttaaccgaaacgtaacgtaccggtttaagtacgttcgacgtaaccgaaacgttaccggaaacgtccggtaaccgttaggacggtacgggaacccggtaacgggaccgtaccggttacgttagttaacgg

SEQ ID NO: 94782 - DNA, 731 bp, Homo sapiens
  misc_feature: GYAE6OF02GXVRT.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccagtggagtttgggctgagtcgttgggtttcctcgttgtcttactttaaggaggtcgtacagtgtcgagggtcgacaacgtgggtggtagtcggtagggggagcggtcggtccaggtccgtaggggtaccgtccctaggacgtacttccgtccttaggtcgacgtaggtccgttcgtacggtacctttcccaaccggtttcgaagggtactacctagtcgaactaggtcacgtacggtcgggcccacgacgtccgtcggaaggtcggaagggtcgtacgggtagggtcgggtagtaccgtaaggttacgaggttaggttatacggtaagtaggttaaacttaaagttaaagtacgttaaggtcgggtaacgtaccgttacgggtaacggacggttccgttaagttaccgaactacgtccaaccgtaagaccggtaaacctacccgtaacgtaaaccggtaacgttacggtacgttaacgtcgtaacgaacgtttaaacgaacgtcggaacgtccgaaggtacgaacgggaccgtagggtaccggtacgggtacctaggttaaccgg

SEQ ID NO: 94783 - DNA, 814 bp, Homo sapiens
  misc_feature: GYAE6OF02GEEZ7.11.81.H04.1.454.CMB.1.raw
  modified_base (217)..(217): a, c, t, g, unknown or other
  misc_feature (217)..(217): n is a, c, g, or t
  modified_base (806)..(806): a, c, t, g, unknown or other
  misc_feature (806)..(806): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaacatggagtttggctgagtcgttgggttttcctcgttgcttacgttttaaggnggtgtccagttgtcgaggtgactaacgtgggtaggagtcggtgggggagcggttggccgaggccgtgggacggtccctagacgacgttcctccgtgtcgacgagtccgttcgtaggtactttcccgaccgtttggaaggtacgtacgttaagtcgtaacctagttcggaccgtaccgggttaccggggtccccgaccggtacggggtaccccttaccggacggggtaccgggtaacggggggtcgttacgggggtaacggggttgggggtacggggtaacgttaagggttttactaacgggtttacgggttaagttacggtaaagggtttaacgggttaaaacgtttttaaaagtaaaaacggtttaaccgttaaagggttacggggtaaccggtacccggtttaaccggggttagggtaaaacccggggttacccgttaacgtttacccgtaaacccgtttacgttacccgttaccgaaggttaacctaaccgttaacccgtaacgaaacgtaaccgtacggttaacgtacgtcgtacgaataacgtacgaacgcgtaccgtagacggcgacggacggactaccggtntaggtacg

SEQ ID NO: 94784 - DNA, 859 bp, Homo sapiens
  misc_feature: GYAE6OF02F3YE9.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcgttgggttttcctcgttgcttcttttaaggaggttcgtcctaaggttcgtccaggtcgctaaacgttgggtagggaggttcggtaggggggaggtcggttcgggtccacggccgtacgggggtacggtccccgtggacgtacctcctccttggtcgcgtacggtccggtcgttacgggtactttcccgtacccgtttcggacggggtaacgtacttaagtacgaaccgtagttcggacccgtacggtttccgggggtaccccgacccggtacgggcccggttaacccggacggggtaccgggtaaacggggggtccggttaagggggtaggggttcggggggtacgggtaccggttaaggttttaacgtaggtttaggggttaacgtagggtaagggtttaaaggggttaaacgtttaaaagttaaaacggttaacgttaagggttaacgggtaaccggtaaccgtttaccggggtaacgggtaaacggggttacccgttaaaccgttacccgaaacccttaccgttacccgttaaccgaacgtaaccggtaaccttaccgttaacccgtaaacgtaaccgttacggtacgttacgacgtacgaagtaaacgtacgaacctacggtaccagggaacgacggtaacggaccggtacgtacggtagttcggttaacg

SEQ ID NO: 94785 - DNA, 836 bp, Homo sapiens
  misc_feature: GYAE6OF02IFTRE.11.81.H04.1.454.CMB.1.raw
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttggctgagcgttggttttcctcgttgtcttacttttaaggnggtntccgtagtgtcgaggtgcgtaacgtgggtaggagtcggtgggggagtcggtcggtaccaggccgtagggacggtcccgtggacgacctcgtccgtgcgacgacgtcgtcgtaggtacttccaccgttcgaaggtacgtcgttaagtacgacagttcggaccgtacggttccggggtcccgaccgtacggtcctacccggaggggaccggtaaacggggtcgtaggggtaacgggttcggggtaggaccggttaggtttaagtttacggtagggtttaaggtaggtaacggtttaaggggtaaactttaaagttaaaacgtttacgtaaggttaagggaaccggtttaaccggtaccgggttaaggggaaaccgggttcccgttaaaacgttcccgtaaacctaaccgtttacccgacccggtaaagggtacccgtaaacccgttaaccgttaacccggtaaaacggaccgttaaacccgggttaagttaaccgttaccgaggtaaaccttaaacggtacggtaaaaccctacgggtaacccggtaacggtaaaccgggaacccggaaccgggtaacccggggtaaaccgtaccccgggttaggttacggttaaccgg

SEQ ID NO: 94786 - DNA, 799 bp, Homo sapiens
  misc_feature: GYAE6OF02JSST6.11.81.H04.1.454.CMB.1.raw
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
  modified_base (476)..(476): a, c, t, g, unknown or other
  misc_feature (476)..(476): n is a, c, g, or t
  modified_base (495)..(495): a, c, t, g, unknown or other
  misc_feature (495)..(495): n is a, c, g, or t
  modified_base (730)..(730): a, c, t, g, unknown or other
  misc_feature (730)..(730): n is a, c, g, or t
tcagcgagagataccacgaccggtgctcgatttagtagtgtagattcgcgggctgcccttgctttggagatggtttctcgatgagctctgggagaggagccagcactagaagtcggcggtgttccagttcggtgatcagccatgaacacaggagactcaccgagtggagtttggctgagtcttgggttttccctaggttntacctttctttaaaaggngggttctcccaggttgtcctagggtcgactacgtgggttaggcggtacggttgggggggaacgtcgtcggggttaccaaggtcccggttgggggtaaccggttccccgtgggtaaccgtccgttcgttcccgttgtcggtcccgagtcgggtcctcgggttactttaccgaccccgtttacggagggtaaccgttccgtaagtagtaccgaagttcgaacctcggttacgggtcccgacgtacgggtacctacccggnggggtaaccgaaccggggnggttaacggtcgggggtaggggcggtaccgtaaagttttggaacgggttgtaacggtagttacgggttaagggttaaagtaacggtttaaaataccggttaacgtacgggtaaactaccggttcgggttaacggtaaacgggaccgttacccgtttaacgggtacccaacggtttacccttaaccgaaggtaaccgtaacctccgtaaaccgtaaagggaacccaacgggtttanaccgttagtacgaacgtaaagtaaccaagtacgcgtagaacgtcgcgtaaacgcgtaccggtgtagtag

SEQ ID NO: 94787 - DNA, 738 bp, Homo sapiens
  misc_feature: GYAE6OF02J2YSP.11.81.H04.1.454.CMB.1.raw
  modified_base (102)..(102): a, c, t, g, unknown or other
  misc_feature (102)..(102): n is a, c, g, or t
  modified_base (126)..(126): a, c, t, g, unknown or other
  misc_feature (126)..(126): n is a, c, g, or t
  modified_base (587)..(587): a, c, t, g, unknown or other
  misc_feature (587)..(587): n is a, c, g, or t
tcagcgagagataccacgaccggtgctcgatttagtagtgtagattcgcggggctgccctttggctttggagatggttttctcgatgagctctgggagaggngcccagcactagaagtcggcggtntttccattcggtgatcagcactgaacacagagacctcaccagtggagtttgggctgagtcttgggttttccctcggttcacctttcgttttaaaaggcggttcgtcccgaggttcgttccgaagggtcgtacctaaaggttggggtaggtacggttccggtggggggaacgtcggttacggttcccgaggtccggtgggaccgttcccgaggtactccgtccttccgtaggtcgacgcgtcccgttgtcggtaacttccgtaccgttgaaacgggtctctaatcgacgtagtcgccgtacggtcgggtcccgaccgtaggtcctacggagggacggaacgggtcgtgggtaggtcgggttcgactaggttagtgtacgtagtgaagttagtaaataaagtaactagtacgtggaactcggtacggtaaggaccggtctaacttcaacctagttccaaccgngtaactacctacgttaaaccgaacgttaaaccgttcggatttaccgacgttaacgaacgttaaacggaacccgtagtaacggaccgtaagaaccgggttaaacccgccggggttaaaacgcccggtaaacgggttcggtacgtttaaacgg

SEQ ID NO: 94788 - DNA, 863 bp, Homo sapiens
  misc_feature: GYAE6OF02IAMHO.11.81.H04.1.454.CMB.1.raw
tcagcgagagataccacgaccggtgctcgatttagtagtgtagattcgcggggctgccctttggctttggagatggttttctcgatgagctcgtgggagaggagcccagcactagagtcggcggtgtttccattcggtgatcagcactgaacacagaggactcaccatggagtttgggctgagcttgggttttcctcgtttgcttacttttaaggaggtcgtccaggttgtcgaggttcgcaacgttgggtaggaggtcggtggggggtaggccggttggtcccaggtccgtaggggacggttcccctaggacgtacctccgtccgtggtcgcgtacgtcgttcgtggtactttccgaccttcgaacggtagtaccttagtacgaacgtattcgccgtaaccggttcgggtcccgacccgtacggtccgtccggaacggggtaccggaacgggggtcgttagggggcggttacggggtcgggtaccgttagggtttaacgttacggttaggggttattacgggtaagggtttaaacggggttaaaaggtttaaacgttaaaaacgtttaccggtaaaggttaacggggtaacggtaacccggttaaccgggtaaacggggttaaacccgggtacccggttaacctttaacccggaacccgttaacgttaccccgttaaccgaaaaccggtacccgtaaacccgtttaacccgttaacccggtaaaacgggtaacccggttaaacgggttaccgttaacttccgtaacggtaaacgtaacgtaacggtaaacccgacgtacccggttaacgaacggaccggtacccggtaacggggaccgtaccgggttacggtacgttaacgg

SEQ ID NO: 94789 - DNA, 843 bp, Homo sapiens
  misc_feature: GYAE6OF02H6M1V.11.81.H04.1.454.CMB.1.raw
tcagcgagagataccacgaccggtgctcgatttagtagtgtagattcgcggggctgccctttggctttggagatggttttctcgatgagctcgtgggagaggagcccagcactagaagtcggcggttgtttccagttcggtgatcagcactgaacacgagagactcaccagtggtagtttggcgtgagtcgttgggttttccttcgttgtcctttacgttttaagcggttcgtccgaggttgtacgaggtcgaccaacgttgggtggtacgttcgggtagggggacggtcgttcggtccgtagcccggttaggggccggttccccgtaggacgtaccgttccgtaccgtggtacgccgacggtccgttcgtaggtaccttccgtaaccgttacggaagggtaccgtacgttaacgtaccgtaaaccgagttccgtaccggtaccggttccggggtaacccggcgtaacgggaccccgttcgggaaccgggaacggtaaggggtccgtagggtaaggggttcgggacgtaacgttaaggtttactaaggttggttaagtaggtaaacgttaagggttaaaatttaaacgtaaaattacgaaggttacggtaacgtaccggttaaccggtaggaacggtccgtaaccttaaccgtacgtaccgtacgttaacgaacggtaaccgtaaccctaaccggttaaccgaaaaccgtaacggtaacccggttagttaacgttaacgtaacgtaacgtaaacgttaaccggaaccgtttaacggccgttaacggaacggtacccggtaacggaaacccggtaacggtacccggttagttaaggttaacccg

SEQ ID NO: 94790 - DNA, 863 bp, Homo sapiens
  misc_feature: GYAE6OF02GFHJ7.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagtcgttcgggtttttcctcgttgccttacgttttaagaggttgtcctagtgtcaggttcgactaacgtgggtcggaggtcggtggggggacggtcggtcggtcccgagtcccgtggggtacggttccccgtgaaggtaccttccgtcccgtgtcgcaggccgttcgtggtacttccgtacccttgacgggtatcctagtacgaactacgttagacctaccgggttcggggtacccccgaccgtacggggtcccgtcccgggtaaacggggaacccggttaagggggtccggtacggggtaaggggtttcgggggtccggtaaccgggttaaaggttttaacgtaaggttttacggttttaagttaagggtaagtttaaagggggttaaaattttaaacgttaaaaacgttaaaccggttaaggttaacggggtaaactaccgggttaacccgggttaaggggaacccgggttaccgggtttaaccttacccgtaaccggaacctttacccgtaccgtaaagggtaacccgtaaccctttaacccggttaacccgaaaagttaaaccgggaacggttaccgttacttacgtagtaaccgtagtaaccggtaaagtcccgtacggttacggtacgtacgggtaacccggaaacggacccggtacggttaccgtagtttaacgg

SEQ ID NO: 94791 - DNA, 763 bp, Homo sapiens
  misc_feature: GYAE6OF02HW1RT.11.81.H04.1.454.CMB.1.raw
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
tcagcgagagataccacgaccggtgctcgatttagtagtgtagattcgcggggctgccctttggctttggagatggttttctcgatgagctctgggagaggagcccagcactagaagtcggcggtgttccattcggtgatcagcactgaacacagaggactcacatggagtttgggctgagtcttgggttttcctcgttgcttacgttttaaggaggttcgtacctaggttgtacgaagggtcgactaacgtggtagggaggtcggttgggggggagtcggttggtccagccgtggggacgtccctgacgctctcgtgtgacaggcgtctggtacttccacttcgaggtcnctatgactangtccgacgtcggtcccgacgtacggccttacggagggacggaacggggtcgtacgggtagggttcgggggtgtacgttaagtttagtacggtttggggtaattacgggtaaggttaaacgggttaaagtttaaaattaaaacgttaacgttacggtacggggtaaaccgtaccggttaccgggtaagggtaaacccgggttccgtaattacccgaaccgtaacgttacccgtaaccggaacgtaacgaacccgtaacgttaacccgaaaaggttaacccgtagttacggttaacctacggttacgtaacctaaacggtacgtaaaccgacggttaacccgacgggtaaggaacccgggacccgtaaagggtacccgtaccgggtttagtaccggtttaacgg

SEQ ID NO: 94792 - DNA, 604 bp, Homo sapiens
  misc_feature: GYAE6OF02F5V6D.11.81.H04.1.454.CMB.1.raw
  modified_base (419)..(419): a, c, t, g, unknown or other
  misc_feature (419)..(419): n is a, c, g, or t
  modified_base (590)..(590): a, c, t, g, unknown or other
  misc_feature (590)..(590): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggtagtttgggctgagctgggttttcctcgttgcttacgtttaaaaggtgtaccagtgtcgaggtgcaacgtggtggagtcgtgggggaggcgtggtccgagccgtggggacggtcccgtagacgaccttccgtccgtgtcgcacggtcgttcgtaggtacttccgtaccttacgaggtagctatggacatcgcgacggtcgggcccgaccgacggctccgaaggtacggaggggctgggaggtggggtgngttagttagtagtgtagtgagtaggtaagtaataatagtaggtacggagtaccgtcggagtacgggtactacgtcaccagtcctacgagtacactacctacgaacgtacgtacgtactcgtacagtacaagtgtaacacgtacgtagaagtcgaccggaggaaccgtcggngttacgtagttacg

SEQ ID NO: 94793 - DNA, 972 bp, Homo sapiens
  misc_feature: GYAE6OF02IL3X5.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagagactcacatggagtttgggctgagtcgttgggttttcctcggttgtcttacgttttaaggaggttcgtcctagttgtcgagggtcgactaacgtgggtggaggttcggtggggggaggcggttggtccaggtccgtggggacggttccccgtaggacgtaccgtccgtcgtacgtggcacggcgtcgtggtacttccgaccgtttcgaaggtacgtccttagtcggactacgtcgtccgtaacgttccggggccacccggacgggtccgttaccccgaacggggaccgggtaaacggggggtccgttaagggggtcgggtttcgggggggtcggaaacccggttaagggttttacgttaacggtttaggggttaacggttagggttaacgggtttaaaggggttaaaacgggttttaaaaagtttaaaacccggtttaaaaggttttaacggggtaacggttaaaccgggttacccggtttaaaccgggggtttaacgggaaacccgggggtttaacccggtaaaccgttttaacccgaaaccccgtaacccgtttacccggaaaccgggtaacggttaacccgaaaaaccccgtttaccgggttaaaacccgaaaccgggtttaaaaccccgggttagggttaaaccgttaaaccggtttaccggtaaaccggtaaaaacgtttaaaccggtaaaacgggaacccggtttaaaccgggttaacccgggtaacgggtaacccgggaaccggggttaaacccggggaacgtaaaccccggggttaccgtttacgggtttaaacggttttaaccggg

SEQ ID NO: 94794 - DNA, 581 bp, Homo sapiens
  misc_feature: GYAE6OF02GOPX4.11.81.H04.1.454.CMB.1.raw
  modified_base (213)..(213): a, c, t, g, unknown or other
  misc_feature (213)..(213): n is a, c, g, or t
  modified_base (343)..(343): a, c, t, g, unknown or other
  misc_feature (343)..(343): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgcaacgtggtggagtcgtgggggagcgtggtccagccgtgggagtccctgagactctcctgtgcagcgtcgtggattccaccttgaggagctatgacatgctacgtgggcccncaggcctacgaggcgagggctgggagtggggtgcgtagttatagtggtatagtagtaggtaaagttaataaagtactagtaggactacgtccggtaggaacgggtcctagttccactactccaccgagacgacctaacgttaccgaaacgaaccgtcggttatactcgtacgaactaaagtacggaacctcggacgtaggaacgacggtaccggaagtacggacggtacgtggttacg

SEQ ID NO: 94795 - DNA, 587 bp, Homo sapiens
  misc_feature: GYAE6OF02GJVZX.11.81.H04.1.454.CMB.1.raw
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
  modified_base (487)..(487): a, c, t, g, unknown or other
  misc_feature (487)..(487): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcggtggttcgcgtagcgtcttaagaggtgcagtgtcaggtcgcaacgtggtaggagtcgtggggagcgtggccaggtccgtgggacggtcctggagactcctcgtgtcgacagcgtcnggtactccaccttgacggntactagtgacntacgactcgtcgggtaccncgacggcctacgaggtcgaagggtcgtggacggtgggtgacgtagtaagtacgtgggtaatgtagtaggtaataaattaacgtatagtagtacgacgttcgtaggacggtccgtataccgcctataccgcgaagtanacgtaactcgaagtaccaaggtcctatccgtagtaactaaggtctacgacgtaccgtagaaccggacgcgggttaaccggaacgtcgggtatacggtacg

SEQ ID NO: 94796 - DNA, 868 bp, Homo sapiens
  misc_feature: GYAE6OF02IWJZV.11.81.H04.1.454.CMB.1.raw
  modified_base (224)..(224): a, c, t, g, unknown or other
  misc_feature (224)..(224): n is a, c, g, or t
  modified_base (349)..(349): a, c, t, g, unknown or other
  misc_feature (349)..(349): n is a, c, g, or t
  modified_base (462)..(462): a, c, t, g, unknown or other
  misc_feature (462)..(462): n is a, c, g, or t
tcagcgagagataccacgaccggtgctcgatttagtagtgtagattcgcggggctcgccctttggctttggagatgggtttttctcgatggagctctggggagaggagcccagcactagaagtcggcggtgtttccagttcggtgatcagcacagaacacgagagacctcaccatggagtttggctgacgcttggttttcctcgttgcctttacgttttaaggnggttctccgaggtgtcgagggttcactaacggttcgggtaggacggttcggtggggggaacggtccgtttgggccaggtcccggttggggtacggttccctaggacgtcctctccgtgtggaccnggtccgttcgtcgggtactttccacccgttacggaggtcgtacgtacgtacggtaacagtccggtaccgtacggttcccgggtcccgtacccgagggtacccttaaccggggnggaccggggtaacgggttcggtacggggtacgggttgggggtaacccggcggtttaacggtttttaaggaaggtttccggggttaattacgggtaagtttaacggggttaaagtttaaacgttaaagtttaacggttacggttaaggtaacccggttaaccggttcgggttaaccggtaaaccgggttacccggttaaccgtttaccgacccgtaaccgttaacccggttcccgaacgttaaacccggtacccgttaaacccgtttaaacccggaaagttaacccggttacccggttaagttaacctaccgttacgaacgttaaacggcgttaaaccgttaccgtacgtaacgggaccgtaacgggtaccggtaacggacccgtacgggtacgttacgtttaacgg

SEQ ID NO: 94797 - DNA, 672 bp, Homo sapiens
  misc_feature: GYAE6OF02ILNRZ.11.81.H04.1.454.CMB.1.raw
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
  modified_base (559)..(559): a, c, t, g, unknown or other
  misc_feature (559)..(559): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttaccagttcggtgatcagccactgaacacgagacggactcacagtggtagtttggctgagcgttgggtttcctcgttgtcttgtttaagnggttntccgagtgtcaggtgactacgtggtcggagtcggtgggggacgtcgtggtccgaggtccggtgggacgttccgtaggacgtactcctccgttgcgacgcgtcgtcgtgtacttcaccttcgagtcgtactatcgacgtacgtcgaccgtaccggtcgggtccccgaccgtaacggtccccgtacggaaccgggacggaaacggggtcgtagggggtacggttcggggtcggtacgtaggtttacgtaggttacggtaacgtggtaagttagggtaaacttaagtaaacttagtaggtacgtagtaccgtagggacggtacggtctaactcgtaacncgttcgaacgaagaccgtaccgtaccgtaacgaagtaaccgacgtagtacgtcctagaactaacgacgtacgactacgagtaacggcgtacggaggtacacggttgtagttcg

SEQ ID NO: 94798 - DNA, 880 bp, Homo sapiens
  misc_feature: GYAE6OF02F4CEE.11.81.H04.1.454.CMB.1.raw
  modified_base (221)..(221): a, c, t, g, unknown or other
  misc_feature (221)..(221): n is a, c, g, or t
  modified_base (435)..(435): a, c, t, g, unknown or other
  misc_feature (435)..(435): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacgagaggactcaccagtggtagtttgggctggagtcgttgggttttcctcgttgcttacttttaaggnggtctccgagtgtacgagggtgactaacgttgggtagggtaggttcggtaggggggaggtccggttagggtcccaaggccgtgggggaacggttcccctaggacggaccttccgttccccgtggtcgaccgtaggtcgtcgtagggtactttccgaccctttcggaagggtactcgtaagtcgaactagtcgtaccgtacgttcggggtccccnccgaagggtcccttaccgaagggccggtaaacgggggtcgttagggggacgggttagggggtacgggacgtttaaggtttaacgtaaggttacggggtttaacgtaggtaaaggttttaagggggtaaaaacgttttaaagttaaaaacgttaccggttaaaagggttcgggggtaaaaccgttaccccgggttttaacccgggtaaagggggtaaaccgggggtttaccttaaaccggttcccgtaaacccgtaacgtttacccctaaaccgggaacgggtaaaccgtaaccccttaacccggtttaaacccggaaaacgttaaaccccggtcggttttaacggtactaccggttacgtaaacctaaaggtacgaaacgtaccgtaccggtaagaaccgtaccgggaacccggtaggacccgtacggttaccgttagttaacgg

SEQ ID NO: 94799 - DNA, 710 bp, Homo sapiens
  misc_feature: GYAE6OF02GQSWV.11.81.H04.1.454.CMB.1.raw
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
  modified_base (345)..(345): a, c, t, g, unknown or other
  misc_feature (345)..(345): n is a, c, g, or t
tcagcgagagataccacgaccggtgctcgatttagtagtgtagattcgcggggctgccctttggctttggagatggttttctcgatgagcctactgggagaggagcccagcactagaagtcggcggtgtttccattcggtgatcagcactgaacacagaggactcaccatggagtttgggctgagctgggtttcctcgttgcttatttaagnggtgtccagttgtcaggttnctaacgtggtggacgttcggtggggggagcgttaggtccaggccgtggggacggtccctgacgtactctccgtgtcgctagcgtctggtacttccaccgttgaggatcgttangactatcgactacggtcgggtcccgcgtacgggtcctccggacggtaccggaaaggggtccgtaggggtacggttaggggtcggaccgtaaggtttaacgtaggtttacggtagtagggtaagttaagggtaaagttttaaagtaaaacgtttacgtaagttagggtaaccggtaaccgttcccgggttaaagggtaacggggttacctaacgttaccctaacctacgtcctaacccgaaggtaacgtaacccgttacgttaacccaagtaaacccgtaggttaacgtcttacgtagaacctaaggtcgaacgttcgtaccgtagtacggaccggaccggaaggaccgacggtcgtaggtaacgg

SEQ ID NO: 94800 - DNA, 851 bp, Homo sapiens
  misc_feature: GYAE6OF02F0ECZ.11.81.H04.1.454.CMB.1.raw
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagagactcaccatggagtttgggctgagcttgggttttcctgttgcttcttttaagnggtntccagtgtcaggtncaactggtggagtcgtggggggaggcgtggtccaggccgtggggaggtccctgagactctcctgtgcagcgttcgtggtacttccaccgtttcgagggtacgtcttaagtcggaactacgtcggcctacgttcggggtccccgacccgtaggggccctttaccccggaggggtaccggaaacggggggtccgtagggggtaacggggtttacggggggttcggtaccgttaaggggttttaaacttaagggtttacggggtttaagtttacgggtaacgggtttaagggggttaaaaggtttttaaacgttaaaaaagtttaaccgtttaaagggttacggggtaaacggtaacccgtttacccgggtaacgggtaaaccgggggtacccgttaacgtttacccgaacccgttaaccgttcccgttaacccgtaagggtaaccgtaacccgttaaaccgtttaacccgaaaaacgggtaacccgtaaaccgggtttgttaaaccgtccggttaggaaaccgttaaaacgtcggaaaacccgtacggtaccccgttaagggaaccggaccgggtacccgggtaacgggaaccccggaacgggtttaccgtagggtttaaccgg

SEQ ID NO: 94801 - DNA, 832 bp, Homo sapiens
  misc_feature: GYAE6OF02IF11Q.11.81.H04.1.454.CMB.1.raw
  modified_base (223)..(223): a, c, t, g, unknown or other
  misc_feature (223)..(223): n is a, c, g, or t
tcagcgagagataccacgaccggtgctcgatttagtagtgtagattcgcgggctgccctttggctttggagattggtttttctcgatgagctctgggagaggagcccagcactagaagtcggcggtgtttccagttcggtgatcagcactgaacacagaggactcaccagtggtagtttgggctgagtcgttgggttttcctcgttgctttacgttttaaggnggttcgtcctaggttgtcgagggttcgacgtaacgttgggtacgggtaggttcgggttggggggaggtccgggttcgggttacccgacgggtcccggttagggggtaccgggttccccgtggtaaccggtccttccgttcccgttggttaccgcgacggtccggttcgttacgggttacctttacccgtaccgtttacggaacgggtactaccgttaagtacgtaactaacgttcggaccgttacggttccgggtacccgcccggtaggtcccgtccggaaggggaccggaaggggttccgtaggggtacgggtcgggggtcgtacggtagtttacgttaggttaggtaagtcgggtaagttaagggttaaatttaaagtaaagttacgtaggtaagggtacgtaccggttaccggtaagggtaacccgtacttaccttccgaacctacgttaccgaacgtacgaacctacctaaccgttaaacgaaacggtacgtacggttacttaaccgtcgtaacgaacctaaacggtaacgaaccggtcgtaccggaacggtaacggaccggtaacccgggaggttaaacccgtcggttacggttacgtttaacg

SEQ ID NO: 94802 - DNA, 784 bp, Homo sapiens
  misc_feature: GYAE6OF02HTCXG.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtcgtgggggagcgtggtccagccgtggggacggtccctggacgactctcctgtgcagcgtctggattccgacctttcgaggacgccttagtcgacagtgacgacgttcggggtcccgccgaagggtcctacccgaggggtaccgaaaggggggccttagggggacggttggggggtacgggtaccggttaaaggttttaattacggttaggggttaagttgggtaaagtttaaggggtaaaaacgttttaaagttaaaaacgttaacgtttaaaggtggggtaaaccgttaccgttaccgggttaagggtaaacggggacccgttaacgtttaccgaaccctaacgttacccgtacccgtaaagggaaccggtaaaccctaaccgtttaacccgaaaaggtaaacccggttaacgggttaacgttaacgttccgttacgtaaccgtaaaaggtacggtaaaacccgacgtaacccggttaggaaccgggtacggacccgggaagggtaaccccggtaacgggtacccgtttaggtttaaccgg

SEQ ID NO: 94803 - DNA, 703 bp, Homo sapiens
  misc_feature: GYAE6OF02JWHAV.11.81.H04.1.454.CMB.1.raw
  modified_base (401)..(401): a, c, t, g, unknown or other
  misc_feature (401)..(401): n is a, c, g, or t
  modified_base (575)..(575): a, c, t, g, unknown or other
  misc_feature (575)..(575): n is a, c, g, or t
  modified_base (600)..(600): a, c, t, g, unknown or other
  misc_feature (600)..(600): n is a, c, g, or t
tcagcgagagataccacgaccggtgctcgatttagtagtgtagattcgcgggctgccctttggctttggagatggttttctcgatgagctctgggagaggacgcccgagcactagaagtcggcggtgtttccattcggtgatcagcactgaacacagacggactcaccagtggagtttggctgagcttgggttttcctcggttcgtcttacgttttaagacggttgtccgagttcgtcgaaggtcgactaacggtgggtggagttcggtggggggagtcggttggtccgtaggccgtggggacggtccctggacgtacgttcctccgttaggtcgacgacggtccgtcggtaggtacttccgtacccgtttcgaagggtactcgtttaacgtacggtaacncgttccgtaacgaccggttacggttccccggtacctaaccgggcccgttaccgaacggggtacgaacggggtcgtagggtagggttcggggtcggaccgtttaaggtttacggacgtttggaagttcgtaagtaaggttaacgttaataacgtagtagtcgtacgtacgtacgnggaacgtcgtaatcgactacgtacncgagatacctctacgtagaaccgttaggatacgtacgtagactacggtaacaacgtacgccgttacggagacgccggaagccccggaaggtcttaccggtacg

SEQ ID NO: 94804 - DNA, 779 bp, Homo sapiens
  misc_feature: GYAE6OF02F414O.11.81.H04.1.454.CMB.1.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
tcagcgagagataccacgaccggtgctcgatttagtagtgtagattcgcggggctgccctttggctttggagatggttttctcgatgagctctgggagaggagcccagcactagaagtcggcggtgttccattcggtgatcagcactgaacacagagactcaccatggagtttggctgagcttgggttttcctgttncttacttttaagnggtgtccagtgtcgaggtcgactaacgtgggtggagttcggtggggggaggcgtcggtccacggtcccggtaggggacggttcccctggacgtaccttccgttccctggtcgcgtacggtccgtcgttacggtactttccgtaccctttacggaagggtacgtaccttagtcgaactagtcggtacgtaccggttcggggtacccgaccggaacgggtccccgttaaccggacggggaccgggaaacgggggtccgtaggggtaacggggttcgggggtaggtaccggttaaggtttaacgtaaggttgggttaagtacggtaggtttaacgggtaaagttttaaataaaacgttaacgtaaggtaagggtaaccgtaaccgttcggttaagggaaccgggtacccgtacgttaaccacccgtacttaccgtaccgaacgtaccgtaaccaccgttaacgaaacgtaaaccgttacggtaagtacgtacgtcgaaacctaaggtaacgaacgtacggtacccgtaggaaccgacggacggtacggaacgtccgggtacggttgttaacg

SEQ ID NO: 94805 - DNA, 668 bp, Homo sapiens
  misc_feature: GYAE6OF02H30HS.11.81.H04.1.454.CMB.1.raw
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (211)..(211): a, c, t, g, unknown or other
  misc_feature (211)..(211): n is a, c, g, or t
  modified_base (388)..(388): a, c, t, g, unknown or other
  misc_feature (388)..(388): n is a, c, g, or t
  modified_base (400)..(400): a, c, t, g, unknown or other
  misc_feature (400)..(400): n is a, c, g, or t
  modified_base (441)..(441): a, c, t, g, unknown or other
  misc_feature (441)..(441): n is a, c, g, or t
  modified_base (461)..(461): a, c, t, g, unknown or other
  misc_feature (461)..(461): n is a, c, g, or t
tcagcgagagataccacgaccggtgctcgatttagtagtgtagattcgcgggctgccctttggctttggagatggttttctcgatgagctctggagaggagcccagcactagaagtcggcggtgtttccgattcggtgatcagcactgaacacagaggactcacagtggagtttggctggancttcgggtttccngttgcttcttttaagngttgccagttggtcaggtcgactaacgtgggtaggtaccggtgttagggggagccggttaggccgagccggtgggaccggtcccaggacgacttcgtcctagtcgtcgaagcgtacgtggatttccgaccttgacggtacgtactagtggaaccagtcgccgacgttggggtacccnccgtagggtccncccggtaaggccgaaaggggttcacgggtgtaacggggttnaaccggtagttagtttacgngttagtcgagtaacggtaaagttaagtaaacgtaacgtggtaacgtacggacttacggccggtaaggtacgtaatacgtacacgttacgtaccgagaccgtaagtaccgttaacgaaccgtaacgtaacggttaacgtgttacccgagtaacgtaacgtacgaacacgtacgaacgtggacgcggtaacgaacgtccgagtgtaacg

SEQ ID NO: 94806 - DNA, 694 bp, Homo sapiens
  misc_feature: GYAE6OF02FT3AW.11.81.H04.1.454.CMB.1.raw
  modified_base (214)..(214): a, c, t, g, unknown or other
  misc_feature (214)..(214): n is a, c, g, or t
  modified_base (648)..(648): a, c, t, g, unknown or other
  misc_feature (648)..(648): n is a, c, g, or t
  modified_base (655)..(655): a, c, t, g, unknown or other
  misc_feature (655)..(655): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttcgttttaagnggtcgtccagtgtcaggtgcaacgtgggtggacgtcgtggggggagcgtggtccgacgccgtggggacggtcccgtgacgacttcctccgtgtcgacagtcgtcgtaggtacttccgtaccgttcgaggacgcttagtgactagtgaccgtaaccgttcggggtccccgaccgacgggcctaccggaacgggcggaaacggggcgttaggggtagggtcggggttcggacgttaaggtttatagtagggttatggtaaggttaaggtaaagtttaataaaacttacgttaagtacgggtactaccgtaccgggttaaggaaccgggtaccgtaacttacccaccgtacttcccgtacgaacgtacgtaacctaaccgttaaccgaaacgtaaaccggtacggtagttactaccgtacgactaaagtcggaaacncgtacgngtaacggcggacccggaacggccgacggtcgtagtacgg

SEQ ID NO: 94807 - DNA, 759 bp, Homo sapiens
  misc_feature: GYAE6OF02JS1BK.11.81.H04.1.454.CMB.1.raw
tcagcgagagataccacgaccggtgctcgatttagtagtgtagattcgcgggctgccctttggctttggagatggttttctcgatgagcgtctgggagaggagcccagcactagaagtcggcggtgtttccagttcggtgatcagcactgaacacagagacctcgaccatggagtttggctgagcgttcgggtttacctcgttgtacttcgtttaagtaggtgtccgagtgtacgtaggtgtactaacgtggtggtacgttcgtggggtacgggtcgttacggtcccgtacggccggttacgggtacgggtccccgttaggacgtaaccgtcttcccgtaggtcgacgtcgtcggttcgtaggtactttaccgaccgtttacgaggtacgtacccgttagttccggaaacgtcgttaacggccgtaaccggttcggggtacccccgtaccgaaaccgggtccgtacccggtacgggtacggtaaacggggtccgttacggggtagttcggggttaccggtagtacgtttaaacgttggttacggtacgttaggtaacggtaaggtaagtaacgttaaagtactaggtacgtacgtactcccgggtaagtaccggtacgtacgtacgtaccacgttacaccgaagtaccgtacgtaccgtacgtaaacgacgtacggttatacgtcgaccgtagtaacctaggtaacacgtccgttaggaacgtcggtaacgccggtaacggtcgttacggtgttaacgg

SEQ ID NO: 94808 - DNA, 689 bp, Homo sapiens
  misc_feature: GYAE6OF02IBPKL.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttcctcgttgcttcttttaagaggtgtcctagtgtcaggtgcaacgtgggtggagtcggtgggggaggcggtggtccagccgtggggacggtcccctggacgacctcctcctggtgcagccgtcgtggtactttccaccttcgaggagctatgacatgcacgtcgggtcccacgaggctaccgagggacgtaacggggcgtaggggagggtcggggtgggtacgtaaggtttattaacggttgggtacgtaggtagttaagggtaaagtttaaataaaagttacgtaagtaggtaacgtaccgttacgggtaggaaacgggtccctaattacccaacctaccgttacgaccgtaaggaacaacccgttaccttaaccgaaaacgtaaccgtacggttagtaactcgtacgaaaccttaaagtcggaaaaccgtacgtaacccgtaagggacgaaccggaaccgggaaccgaacccggtacggtacggttaggttaacg

SEQ ID NO: 94809 - DNA, 759 bp, Homo sapiens
  misc_feature: GYAE6OF02HO0PV.11.81.H04.1.454.CMB.1.raw
  modified_base (310)..(310): a, c, t, g, unknown or other
  misc_feature (310)..(310): n is a, c, g, or t
tcagcgagagataccacgaccggtgctcgatttagtagtgtagattcgcggggctgccctttggctttggagatggttttctcgatgagctctggagaggagcccagcactagaagtcggcggtgtttccattcggtgatcagcactgaacacagaggactcaccagtggagtttgggctgagtcgttgggttttcctcgttgtcttacttttaaggaggttcgtccgtagtgtaccgaggtgactaacgtgggtaggaggtcggtgggggagtcggtacggtccaaggcccggtagggccggttacccnggacgtacctccttccgtagtcgacgtaggtccgttcgtaggtactttacccgtacccgttagaaggtacgtccgttagtcggtactagtcgaccgtacgggtccgggtacccgaccgtacggtaccctcccgggaagggtaccgggaacggggtcggtaagggtcggggttacgggggtacgtaacggttaaggtttaacgtacggtttagggtagtaggtacggtaaagggttaaacgtttaaagttaaaacgttacgtaagtcgggtaaacgttccggtaccggtaagggtaacggtcctaatcccgtaactcgtaccctaagaacgtacgtaaccgtaccgttaacgaacggtaaccgtagttacgtactcggtaagtaccgaaacgtcggaacgcgtacgtaggacgtaccggacggaacgtaccggtacgtcgttagttacgg

SEQ ID NO: 94810 - DNA, 805 bp, Homo sapiens
  misc_feature: GYAE6OF02JE4FT.11.81.H04.1.454.CMB.1.raw
tcagcgagagataccacgaccggtgctcgatttagtagtgtagattcgcggggctgccctttggctttggagatggtttctcgatggagctctgggagaggagcccagcactagaagtcggcggtgtttccattcggtgatcagcactgaacacagaggactcacatggagtttggctgagctgggttttcctcgttgcttcttttaagaggttcgtaccagttgtctaggtgacaacgttgggtagggagttcggtgggggggacggcggttcgggtccaggtccgtgggggacgttcccctggacgtaccttccttcccgtggtcgcaggtccggttctgggtactttaccgaccttacggaggtacggtccttaagtacggaactagtcggtaccgtaaccggttccggggtcccgcccgaaggggtcccttaccggacggggaaccggaaacgggggtccgtagggggtaggggttcgggggtcggtaacgtaaggtttaacgtagttacggggtagtaggtaaggttaaggggtaaaggttttaaactaaaacgttagttaacgtaacgggtacgtaccggttaccgggcgggaaacgggggtcccttacggttaaccctaccctaaagttccctacgaaggtaccgtacccgttaaaccgtaccgaaaaccggtaaccgtaaccggttagtaaccgtcgtacggtaaacaacggttaacaaacccggtacgtaaccggtacgggaaaccgtacggggaaccccggtaagggaccggtaccggtaagttccggttaacgg

SEQ ID NO: 94811 - DNA, 762 bp, Homo sapiens
  misc_feature: GYAE6OF02JWG8H.11.81.H04.1.454.CMB.1.raw
  modified_base (186)..(186): a, c, t, g, unknown or other
  misc_feature (186)..(186): n is a, c, g, or t
  modified_base (346)..(346): a, c, t, g, unknown or other
  misc_feature (346)..(346): n is a, c, g, or t
tcagcgagagataccacgaccggtgctcgatttagtagtgtagattcgcggggctgccctttggctttggagatggttttctcgatgagctcgtgggagaggagcccagcactagaagtcggcggtgtttccattcggtgatcagcactgaacacagaggactcaccagtggtagtttgggctagngtcgttgggttttcctcgttcgtcttcttttaaggaggttgtcagtgtcgaggtgcacgtgggtaggagtcggtgggggacggtcggttcggtccgacggtccggtagggggtcgggttccccgttggaacggtaccgtccgttccgtcggttggccggnggtacccggttcgtacggggtactttacccgtaccgttcgaagggtacgtaccgtagtacgtaacacgttcggaccgtacggtccgggtaccgcccggtaacgggtccgtaccggacgggtaaccggggtacgggtcgggtaagggttcgggggtacgggtacggtacggttaacggtttaggtacggtttacgggtagttaaggtagggttaagggtttaaagttaaagttaaacgttaacgttaggttacggtacggtaccggtccggtaaggtacggtacgtacctacgtactacctacgtacctagacgtactaacaacgtaacgacgtaacgtgttactacgtctaacgtacgtaacgacgtcgtaagacgtacggaccgaacggaccggtagaccggtcgtaggttacgg

SEQ ID NO: 94812 - DNA, 967 bp, Homo sapiens
  misc_feature: GYAE6OF02INP7E.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggtagtttgggctgacgtcgttcggggtttttcccttcggttcgcctttacgtttttaaggagggttcgtcccgaaggttgttaccgaagggttcgaccgtaaaccgttgggttacgggtaacggttccgggtagggggggaacggtccggttacgggtacccgacggtcccggttagggggacggttaccccccgtaggaacggtaccttccgttcccgttggtacgaccgtacggtccgttcgtagggttactttccgtaacccgttcgaacggggtacgaccttagtacgtacgtagttaccggtactaccggttccggggtacccgtccggtaacgggtcccgtaaccggaccggggtaaccgggtaaagggggtccggttacgggggtaaggggtttaccgggggttaggaaccggtttaaggttttaagtaccggttttaggggttaacgttacgggtaaacgggttaaagggttaaaacgttttaaacgttaaaaacgtttacgttaacgggtacggtaacggttaacccgttaccggggtaacgggtaaacccgggtaccgttaaaccggttaccctaaacccgttacgttacccggtaaccgttaacggtaacgtaaccccttaaaccggtttaacccgaaacgtaaacccggttacggttaaaccttacgttaacgtacgtaaacgttaacggtaaccggtaaaccgaacgggttccgtaaagggtaaccggtaacggaaccgggtaaccgggttaaccggtacccggttaccggtttacggttaacgg

SEQ ID NO: 94813 - DNA, 610 bp, Homo sapiens
  misc_feature: GYAE6OF02FOMY7.11.81.H04.1.454.CMB.1.raw
  modified_base (379)..(379): a, c, t, g, unknown or other
  misc_feature (379)..(379): n is a, c, g, or t
  modified_base (500)..(500): a, c, t, g, unknown or other
  misc_feature (500)..(500): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccagtggtagtttgggctgagcttgggttttcctcgttgcttcttttaaggaggtgtccagtgtcaggtgcaacgtggtggagtcgtgggggaggcgtggtccaggccgtggggacggtccctggagtaccttcctccgtggtcgaccgaggtccgtcgtggtacttccgaccgttcgaggacgtactatggactagtcgcgacgttcgggcccncgaggcctaccgagggcgaaggggctgggaggtggggtgcgtagttatgtaggtagtagagtaggtaagttaataaatacgtagtaggagtacgtcggtaggacggtcctacttccacctntcctacgagacgactacctacgaaacgtacgaggttatacgtactagaactaagtagaactacggacgtaggaacggacggccggaacggacgaccggtcgttagttacg

SEQ ID NO: 94814 - DNA, 595 bp, Homo sapiens
  misc_feature: GYAE6OF02G08VB.11.81.H04.1.454.CMB.1.raw
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
  modified_base (342)..(342): a, c, t, g, unknown or other
  misc_feature (342)..(342): n is a, c, g, or t
tcagcgagagataccacgaccggtgctcgatttagtagtgtagattcgcggggctgccctttggctttggagatggttttctcgatgagctctgggagaggagcccagcactagaagtcggcggtgttccattcggtgatcagcactgaacacagaggactcaccatggagtttgggctgagctgggttttcctcgttgcttcttttaagaggtgtccagtgtcaggtgcactggtggagtcgtgggggagcgtggtccaggcctgggacggtccctgagactctcctgtgcagcgtctggtacttccaccttgagganctatgacntgcacgtcgggtccnccgaggcctccgaggcgaaggggtctagggaggtggggtgacgtagttagtagtggtatggtagtaggtaaagtttaataaagtacgtagtagggaactaccgttacggtaggaacgggacctataccgacctagtcctacgaagtacgactaaccttaccgaaagtacgaggttatacgtctacgaacctaaggtacgaactacggtaccgtaggaggtaccgaccggaaggaccgtacggtcgtagtacgg

SEQ ID NO: 94815 - DNA, 636 bp, Homo sapiens
  misc_feature: GYAE6OF02FJSJQ.11.81.H04.1.454.CMB.1.raw
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
  modified_base (283)..(283): a, c, t, g, unknown or other
  misc_feature (283)..(283): n is a, c, g, or t
  modified_base (351)..(351): a, c, t, g, unknown or other
  misc_feature (351)..(351): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttcgggttttcctcgttgctcttttaagnggtgtccagtgtcaggtncaacgtggtggagtcgtgggggagcgtggtccaggcctgggagtccctgacnctctcctgtcgcagcgtctggtattccaccttgaggagtctaatgactagtcgacacgttcgggtccnccgtaggcctaccgaggacgaacgggggtctagggaggtcgggggtagtccgtaaggtttactagtcggtatagtagtgggtaaacgttaataaacgtacgtagtacgagtacgtcggttaggaggtacgtactcgactactctacagacgtaacctaccgttaccgaaagtaaccgtacggttacgtacgttccgtagtaacgtaacgtaacggtaacgaaccgttacgtacggaacggaacggtaccgggaaacgtacccggaacggtccgtttaagttacgg

SEQ ID NO: 94816 - DNA, 670 bp, Homo sapiens
  misc_feature: GYAE6OF02IIZAB.11.81.H04.1.454.CMB.1.raw
  modified_base (180)..(180): a, c, t, g, unknown or other
  misc_feature (180)..(180): n is a, c, g, or t
  modified_base (465)..(465): a, c, t, g, unknown or other
  misc_feature (465)..(465): n is a, c, g, or t
  modified_base (556)..(556): a, c, t, g, unknown or other
  misc_feature (556)..(556): n is a, c, g, or t
tcagcgagagataccacgaccggtgctcgatttagtagtgtagattcgcggggctgccctttggctttggagatggttttctcgatgagctctgggagaggagcccagcactagaagtcggcggttgtttccattcggtgatcagcactgaacacagagactcacatggtagttggctgngtcgtttggtttcctgttgtcttacgttttaaggcggttcgtaccagttgtacgaggtcgactaacggttgggtaggtacggtcggtaggggggacggtcggttcggtaccgacggtccggtagggggtaccggttccccgtaggtacgaccttccttccgttggcgtacacggtcgttcggtcggttactttcccgaccgttgaacggtagtctaacgtgaaactagtcgaccgacggtttcgggacccggcgtaggccctcggaaggaccggagggtcgtggngggtgggtgacttagttaagtgttagtagttgaagttaagtaattaaatatacgtagtcgagtacgtcggaagtacggctactacgacctntaccacgagaacctacctactaaccggaagtaacgtacggttagtactgtagtaacgtagacggtaaccgcgtaagtacgacgaccggagtaccggcgttagtagttcgttacg

SEQ ID NO: 94817 - DNA, 922 bp, Homo sapiens
  misc_feature: GYAE6OF02IBID3.11.81.H04.1.454.CMB.1.raw
tcagcgagagataccacgaccggtgctcgatttagtagtgtagattcgcggggctgccctttggctttggagatggttttctcgatgagctctgggagaggagcccagcactagagtcggcggtgtttccagttcggtgatcagcactgaacacaggaggacctcaccatggtagtttggctggagtcgtttgggtttcctcgttgtcttacgttttaaggaggtgtcctaggttcgtacgagggttacgaccgtaacgtggggtggacggttcgggtcggggggaacggtcggtacgggtacccaggtcccggtggggtaccggttcctaggactaccttccgtccgtgtcgacgtacgtcgttcgtaggtactttccgaccttggacgtacgacgtagtacgactagtcgtaccgtacggtcgggtcccgaccgacggttccaaccgggtacgggaccgggaaacggggttcgtaacgggggtcggggttaacgggtcgggtacggtttaaacggtttagtaagggtttacggttaacggtaagggttaacggtttaagggttaaaacgttttaaacgtttaaaacgttacggttaagggttaacgggtaaccgttaaccggttccggggttaaacgggtaaaccgggggttccctttaaacgttaacccgtaacccgtacgtttccccgtaaaccggtaacggtaacccgtaaacccgttacccgttaaaccgaaaaccgggttacccgttaaccgggttaacttaaccgttccggtaaaccgtaacggttaaaacccgtaccggtaaaacccggacggttaacccccgggttaaagggtaacccgggtaaacccgggtacccgggtaaaccgggttaacccgggtcccgggtttaaccgggttaccggttttaacggg

SEQ ID NO: 94818 - DNA, 754 bp, Homo sapiens
  misc_feature: GYAE6OF02HKCAB.11.81.H04.1.454.CMB.1.raw
  modified_base (227)..(227): a, c, t, g, unknown or other
  misc_feature (227)..(227): n is a, c, g, or t
  modified_base (321)..(321): a, c, t, g, unknown or other
  misc_feature (321)..(321): n is a, c, g, or t
tcagcgagagataccacgaccggtgctcgatttagtagtgtagattcgcgggctgccctttggctttggagatggttttctcgatgagctctgggagaggagcccagcactagaagtcggcggtgtttccattcggtgatcagcactgaacacagaggactcaccatggagtttgggctgtagtcgttcgggttttcctcggttgtaccttacgttttaaggaggtntaccgtaggtgttacgagggtagccgtaacgtggggttgggagttccggagggggtacggtcgtacggtccaggtccgtggggacgttccccgngacgtaccgtctccggtagtcgcgtacggtccgttacgtcggactttcccgtaaccgtttcgggaaggtacgtactttaacgtcgaacgttacgtccggtaccgtacccgggttccgggaccccggtaccgtccgggtacccgtacggaacggggtacggtacgggggttctgggggtaggtcgggtaggacgttaaggtttagtaggtggttagtagtaggttaaggttaagtaataacgtataggtacgtacggccgttacggtacgaccgggtactactaccgactaccgtcgtaacgcgtactaaccgtaccgttaaccgaacgtacgtagtacgtacgttacgacgtaagtactacggtaaccggtcgtaaccggacggtaacgaacggggtaccgacggtacggtaccggttagttacggttaacgg

SEQ ID NO: 94819 - DNA, 721 bp, Homo sapiens
  misc_feature: GYAE6OF02ILSSQ.11.81.H04.1.454.CMB.1.raw
  modified_base (502)..(502): a, c, t, g, unknown or other
  misc_feature (502)..(502): n is a, c, g, or t
  modified_base (527)..(527): a, c, t, g, unknown or other
  misc_feature (527)..(527): n is a, c, g, or t
  modified_base (559)..(559): a, c, t, g, unknown or other
  misc_feature (559)..(559): n is a, c, g, or t
  modified_base (591)..(591): a, c, t, g, unknown or other
  misc_feature (591)..(591): n is a, c, g, or t
  modified_base (674)..(674): a, c, t, g, unknown or other
  misc_feature (674)..(674): n is a, c, g, or t
  modified_base (712)..(712): a, c, t, g, unknown or other
  misc_feature (712)..(712): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacaggaggactcaccatggagtttgggctgagctgggttttcctgttgcttctttaaggaggttgtaccgtagtgtcagggtcgactaacgtgggtggaggtcggtggggggaggtccggttggtcccaagggccccgttgggggtacggttcccccgtaggaacggtacctcccgtccgttcggtgacccgagggttccgttccgtagggtacttttacccctaaccccgtttagaacggggtacggtaccttaaggttaccgaataagttccggaacgtcccgggttcggggtacccccgccgtaacggggccctaacccggtaggggtaccgagggggcgttcgggnggttacggggtgaaccgtgtttagnggtcgtagtgagtagggaaagttacttaaatntaggtagtcacgtagttacggagtcgtatccnctatcccgtacgcgagtacctacttacccgaaacgaccgtacggtaagttgtaaccctaggaccctaagttaaaccaaccggngtacccgtggaacgaccgggacggccggactaccggtntaggttccg

SEQ ID NO: 94820 - DNA, 196 bp, Homo sapiens
  misc_feature: GYAE6OF02INJKP.11.81.H04.1.454.CMB.1.raw
  modified_base (148)..(196): a, c, t, g, unknown or other
  misc_feature (148)..(196): n is a, c, g, or t
tcagcgagagataccacgaccggtgctcgatttagtagtgtagattcgcgggggctgccctttggctttggagatggttttctcgatgagctctgggagaggagcccagcactagaagtcggcggtgtttccattcgggtgatcagcnnnnnnnnnnnnnnnnnnnnnnnnnnnnnnnnnnnnnnnnnnnnnnnnn

SEQ ID NO: 94821 - DNA, 954 bp, Homo sapiens
  misc_feature: GYAE6OF02G0EFG.11.81.H04.1.454.CMB.1.raw
tcagcgagagataccacgaccggtgctcgatttagtagtgtagattcgcgggctgccctttggctttggagatggttttctcgatgagctctgggagaggagcccagcactagaagtcggcggtgtttccattcggtgatcagcactgaacacagaggactcaccatggagtttgggctggagtcgttgggttttcctcgttgcttacttttaaggaggtgtccagtgtcgaggtcgactaacgtgggtcggagtcggtggggggaggtcgtcgggtccaggccgtggggacggtcccctaggacgtacctcttcccgtggtacgccgaacgtccggttcgttggggtaacctttccgaacccgtttcggaacggggtaacgcctttaagtacgaaccgtagttacggacccgtaccggttccgggggtaccccgacccggtaaccggggtcccctttacccggggaacgggggtacccgggtaaaaggggggggtcccgtttaaggggggtacggggtttacgggggggggttacccgggtaaaggtttaacgggtttttaaagtttaccgggttttagggggttaagtttaaggggttaaacgggttttaaaggggttaaaacgggtttttaaaacgtttaaaaaaccgtttaaaccggttttaaaaggggttacgggtaaaacgggtttaaccccggtttaacccggggttaaacggggtaaaacccgggggttacccgttaaaccggtttaccccgtaaacccgttaccgttaccccgtaacccggtaaacgggtaaccgttaaacccgtaccgtttaacccgaaaaggtaaacccgttaccgggttacgttaacgtcgtaacgtaaccgtaaacggtacggaaaccgtacgttacccgtaggtaacgggaccgtacgggaaacggaccgtaccggtacgttaggtacgg

SEQ ID NO: 94822 - DNA, 736 bp, Homo sapiens
  misc_feature: GYAE6OF02HPNI4.11.81.H04.1.454.CMB.1.raw
  modified_base (196)..(196): a, c, t, g, unknown or other
  misc_feature (196)..(196): n is a, c, g, or t
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggagtttgggctgagcttgggttttccngttgctcttttaagaggtgtccagtgtcaggtgcaactggtgagtcgtgggggagcgtggtccagcctgggacgtcctgagactctcctgtgcagtcgtctggacttccgaccttcgaaggtagctattcgaactagtcgactacgtcgggcccgtaccgaggtcctaccgaggaccgaaagggggtctagggagggtcggggtggacgtaaggtttagtagtacgggtagtaggtaacgttagggtaaacgtttaaagttaaacgttaacgttaaggtacgggtaacgtaccggttcccggtaaggggtaaaccgggtcccgttaaacgttcccgaacccgtaacgttaccgttacccgaaaggtacgtaaaccgttacccgtttaaccgtaaaacggtaaaccgtaaacggtaacgttaacgttaccgttacggtaacgttaaacggtaaccggtaactaaccgggtaccgttaacggtaacggaaccggtacccgggaaaggtaacccggtaaccgggtacggtttacggttaacgg

SEQ ID NO: 94823 - DNA, 811 bp, Homo sapiens
  misc_feature: GYAE6OF02HUZYI.11.81.H04.1.454.CMB.1.raw
  modified_base (362)..(362): a, c, t, g, unknown or other
  misc_feature (362)..(362): n is a, c, g, or t
  modified_base (394)..(394): a, c, t, g, unknown or other
  misc_feature (394)..(394): n is a, c, g, or t
  modified_base (447)..(447): a, c, t, g, unknown or other
  misc_feature (447)..(447): n is a, c, g, or t
  modified_base (715)..(715): a, c, t, g, unknown or other
  misc_feature (715)..(715): n is a, c, g, or t
tcagcgagagataccacgaccggtgctcgatttagtagtgtagattcgcggggctgccctttggctttggagatggttttctcgatgagctcgtgggagaggagcccagcactagaagtcggcggtgttccattacggtgaatcagccacgtgaacacgagacgactcacctagtcggtaggtttggactggacgtcgttgggttttaccctcgttcgtcgtttacgttttaaggaggttcgtaccgtaggttcgtacgaggttacgaccgtaacgtggggtaggacgttcgggaggggacggtcggtcggtacgacggtccgtaggggactcccgtagaccgcttccgttcgtggacgtcncggtccgttcttaggctttaccaccgttaggngacgtctaggcgaactgtcgaccgtacggtccggtaccgccgtacggttaccnccggtaaggaccgggtacgggcgttaggggtcgggtagggctacggttaagtttaggacggtttaggtacgttggtaaggttaacgggttaagtttaaacgttaaacttacggttaacggtacgggtaacgttacggttaacccggggtaacgggtaaccgggttacccgtaacgtttaaccaccgtaaccgttcctaaacccggaagttacccgtaaccgtaaccgttaaccggtaaacggttaacccgttaaggtacgttaaccgnttaaccggaacgttaaacggtaacgtaaccgtaacggttcggaacggaccggtaacggaccggacggttaaccggaccggtttgtacggttaacgg

SEQ ID NO: 94824 - DNA, 810 bp, Homo sapiens
  misc_feature: GYAE6OF02HKNDY.11.81.H04.1.454.CMB.1.raw
  modified_base (676)..(676): a, c, t, g, unknown or other
  misc_feature (676)..(676): n is a, c, g, or t
tcagcgagagataccacgaccggtgctcgatttagtagtgtagattcgcggggctgccctttggctttggagatggttttctcgatgagctcgtgggagaggagcccagcactagaagtcggcggtgtttccagttcggtagatcgagcactggaacacgagagactcaccagtggtagttggctggagtcgttgggtttcctacggttgcctttattttaaaggcgggttcgtacctaggttgtacgtagggtgaccgtaacgttgggtacggtaggttcgggtggggggacggtcggttcggtaccgacggtaccggtggggtaaccggttcccctgggaacgtaccttccgttccgttaggtacgccgtaaggtcccgttacggtcggtaccttaccgtaccgttcggaacgggtataccgtagcgaacgtgttacgaccggttaccggtcgggtaccccgacggtacggtccgaccgggtaggaaccggtacggggtcggtaggggtacggggttcggggtacgtaacgttaacggtttaaggttaaggtagggtttgtaagggttaacggttaaaggggtttaaaatttaaacggttaaacgttaaggttaacggttacgggaacgtaccgtcgggtaacggtaacggtaccgttacgtaaccacccgttntaaccgaccgtacgtaaacggtacctaaaccgttaacgaaccggttaaaccgtagttacgttacgtaccgtagaactaacgaacgtacgacgtagtaccggagaccgtacgaggtaccggtacgtgtagttacg

SEQ ID NO: 94825 - DNA, 617 bp, Homo sapiens
  misc_feature: GYAE6OF02GKGN1.11.81.H04.1.454.CMB.1.raw
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (317)..(318): a, c, t, g, unknown or other
  misc_feature (317)..(318): n is a, c, g, or t
  modified_base (321)..(321): a, c, t, g, unknown or other
  misc_feature (321)..(321): n is a, c, g, or t
  modified_base (383)..(383): a, c, t, g, unknown or other
  misc_feature (383)..(383): n is a, c, g, or t
tcagcgagagataccacgaccggtgctcgatttagtagtgtagattcgcggggctgccctttggctttggagatggttttctcgatgagctctgggagaggagccccagcactagaagtcggcggtgtttccattcggtgatcagcactgaacacagaggactcaccatggagtttgggctgagcttgggttttcctcgttgcttctttaagaggtctccagtgtcaggtncaatggtggngtcgtggggagcgtggtcagccgtgggcgtcctgagctctcctgtgcagcgtctggattccaccttgaggcgctannacntcgcgtaccgtcgggtaccgccgtaggcctacgacggacggaagggtcgtgggagttggggngtaccgtagttgtaagtggtatgtacgtaggtaaattataaactcgtagtacggacgtaccgtcggtaagggtacgccgtacttaccgaaccctactcctaaccgagacgtaaccctacgttaaccgaacgtaaaccgtacgttacggtaactcgttacgtaacgtaacgtacggaacgtaccggtacgtacggaaggaccggccggaaggacccggtacggtagtcgttaagg

SEQ ID NO: 94826 - DNA, 778 bp, Homo sapiens
  misc_feature: GYAE6OF02HNWOU.11.81.H04.1.454.CMB.1.raw
  modified_base (126)..(126): a, c, t, g, unknown or other
  misc_feature (126)..(126): n is a, c, g, or t
tcagcgagagataccacgaccggtgctcgatttagtagtgtagattcgcggggctgccctttggctttggagatggttttctcgatgagctctgggagaggagcccagcactagaagtcggcggtntttccattcggtgatcagcactagaacacagagactcaccatggtagtttgggctgagtcttgggttttcctcgttgtctttacttttaaggaggttctcgtagttgtcgtagggtcgacgtaacgttgggtaggtaggttcgggtggggggacgggtcggttcgggtaccctaggtcccgggttggggtaacccgggttcccctagggaccgtacccgtttctccccgttagtcgtaccgacggtccggttacgtggtacctttccgtacccgtttacggaggaccgtcgttagtacgtaactagttacgccgttacgggttaccgggtcccgaccgtacgggccgtaccggaaggggacggaacggggttcgtgggtaggggttcggagggtacctagtttagtagttaggtagtaggtagttaaggtaaagtttactaaacgttgtaaggtcggaaacgtcgtaaccgggttaggtaaacgggtcccttaacgttacccgacttacccgttagacgaacgttacgtaacctacctaacggtaaacgaacgtcggtacgttagtaccgcgtaaactagaaacgacctacggtcgtaaaggggccgttaaccggaacggaaccgtaccggtcgggttactaccggtttaag

SEQ ID NO: 94827 - DNA, 775 bp, Homo sapiens
  misc_feature: GYAE6OF02JV093.11.81.H04.1.454.CMB.1.raw
tcagcgagagataccacgaccggtgctcgatttagtagtgtagattcgcggggctgccctttggctttggagatggttttctcgatgagctctgggagaggagcccagcactagaagtcggcggtgtttccattcggtgatcagcactgaacacagaggactcaccatggtagtttgggctagagtcgtggtttctcgttgcttctttaagaggtcgtccgtagtgtacgtaggtcgactaacgtggttcggaggttcggttacgggggagtcgttacggtaccaacggtccgttaggggacggtaccgtggtaacggtacttcctacgtcggtgtccgacggtccgtcggttcggtaccttccgtaccgttacgtacgggtaactcgttaagtacgtacgtaacggtcgtacgaccggttccgggttacccgacctaaggggtccctaccggtacgggtaccggaacgggggtctaggggtaaccgggttggggtaacggtacggtaacgtttactaggttacggtacgtaggtaagttaggtttaaacgttaactaaacgtacgtaacgttacggtacgtacgttaccggtaaggtacggtaccggtactaccgtacgtaacgttcgtccggtaacgaacgtacccgtaacgttaccgaaacgaacgttacgtacgttaacgtaccgtagtaacgtacgtaaccggtaactaccggaaccgttaggaccggtaacgttccggaagtaccggtaacgtcccgttagttaaccgg

SEQ ID NO: 94828 - DNA, 704 bp, Homo sapiens
  misc_feature: GYAE6OF02I7LHE.11.81.H04.1.454.CMB.1.raw
  modified_base (103)..(103): a, c, t, g, unknown or other
  misc_feature (103)..(103): n is a, c, g, or t
  modified_base (138)..(138): a, c, t, g, unknown or other
  misc_feature (138)..(138): n is a, c, g, or t
  modified_base (249)..(249): a, c, t, g, unknown or other
  misc_feature (249)..(249): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (436)..(436): a, c, t, g, unknown or other
  misc_feature (436)..(436): n is a, c, g, or t
  modified_base (551)..(551): a, c, t, g, unknown or other
  misc_feature (551)..(551): n is a, c, g, or t
  modified_base (559)..(559): a, c, t, g, unknown or other
  misc_feature (559)..(559): n is a, c, g, or t
  modified_base (570)..(570): a, c, t, g, unknown or other
  misc_feature (570)..(570): n is a, c, g, or t
tcagcgagagataccacgaccggtgctcgatttagtagtgtagattcgcggggctgccctttggctttggagatggttttctcgatgagctctgggagaggancccagcactagaagtcggcggtgttccattcggtnatcagcactgaacacgagaggactcaccatggtagttggctgagtcgttgggtttcctcgttgcttacttttaacggaggtgtcctagtggtcaggtcgacagttggtggngtcgtgggggacgtcgtcggtccaggcgttagggacggttccctaggngtaccttcgtcctggtacncgtagtcgtcgtacggtacttcaccgttacgagaccgtatagtcgaacgttagcgtagtaccggttgggccccgtgtaaccgtccgtacccggaggaaccggggacggttggtaacgggnggttcggggtcgtaacgttagttaaccgtaggttaggtaccgttggtaaagttaagggttaacttaaagtaaacttacgtacgaaggtaccgtacgtaggtacgaacgtccgtancctactanccgtaaccggngtaacgtacgtacccgtaaagtaacgaacggtttacggacttagtcgtataacggttaaggaacccttcggtaacgtacgtaccgggtaaggtacgaaccgggtacccgaccgtacgggttacttaggttaacg

SEQ ID NO: 94829 - DNA, 835 bp, Homo sapiens
  misc_feature: GYAE6OF02H769Y.11.81.H04.1.454.CMB.1.raw
  modified_base (231)..(231): a, c, t, g, unknown or other
  misc_feature (231)..(231): n is a, c, g, or t
  modified_base (371)..(371): a, c, t, g, unknown or other
  misc_feature (371)..(371): n is a, c, g, or t
tcagcgagagataccacgaccggtgctcgatttagtagtgtagattcgcggggctgccctttggctttggagatggttttctcgatgagctctgggagaggagcccagcactagaagtcgggcggttgtttccgattcggtgatcagcactagaacacagaggactcacctatggtacgtttagggctgagtcgttcgggttttcctcgttcgtcttacgttttaaacggnggttcgtcgtaggttcgtaccgtaggttcgactacggttgggttacggacggttccggtagggggggaccgtcggttcggtacccgaggtcccggttagggaccgggttcccctggaacgtaccgtccttccggtggtcncggtacgtcgttacggttggtacgttcccgtaccgttaccgaggtacgtaaccttagtcggaacgtagtcgaccgtaccggttcggtaccccggtacaccgggtccctaccgggacggtaccggtaaacggggtcgtagggggttcgggttacggggtgtacccggttaaaggtttcgtaagggttaggttaggttaacgggtacggtttaaaggggttaaacgtttaaacgttaaagtaaacgttaacggtacgggtaacgttacccggtaacggttacgggaaccgggtaccgttaccggtacctacccggtaacctcgtaaccgtaacggtaacctacgaacccgttaacgaacgtaaaccgtccggtaactacgtacttagtaaccgaaagtcgaaaccgtcgtaacgtaccgtaacggaccgtaacgggccgtaaccggacggttaccgtcgttaacgg

SEQ ID NO: 94830 - DNA, 169 bp, Homo sapiens
  misc_feature: GYAE6OF01DD3HV.39.25.C03.1.454.CMB.1.raw
  modified_base (169)..(169): a, c, t, g, unknown or other
  misc_feature (169)..(169): n is a, c, g, or t
tcagtcgcactagtcacgaccggtgctcgatttagtagtgtagatttgggtttgggaagaggaagactgacggtcccaggagttcaggtgctgggcacagcggccctgggctgcctggtcaaggactacttccactagtgcgactgagcgggctggcaaggcgcatagn

SEQ ID NO: 94831 - DNA, 173 bp, Homo sapiens
  misc_feature: GYAE6OF01CEI6V.39.25.C03.1.454.CMB.1.raw
  modified_base (173)..(173): a, c, t, g, unknown or other
  misc_feature (173)..(173): n is a, c, g, or t
tcagtcgcactagtcacgaccggtgctcgatttagtagtgtagatttgggtttgggggaagaggaagactgacggtcccccaggagttcaggtgctgggcacagcggccctgggctgcctggtcaaggactacttccactagtgcgactgagcgggctggcaaggcgcatagn

SEQ ID NO: 94832 - DNA, 263 bp, Homo sapiens
  misc_feature: GYAE6OF01EHYTG.39.25.C03.1.454.CMB.1.raw
  modified_base (261)..(263): a, c, t, g, unknown or other
  misc_feature (261)..(263): n is a, c, g, or t
tcagtcgcactagtcacgaccggtgctcgatttagtagtgtagatttgggtttgggggacagaattcactctcaccatcagcagcctgcagtctgaagactttggagtttatttctgtcagcagtataataactggcctctgtcctggacgttcggccaagggaccaaagtggaaatcaaacgaactgtggctgcaccatctgtcttcatcttcccgccatctgaactagtgcgactgagcgggctggcaaggcgcatagnnn

SEQ ID NO: 94833 - DNA, 277 bp, Homo sapiens
  misc_feature: GYAE6OF01CCEOG.39.25.C03.1.454.CMB.1.raw
  modified_base (251)..(277): a, c, t, g, unknown or other
  misc_feature (251)..(277): n is a, c, g, or t
tcagtcgcactagtcacgaccggtgctcgatttagtagtgtagatttgggtttgggtgcccaagctgcctggagggcacggtcaccacgctgctgagggagtagagtcctgaggactgtaggacagcccatcggtcttccccctggcaccctcctcctaagagcacctctgggggcacagcggccctgggctgcctggtcaaggactacttccgactagtgcgactgaggcgggctggcaaggcgcatagnnnnnnnnnnnnnnnnnnnnnnnnnnn

SEQ ID NO: 94834 - DNA, 181 bp, Homo sapiens
  misc_feature: GYAE6OF01DY3PA.39.25.C03.1.454.CMB.1.raw
  modified_base (173)..(181): a, c, t, g, unknown or other
  misc_feature (173)..(181): n is a, c, g, or t
tcagtcgcactagtcacgaccggtgctcgatttagtagtgtagatttgggtttgggggaagaggaagactgacggtcccccaggagttcaggtgctgggcacagcggccctgggctgcctggtcaaggactacttccactagtgcgactgagcgggctggcaaggcgcatagnnnnnnnnn

SEQ ID NO: 94835 - DNA, 568 bp, Homo sapiens
  misc_feature: GYAE6OF01B683V.39.25.C03.1.454.CMB.1.raw
  modified_base (423)..(423): a, c, t, g, unknown or other
  misc_feature (423)..(423): n is a, c, g, or t
tcagtcgcactagtcacgaccggtgctcgatttagtagtgtagatttgggtttggggacataacaaccgcattcctcctctaaagaagcccctgggagcacagctcatcaccatggactggacctggaagttcctctttgtggtggcagcagctacaggtgtccagtccctggtgcagctgctgcagtcggggactgaggtgaaggagcctgggtcctcggtgagggtctcctgcaaggcttctggaggcaccttcggcaactatcctatcacctgggtgcgacacggcccctggagaaggactttggaggtggggtgggaggcatcactccctgcttgctacaccaacctacgcacagaaacttccgaagcagacgtcacgattccgctgacgatccacgacacggcctatctaagactgancagccttaagtctaggacgacacggactatttacttactgtcacaagagactaccaccctacctcgtacgggtcggggacccgaaacggggacccgtacgggtaccctacccgttcctacccgttcgaccgtccccgtaaccccg

SEQ ID NO: 94836 - DNA, 538 bp, Homo sapiens
  misc_feature: GYAE6OF01EAZ73.39.25.C03.1.454.CMB.1.raw
  modified_base (207)..(207): a, c, t, g, unknown or other
  misc_feature (207)..(207): n is a, c, g, or t
  modified_base (526)..(526): a, c, t, g, unknown or other
  misc_feature (526)..(526): n is a, c, g, or t
tcagtcgcactagtcacgaccggtgctcgatttagtagtgtagatttgggtttggggacataacaaccgcattcctcctctaaagaagcccctgggagcacagctcatcaccatggactggacctggaagttcctctttgtggtggcagcagctacaggtgtccagtccctggtgcagctgctgcagtcggggactgaggtgaaggngcctgggtcctcggtgagggtctcctgcaaggcttctggaggcaccttcggcaactatcctatcacctgggtgcgacaggcccctggagaaggacttggaggtggggtgggaggcatcatccctcgctttgctacaccaacctcgcacagaaattccaaggcagagtcacgatttccgctgacgaactccacgaacacggctatctagaactgagcagccttaagctagagacacgacctatttattactgtgcaagagtatccacctctacgacggtagggaccgaacgggaccgacgggaccgtaaccgtctcctcncgccctaacccg

SEQ ID NO: 94837 - DNA, 855 bp, Homo sapiens
  misc_feature: GYAE6OF01CVS9Y.39.25.C03.1.454.CMB.1.raw
  modified_base (175)..(175): a, c, t, g, unknown or other
  misc_feature (175)..(175): n is a, c, g, or t
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
tcagtcgcactagtcacgaccggtgctcgatttagtagtgtagatttgggtttggggacataacaaccgcattcctcctctaaagaagcccctgggagcacagctcatcaccatggactggacctggaagttcctctttgtggtggcagcagctacaggtgtccagtccctggtncagctgctgcaggtcgggactggaggtgaggacgccgtgggtcctggngagggtctccgtgcgaggtcttcgnggagcaccgttggcaactatcctatcctaccgtggtcgcgacgacggtcccctaggacgaacggtaccttggacggttggggtagggacggcgtagtccgtaactcccccgttacgtccgtttacggacccttaacgaaccccgtaaacccgttaacggaccgtaaacgtaaacggtaaaaccttttaacccggaacgggtaccgtaaacggtaaaccgtttaccggtaaaccggtttaacgttttaccccgggacgtttaacgggaaccgttaaaccgtaacccccgtaaacgggtaaacccgaacccgggttaaccctttaacgttaaccgttaaaacggtacccgttacggaacggtaaccgtaaccggtaaccgtttaaacggttcccgtaagggtaaacgggtaacccgtaaccggggtaaccctttaaacgttttaaaccgttcggttaacggttacgtaacggaacgtacggttaacctacccgtaaccccgttacgttaccggtacgggtaccggggaacccggaaacggggtacccgttaacgggtaccctacccggttaccgttacccctaccggtacccgtccccgtaacccccgg

SEQ ID NO: 94838 - DNA, 132 bp, Homo sapiens
  misc_feature: GYAE6OF01CBQO8.39.25.C03.1.454.CMB.1.raw
  modified_base (130)..(132): a, c, t, g, unknown or other
  misc_feature (130)..(132): n is a, c, g, or t
tcagtcgcactagtcacgaccggtgctcgatttagtagtgtagatttgggtttgggcacagcggccctgggctgcctggtcaaggactacttccactagtgcgactgagcgggctggcaaggcgcatagnnn

SEQ ID NO: 94839 - DNA, 728 bp, Homo sapiens
  misc_feature: GYAE6OF01CPIGI.39.25.C03.1.454.CMB.1.raw
  modified_base (267)..(267): a, c, t, g, unknown or other
  misc_feature (267)..(267): n is a, c, g, or t
tcagtcgcactagtcacgaccggtgctcgatttagtagtgtagatttgggtttggggacataacaaccgcattcctcctctaaagaagcccctgggagcaacagctcatccaccatggactggacctggagttcctcttggtggtggcagcagctacgaggtcgtccacgtcccgtggtcgcagctgcgtgcgaggtccgggactggaggtaggaaggacgcccgtggtccgtacgggtgtcggtctccgtagacgacggtcttcgnggacggctccgtacgactaactacgtcctacgtaccgtacgtgggtcgacgacgccggtcccgtaggacgtaacggtacgttggtagggtgggggtacggacggactacgtaccgtccgttacccgttacgtaccgttacgaaccctaaccacccgtaaccgtaccgaacctaaccgaaactaaccgtacgacgaccgaagacgtacgaaccgttacgttccgacgtacgaaccgtaacctaccgaaccgaacgacccgtacttatacgtaaacgacgtacgagacctacgtacctacgtacggtacgacgtaccgtaaccgtaccttaattaccgttgaccgttacgaacgtagaccttacacccgttcccgtaccggacgtaaccgggcggaacccggtaaccggaccgtacggtacccgtacccgttctacccgtaccgtaaccgccccgtaaacccg

SEQ ID NO: 94840 - DNA, 701 bp, Homo sapiens
  misc_feature: GYAE6OF01D1GBJ.39.25.C03.1.454.CMB.1.raw
  modified_base (212)..(212): a, c, t, g, unknown or other
  misc_feature (212)..(212): n is a, c, g, or t
  modified_base (258)..(258): a, c, t, g, unknown or other
  misc_feature (258)..(258): n is a, c, g, or t
  modified_base (626)..(626): a, c, t, g, unknown or other
  misc_feature (626)..(626): n is a, c, g, or t
  modified_base (686)..(686): a, c, t, g, unknown or other
  misc_feature (686)..(686): n is a, c, g, or t
tcagtcgcactagtcacgaccggtgctcgatttagtagtgtagatttgggtttggggacataacaaccgcattcctcctctaaagaacgcccctgggagcacagctcatcaccatggactggacctggaagttcctctttgtggtggcagcagctacaggtgtccagtccctggtgcagctgctgcaggtcggggactggaggtagaacggngccgtgggtcctcgggtgacgggttctccgtgcgaaggtccttcgngggacggcctaccgttcggctaaactacttcctaatccgaccgttgggcgccgaacgacggccccgtagggagaacggtacgttggaggtggggtgggacgcgatcgactcccgtcgtctttcgacctacgaaccaaccgtacgaccaacgaacgtaaacttacccgaaaggccaacggtacgtacctacgttacgtttacccgacgtacgaaccgtaaccgtcccgaaaccgaacgaacccggtaccctaataaccgtaacgtaacgtcgacgtactacgtacccgtttaagttcgacggaaccggacgacgtaacctttaattttaacgttactaggtcgaacgagacgtacctacctaccccgtntaccggacgggtacgggaccgtaacgggaccgtacggtaccgtacccgttctaccgaccncgtcccgtaacccgg

SEQ ID NO: 94841 - DNA, 176 bp, Homo sapiens
  misc_feature: GYAE6OF02HSFYQ.39.25.C03.1.454.CMB.1.raw
  modified_base (173)..(176): a, c, t, g, unknown or other
  misc_feature (173)..(176): n is a, c, g, or t
tcagtcgcactagtcacgaccggtgctcgatttagtagtgtagatttgggtttgggggaagaggaagactgacggtcccccaggagttcaggtgctgggcacagcggccctgggctgcctggtcaaggactacttccactagtgcgactgagcgggctggcaaggcgcatagnnnn

SEQ ID NO: 94842 - DNA, 650 bp, Homo sapiens
  misc_feature: GYAE6OF02HYCE6.39.25.C03.1.454.CMB.1.raw
tcagtcgcactagtcacgaccggtgctcgatttagtagtgtagatttgggtttggggacataacaaccgcattcctcctctaaagaagcccctgggagcacagctcatcaccatggactggacctggaagttcctctttgtggtggcagcagctacaggtgtccagtccctggtgcagctgctgcagtcgggactgaggtgaaggagcctgggtcctcggtgagggtctcctgcaaggcttctggaggcaccttcggcaactatcctatcaccgtgggtgcgacacggcccctggagaaggacttggaggtgggtgggaggcagtcactccgtcgtctttcgacttaccgacctaacctacgacaacgaacgaaacttaccgaaacggacaagacgtacaacgtaactttccgctacgaacgtaactacccgaacgaaaccgaaccggccttaactacgtaaacgtaacgtagaacggctaaaccggtacctttaaagccgtaggaccgggaacaccggtaaccttattttaacttacgtacgtcgaacgtaaaggactacgtacccacccttcgaccgtaacgggtcgggaccgtaaccgggtacgaccgggttaccaccgttccgccctacgaccgtacctaccccgg

SEQ ID NO: 94843 - DNA, 252 bp, Homo sapiens
  misc_feature: GYAE6OF02GQR35.39.25.C03.1.454.CMB.1.raw
  modified_base (246)..(252): a, c, t, g, unknown or other
  misc_feature (246)..(252): n is a, c, g, or t
tcagtcgcactagtcacgaccggtgctcgatttagtagtgtagatttgggtttgggtgcccaagctgctggagggcacggtcaccacgctgctgagggagtagagtcctgaggactgtaggacagcccatcggtcttcccctggcaccctcctccaagagcacctctgggggcacagcggccctgggctgcctggtcaaggactacttccactagtgcgactgagcgggctggcaaggcgcatagnnnnnnn

SEQ ID NO: 94844 - DNA, 797 bp, Homo sapiens
  misc_feature: GYAE6OF02F6UWS.39.25.C03.1.454.CMB.1.raw
tcagtcgcactagtcacgaccggtgctcgatttagtagtgtagatttgggtttggggacataacaaccgcattcctcctctaaagaagcccctgggagcacagctcatcaccatggactggacctggaagttcctctttgtggtggcagcagctacaggtgtccagtccctggtgcagctgctgcagtcggggactgaggtgaaggagcctgggtcctcgggtgagggtctcctgcaaggcttctggaggcaccttcggcaactatcctatcacctgggtcgcgacacggcccctggacgaaggacttgaggttggggtagggagggacagtcacgttccccgtacgtcgtttgaccttaccaacccaaacccttacggaccaacgtaacgtaaaactttcccgaaaacgggcaaggaacgtaccgaaccggtacttttcccggaccttacggaacccgtaaacgttcccaaaccggaaaccgtaacccggggtacccttaaacgttaccgttaaaccgggtaaaccttcggggtaaacgtaccgtaaacggttaccccgtttaaagggttcccgttaacgggaaaccgggttaaccgtaaccccgggggtaaccctttaaacggtttttaaaccgttttaaccgttagggttaccgtaaacaaaggttaacgtaccttaacccgacccccttcgtacccggtaaccgggtttccgggggaacccgtaaacgggtaacccgaccggggttacctacccggtttcccgtaccctaccgtaccgccccgttaaccccgg

SEQ ID NO: 94845 - DNA, 181 bp, Homo sapiens
  misc_feature: GYAE6OF02I0HQ8.39.25.C03.1.454.CMB.1.raw
  modified_base (174)..(175): a, c, t, g, unknown or other
  misc_feature (174)..(175): n is a, c, g, or t
  modified_base (177)..(181): a, c, t, g, unknown or other
  misc_feature (177)..(181): n is a, c, g, or t
tcagtcgcactagtcacgaccggtgctcgatttagtagtgtagatttgggtttgggggaagaggaagactgacggtcccccaggagttcaggtgctgggcacagcggccctgggctgcctggtcaaaggctacttccactagtgcgactgagcgggctaggcaaggcgcaatgnntnnnnn

SEQ ID NO: 94846 - DNA, 793 bp, Homo sapiens
  misc_feature: GYAE6OF02JH7DZ.39.25.C03.1.454.CMB.1.raw
tcagtcgcactagtcacgaccggtgctcgatttagtagtgtagatttgggtttggggacataacaaccgcattcctcctctaaagaagcccctgggagcacagctcatcacatggactggacctggaagttcctctttgtggtggcagcagctacaggtgtccagtccctggtgcagctgctgcaggtcggggactgaggtgaaggagcctgggtcctcggtgagggtctccgtgacaaggtcttcgtggacggcaccgttcggctaactactcctagtcctaccgtgggtcgacgacgacggccccgtaggacggaaggtacttggaggttcggggtaggggtacggcacgttctaaccgtccccgttcgtccgttttacggaccgttaccgaaccctaaacccgtaacggacctaaacggtaaccgtaaaacctttacccgaacgggtaccgtaacggtaacgtacctaaccggttaccgtttaccggacgttaccggaaccgtaaccgtaacccgtaaaccggaaaccgtacccgggtacccttacgtaccttaaaccgaacgttacgaacgttaccgaacgtttaccgttaaaccgttcgttacgggaaacggtaccgtaacgggttaccctaaagttttacgtttaaccgtacggtacgtaccgtaaaacgacgttaaccttacccgaccccttacgtaccgaccgggtacggggtaacccgaaagggtacccggtaccggtaccgtcccggttaccttacccgacccgtacgttacccccggacccg

SEQ ID NO: 94847 - DNA, 759 bp, Homo sapiens
  misc_feature: GYAE6OF02GBQEL.39.25.C03.1.454.CMB.1.raw
  modified_base (140)..(140): a, c, t, g, unknown or other
  misc_feature (140)..(140): n is a, c, g, or t
  modified_base (206)..(206): a, c, t, g, unknown or other
  misc_feature (206)..(206): n is a, c, g, or t
tcagtcgcactagtcacgaccggtgctcgatttagtagtgtagatttgggtttggggacataacaaccgcattcctcctctaaagaagcccctgggagcacagctcatcaccatggactggacctggaagttcctgttgnggtggcagcagctacgaggtgtccagccctggtgcagctgctgcaggtcgggactggagtgaaggngccgtcgggtccctgggtagagggtctccgtagacgaacggtcttcgtggacgccgtaccgttacgacctaactactactacgtccgaccgtgggtcgacgacgaccggtcccgaggacggaaggtccgtaggtaggtcggggtagggacgacgagactacgtacccgtcggtctttcgtaccgtaaccgaccctaaccgtacgacaaccgttaagtaaaccttaccgaaaggactaaggtactaaccgtaccgttaacgttacccggacgttggaaacccgtacgtaacccgaaacgaaccggtaccgtaaccttactaacgaacgtaaacgtcgaactacgtaaccgttaccgttaaacgttcgtaaaccggtacggaaccgttaaccggtaccgtaagtttaccgttacgagttaaccgaccgtaaaataccggtaaccgtccgtacccgtacgtaccggtaaccgggtaaccgggaaccggaaaccgggtacccgtacgggtaacccgtccggttaccctacccgacgtaccccgtacccgtaacccgg

SEQ ID NO: 94848 - DNA, 551 bp, Homo sapiens
  misc_feature: GYAE6OF01C1DBB.8.82.H05.1.454.CMB.1.raw
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagccgcgggagtccactcccaggtgcaactggtgcagtctggggctgaagtgcgcgagcctggggcctcagtcagagtctcctgcaaggcttctggatacgccttcggcgaccactatatacactggatgcgccaggcccctggacaagggcttgagtggatggcctggatctacccgaatagtggtggcacaaattatgcacgggtagtttcgagggcagggtcacgtgaccagggacacgtcatcactacagtctatatgcatttgagcggcctcagatctgacgacgacggtccgtcttacgttttgtgcggtagggacccgtaccgttcgttttacgacgtgggacgtacgtcacgtactcccgttcgtacctttcgtcggggcccgtacggggtaaccccg

SEQ ID NO: 94849 - DNA, 653 bp, Homo sapiens
  misc_feature: GYAE6OF01C4NFY.8.82.H05.1.454.CMB.1.raw
  modified_base (250)..(250): a, c, t, g, unknown or other
  misc_feature (250)..(250): n is a, c, g, or t
  modified_base (279)..(279): a, c, t, g, unknown or other
  misc_feature (279)..(279): n is a, c, g, or t
  modified_base (315)..(315): a, c, t, g, unknown or other
  misc_feature (315)..(315): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtgccactcccaggttcagttgctgcaatctggaactgaggacgaaagaacggcccgggctcgagtgaaggtctcctgacaaggtcgtaccggttanagtttcaacaagtatggtattaggttggncggacacggcccctggacgaagggcttgagtggagnggggtaggatcagcgtccttacaactaattaacaacaaactatgacaacgaaggtaaacgttccgagtacgagtacgtacaacatacgaaccagttaacgactatttaccgaacggacacgacgtacctaagtagtaggacgtcgtcggacggacgcccgtagacatacgtacgacgaaccgtcgggtacccgttattacgtttccgtggtacgacgtaaggtaaaggaaggttgggaggttgggttacgggttggtaccgttagttttacggaacgttacgggtacgggacccggtaaccgggtacccgttagggtccctaaccggtccgttacccg

SEQ ID NO: 94850 - DNA, 531 bp, Homo sapiens
  misc_feature: GYAE6OF01AHZ0J.8.82.H05.1.454.CMB.1.raw
  modified_base (253)..(253): a, c, t, g, unknown or other
  misc_feature (253)..(253): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
tcagctcgcgtgtccacgaccggtgctcgatttagtcgagctctctcgcggggacccaaaaccacacccctcttgggagaatcccctagatcacagctcctcaccatggactggacctggagtctcctcttcttggtggcagcagcaacaggtggccactcccaggttcagttgctgcaatctggaactgaggcgaagaagcccggggctcagtgaaggtctcctgcaaggcgtcggtacagtttcacacgtntgtattagttgggtgcgacaggcccctggacaagggcttggagtggatgggtggatcgagcgccttcaactattacacaaactatgacacagaagttccgtagacagacgtcaccatgaccataacgactatttccaacggtacacagcctatatggagctggcgagcctgacntcngacgacgtcggcgttctatttctgtgcgaagagaagtgggatggtgggtcggtcttagttgactacggtcggcgtacgggaccctggcctacgtctacccg

SEQ ID NO: 94851 - DNA, 713 bp, Homo sapiens
  misc_feature: GYAE6OF01B1LWS.8.82.H05.1.454.CMB.1.raw
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
  modified_base (363)..(363): a, c, t, g, unknown or other
  misc_feature (363)..(363): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacgaggtggccactcccaggttcagttgctgcaatctggaactgaggcgaagaagcccgggctcagtgagtctcngcaaggcgtcggtacagttcanacgtatggtattaggttggtgcgacgacggccctggacgaagggtcttggagtgggagtgggggtaggatcgaggtccgtaccttacgaaacgttaacttaacaaactaaaacgttnacggaccaacgtaacggtaacgtttccgtaagacgaagacgtaccaaaccgagtacgaacctaagtacgaactactttaccgaacgacgactagtacctagtacgagacgtacgtggaccggacgtccgtacgactacgtcgacgaccgtaccgtccgggtcccttacgttacgtttcgttacggacgtacggaacggtaaaggtaacggtggggttaacggttggggtttacgggggttacgggttaccgtttaaggtttacgggtaaccgggttacgggtacccgggggtaaccggttaaccgggaccccggtttagggtacccccgttacccggtcccgttaacccg

SEQ ID NO: 94852 - DNA, 724 bp, Homo sapiens
  misc_feature: GYAE6OF01CKTPN.8.82.H05.1.454.CMB.1.raw
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgaggcgaagaacgcccggggctcgatgggggaagtctccgtgacaagggtccgtaccgggttaacaggttttcacaacgtagtggttaagttaggttgggtgacggacgacggccccgtagggaacgaaggggtcttaggaggtgggagtgggggtgatcgagtcgtaccttacgaactacttacaactaaacgtagtagacaagtagtaacgttccgtagaactaggacgtacaaccgaagtacggaaccctaagtaacgtaactacgtttacccgaacggaacctaacgacggtacctaagttaagtacgggaacgtcgtacgggaccggacgtacccgttacgaaccgtacttacgtacggaaccgtaccgtccgggtacccgttacgttacgtttccgtggtacggtacggaaggaaacggtaaggtacggggtagttgggtggggttacggtcgtttaggtttacggacgttacggtacggggtacccgtacgggtacccgttagggtacctcccggttcgtacccgg

SEQ ID NO: 94853 - DNA, 621 bp, Homo sapiens
  misc_feature: GYAE6OF01EH1PK.8.82.H05.1.454.CMB.1.raw
  modified_base (272)..(272): a, c, t, g, unknown or other
  misc_feature (272)..(272): n is a, c, g, or t
  modified_base (370)..(370): a, c, t, g, unknown or other
  misc_feature (370)..(370): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgaggcgaagaacgcccggggcctcagtgaaggtctcctgcaaggcgtccgtacagttcacaacgtatggtattagttgggngcgacacggcccctggacaagggcttgagtggagtgggggtggagtcgaggcgtccttacgaacttattacaactaaactatgcacagaacgttccgngacagagtcaccatgaaccatacgactattaccacggacacacgcctatatggagctggccggacgtcctagacctatcgtacgacccgtacgtccgggccgttacttacttttccgtaggtcgacggtaaggaaagtaacgggtggggtacttggggttacgggttacgggtcctttaaggttttcggaaccgttacgggtcggggaccgtaacgggtaaccccgtgggtaccctaccggtcctaccccg

SEQ ID NO: 94854 - DNA, 591 bp, Homo sapiens
  misc_feature: GYAE6OF01BTJ3J.8.82.H05.1.454.CMB.1.raw
  modified_base (247)..(247): a, c, t, g, unknown or other
  misc_feature (247)..(247): n is a, c, g, or t
  modified_base (364)..(364): a, c, t, g, unknown or other
  misc_feature (364)..(364): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgaggcgaagaagcccggggcctcaggtgaaggtctcctgcaaggcgtccggttacngtttcacaacgtatggtattagtgggtgcgacacggcccctggacgaagggcttggagtggagtggggtggatcagcgccttcaactattacacaaactgtgcacgagaagttccgngacgagagtcaccatgaccatacgactatttaccgacgtacacacgcctaagtagtggagccgtaggccggacgcctagacagtcgtcgaacgctcggccgtgttactttcgtgtcgaggtaaggaagtaaggtggggaagttgggtaggggttcggtacgttaggtttacgtacgtacggttcggggaccgtacgggtaaccccgtggccgtcccgtccgtacccg

SEQ ID NO: 94855 - DNA, 651 bp, Homo sapiens
  misc_feature: GYAE6OF01CBZ7O.8.82.H05.1.454.CMB.1.raw
  modified_base (329)..(329): a, c, t, g, unknown or other
  misc_feature (329)..(329): n is a, c, g, or t
  modified_base (353)..(353): a, c, t, g, unknown or other
  misc_feature (353)..(353): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgaggcgaagaagcccggggcctcagtgaaggtctcctgcaaggcgtccggttacagtttcacaacgtatggtattagttgggtgcgacaggcccctggacaagggcttgagtggagtgggggtggatcgagcgccttnaactattacaacaaactatgacanagtaagttccgtagacagagtcaaccatacgaaccaatacgactacttttacccgaacgggacacacgtaccttaataacgtagggacgtcgtaggcggacgcctacgaactacgtactaggaccgaccgtccggtacccgttacttagttttccgtggttagacggtaaggaaggtaaaggttgggggtattagggttagggggttcgggtacctttaggttttcgtaaccggttacggtcgggggacccgtaacggggtaaccccgttgggtacccgtcccggttccgttaccccg

SEQ ID NO: 94856 - DNA, 754 bp, Homo sapiens
  misc_feature: GYAE6OF01A2RDB.8.82.H05.1.454.CMB.1.raw
  modified_base (240)..(240): a, c, t, g, unknown or other
  misc_feature (240)..(240): n is a, c, g, or t
  modified_base (351)..(351): a, c, t, g, unknown or other
  misc_feature (351)..(351): n is a, c, g, or t
tcagctcgcgtgtccacgaccggtgctcgatttagtcgagctctctcgcggggaacccaaaaaccacacccctccttgggagaatcccctagatcacagctcctcaccatggactggacctggagtctcctcttcgttggtggcagcagcaacgaggtggccactcccgaggttcagttgctgacaatcgtaggaactggaggacgaagaaccggcccgggctcgagtgaaggtctccgngacgaaggtcgtaccgttactagttcgactacgtataggttagttaggttgggacgacggaccgaacggtcccgtaggaccgaagggtcttaggaggtggtaggtgggggngtactcgacggtccgtaccttacaacgtataacactaaatcgagtacaacgtagtaacgttaccgtagaacgtaggacgtaccaactagtaccgaacgtacgtaagaacctacttaccggaaccgtaacgtaaccgtacgtaaccgttagtacgtacgggacgtcgtacgggaccggtacgtaccgtacgtaactacggtaccgtacgggtaaccacccggtttcgtaacccggtttacttacgtttcggtacggtaccggaaagtaacgggtaaacgttaaggggtcgggtaaagtttcgggggttagggttacgggttacgtttaggttacgggtaaccgttgggacccggggtaacggtaccggtaacccgttcggggtaccctcccggttcgtacccgg

SEQ ID NO: 94857 - DNA, 531 bp, Homo sapiens
  misc_feature: GYAE6OF02HRPBR.8.82.H05.1.454.CMB.1.raw
  modified_base (411)..(411): a, c, t, g, unknown or other
  misc_feature (411)..(411): n is a, c, g, or t
  modified_base (422)..(422): a, c, t, g, unknown or other
  misc_feature (422)..(422): n is a, c, g, or t
  modified_base (476)..(476): a, c, t, g, unknown or other
  misc_feature (476)..(476): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgaggcgaagaagcccggggcctcagtgaaggtctcctgcaaggcgtccggttacagtttcacaacgtatggtattagttgggtgcgacaggcccctggacaagggcttgagtggatggggtggatcagcgccttcaactattacacaaactatgcacagaagttccgtgacagagtcaccatgaccatagacattttccacggacacagcctatatgganctgcggagccngacatctgacgacctcggccgtctactttctgtgcgagaagaaatggggatggngggttagggtctatttgactagtgggaccgagggacctggtcaccggtctacccg

SEQ ID NO: 94858 - DNA, 686 bp, Homo sapiens
  misc_feature: GYAE6OF02H5M5D.8.82.H05.1.454.CMB.1.raw
  modified_base (242)..(242): a, c, t, g, unknown or other
  misc_feature (242)..(242): n is a, c, g, or t
  modified_base (323)..(323): a, c, t, g, unknown or other
  misc_feature (323)..(323): n is a, c, g, or t
  modified_base (343)..(343): a, c, t, g, unknown or other
  misc_feature (343)..(343): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgaggcgaagaagcccggggctcagtgaaggtctctgcaggcgtccggttangttcacagtatggtattagttgggtgcgacacggtcccctggacaagggcttgaggtggagtggggtgatcgagcgccttnaactatacacaactatgcanagagttccgtagacagagtacacatgaaccatagactactttaccgaacggacaaccgagacccgttaattacgtagggacgtcgttgggaccgggtaacgtcccgttaggaaccttaagtccgtaggacccgaccgttcccgggtcccgttaccgttacttttccgttggtacggtaccggtaaaggaaaacggtaaagggttacgggggttagttacggggttcgggggtttcgggttaacccgtttttaggttttacggttaaccgttaccgggttacgggggtacccgtaacggggtacccccgttacgggtacccgttacccgggttcccttacccgg

SEQ ID NO: 94859 - DNA, 760 bp, Homo sapiens
  misc_feature: GYAE6OF02H0U8B.8.82.H05.1.454.CMB.1.raw
  modified_base (279)..(279): a, c, t, g, unknown or other
  misc_feature (279)..(279): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgagcgaagagcccggggctcagtgaaggtctcctgcaaggccgtccgggttacagtttcacaacgtatggtattagttgggtgcgacnggcccctggacaagggcttgagtggagtggggtgatcgagcgccttacgactattacaactaaactatgcaacagaacgttccgtgaactagtacgtacgacctaagtcgaacccagtaacgacctaacttttacccgaacggtaacaaccgtacgtacccgttaaataacggttacggaacggtcgttacggaccgggtaacgtacccgttacggaacctaacgttacctacgggtaacccgtaaccggttcccgggttacccgttacgtttaaacgtttttccgtacgggttacggtaccgtaaagggtaaaaccgtaaaagggttacggggggtaatttcggggtttacgggggtttccggggtaaccccgttttaaggtttttaccggaaccggttttaaccgggtcgggggtaaccccgtaaccgggggtaaccccgttacggggttaccgtaccccggtttcccgttaaccccgg

SEQ ID NO: 94860 - DNA, 679 bp, Homo sapiens
  misc_feature: GYAE6OF02JX6GM.8.82.H05.1.454.CMB.1.raw
  modified_base (251)..(251): a, c, t, g, unknown or other
  misc_feature (251)..(251): n is a, c, g, or t
  modified_base (264)..(264): a, c, t, g, unknown or other
  misc_feature (264)..(264): n is a, c, g, or t
  modified_base (472)..(472): a, c, t, g, unknown or other
  misc_feature (472)..(472): n is a, c, g, or t
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccgaggttcagttgctgcaatctaggaactggaggacgaagaacggcccggggcctcgagtgaaggtctctgcaaggcgtccggttangttcactaacgtntggtattaggttggtgcgacgacggcccctaggacgtaagggcttggaggtggagtgggggtgactcgagccgtacctttacaaacgttattaaccaactaaaacgttactaggacaacgtaagtaacgttaccgtagaacgtagacgttaccaccgtagtacgaaccaagtacgacctacgtttaccgaacggtacacacgtactanagtcgagcgtacggacgtacgaccttacgacgactcgacgtaccggaccgtccggtccgttacgttcgtttaccgtggtacgtacgaaaggtaaagtaacgggtgggtagtgggttcgggttacggtctttaggttacgtaaccggttaccggtcgggtaacccggtacgggtaacccggttcggtaccgttacccgtacgttcccg

SEQ ID NO: 94861 - DNA, 553 bp, Homo sapiens
  misc_feature: GYAE6OF02GTSMF.8.82.H05.1.454.CMB.1.raw
  modified_base (364)..(364): a, c, t, g, unknown or other
  misc_feature (364)..(364): n is a, c, g, or t
  modified_base (418)..(418): a, c, t, g, unknown or other
  misc_feature (418)..(418): n is a, c, g, or t
  modified_base (455)..(455): a, c, t, g, unknown or other
  misc_feature (455)..(455): n is a, c, g, or t
tcagctcgcgtgtccacgaccggtgctcgatttagtcgagctctctcgcgggggacccaaaaaccacacccctccttgggagaatcccctagatcacagctcctcaccatggactggacctggagtctcctcttcttggtggcagcagcaacaggtggccactcccaggttcagttgctgcaatctggaactgaggcgaagaagcccggggcctcagtgaaggtctcctgcaaggcgtccggttacagtttcacaacgtatggtattagttgggtgcgacaggcccctggacaagggcttgagtggagtgggggtggatcgagcgccttcaactattacaacaaatatgcacagaacgttccgngacagagtcacatcgaccatagactactttaccacggacacagcctatatgganctgcggagcctgactatctgacgacgtcgccgtcttnttctgtcgacgagaagaagtgggagtggtgggttggcgtttagtttcggacttacggtcgggacgtacgggtacccgtgggtccgtaccgtcctcccg

SEQ ID NO: 94862 - DNA, 723 bp, Homo sapiens
  misc_feature: GYAE6OF02JHQFQ.8.82.H05.1.454.CMB.1.raw
tcagctcgcgtgtccacgaccggtgctcgatttagtcgagctctctcgcggggacccaaaaaccacacccctccttgggagaatcccctagatcacagctcctcaccatggactggacctggagtctcctcttcttggtggcagcagcaacaggtggccactcccaggttcagttgctgcaatctggaactgaggcgaagaagcccggggcctcagtgaaggtctcctgcgaaggcgtccggttacagtttcacaacgtatggtattagttggtgcgacaggcccctggacaagggcttgacgtggagtggggtgatcagcgtaccttacgaactagttacactaaactatcggacacagtaacgttccgagacagacgtcaacctagtacgaaccagtacgactactttaccgaacgactaccgtacggtaccttaagtacgttacggagtacgtacggaccgggtactaccggttagtaaccctacgttccgtaggtaacccgtaccggttacccgggtccgtttacgttacgttttaccgtacggttacggacgggtaacggtaaaacggtaaacggttcgggggtaacgttcggggttggggttaccggggttaccctttaaggtttttacggaaccggtttaccggtaccgggggttacccggtaacggggtaacccccgtttggggtaacccctacccgggttccttaacccccggg

SEQ ID NO: 94863 - DNA, 736 bp, Homo sapiens
  misc_feature: GYAE6OF02JZUY5.8.82.H05.1.454.CMB.1.raw
  modified_base (210)..(210): a, c, t, g, unknown or other
  misc_feature (210)..(210): n is a, c, g, or t
tcagctcgcgtgtccacgaccggtgctcgatttagtcgagctctctcgcggggacccaaaaccacacccctccttgggagaatcccctagatcacagctcctcaccatggactggacctggagtctctcttcttggtggcagcagcaacaggtggccactcccaggttcagttgctgcaatctggaactgaggcgaagagcccggggtcncagtggaagtctcctgcgaaggtccgttaccggttacagtttcactaaggtatggttattaggttggtgcgacgacggtcccctaggactaagggcttgaggtggtagtgggggtgatcgagtccgtcgttaccacttaattaccgaacaacgttatcggacacgtaagtaacgtttccgagtactacggtagtaccacgtacgttacgaacctagtaacgtacctacgttttacccgaacgggtacctaacgtaacggtaacccgtttaagtaacggtacggtaaccgttaccggtacgggtaccggtaccggaaccgttacgacgtacgttaccgtacgaccgtacggtaccgggttacccgttactttacgtttacgtcgttacggaggtaacgtaacggtaaaggtcgggtacgttagggttgggtttacggtacctttaacggtttcgaaccggtttacgggccgggtacccgtaaccggggtaacccgttacgggtacccttacccgtcggtttaccccg

SEQ ID NO: 94864 - DNA, 598 bp, Homo sapiens
  misc_feature: GYAE6OF02GO87M.8.82.H05.1.454.CMB.1.raw
  modified_base (185)..(185): a, c, t, g, unknown or other
  misc_feature (185)..(185): n is a, c, g, or t
  modified_base (211)..(211): a, c, t, g, unknown or other
  misc_feature (211)..(211): n is a, c, g, or t
  modified_base (344)..(344): a, c, t, g, unknown or other
  misc_feature (344)..(344): n is a, c, g, or t
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
tcagctcgcgtgtccacgaccggtgctcgatttagtcgagctctctcgcgggggacccaaaaaccacacccctccttgggagaatcccctagatcacagctcctcaccatggactggacctggagtctcctcttcttggtggcagcagcaacaggtggccactcccaggttcagttgctgcatcnggaactgaggcgaagagcccgggctnagtgaacggtctcctgcaaggcgtccggttacagtttcacaacgtatggtattagttgggtgcgacacggcccctggaccaagggcttgagtggagtggggtggatcagcgccttcaactattacacaaactntcgacacagacgttccgtgacagactcaccatcgaaccatacgactatttaccacggacacgacgctaangtggagcgtcgcggngtccgtgactactctcgacgtcctcggtccgttacttacgtttcgtcgttagaccggaaggaacgtaaaggtgggagttcgggttgggttggtaccgttagttttcggtaacgttaccggtcgggtaccgacgggtacccgttcggtcccgttacccgtccttaccccg

SEQ ID NO: 94865 - DNA, 253 bp, Homo sapiens
  misc_feature: GYAE6OF01BS7Q6.21.71.G05.1.454.CMB.1.raw
  modified_base (248)..(253): a, c, t, g, unknown or other
  misc_feature (248)..(253): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgccatctgactcgtctctactgagcgggctggcaaggcgcatagnnnnnn

SEQ ID NO: 94866 - DNA, 248 bp, Homo sapiens
  misc_feature: GYAE6OF01A9AQA.21.71.G05.1.454.CMB.1.raw
  modified_base (244)..(248): a, c, t, g, unknown or other
  misc_feature (244)..(248): n is a, c, g, or t
tcagtcgtcgctcgcacgaccggtgctcgatttagtgtcgtcgcaagagagagggtcaggctggaactgagggcaggtggaggctgacgatgttggcatttattttgcatgcaaatacagactggccttggacgttcggcctggggaccaggttggaaatcaaacgaactgtggctgcaccatctgtcttcatcttcccgccatctgacgagcgacgactgagcgggctggcaaggcgcatagnnnnn

SEQ ID NO: 94867 - DNA, 253 bp, Homo sapiens
  misc_feature: GYAE6OF01CGO6V.21.71.G05.1.454.CMB.1.raw
  modified_base (246)..(253): a, c, t, g, unknown or other
  misc_feature (246)..(253): n is a, c, g, or t
tcagtcgtcgctcgcacgaccggtgctcgatttagtgtcgtcgcaagagagaggggtcaggctggaactgaggggcaggtggaggctgacgatgttggcatttatttttgcatgcaaaatacagactggccttggacgttcggcctggggaccaggttggaaatcaaacgaactgtggctgcaccatctgtcttcatcttcccgcatctgactcgtctctactgagcggctggcaaggcgcatagnnnnnnnn

SEQ ID NO: 94868 - DNA, 252 bp, Homo sapiens
  misc_feature: GYAE6OF01DUO75.21.71.G05.1.454.CMB.1.raw
  modified_base (248)..(252): a, c, t, g, unknown or other
  misc_feature (248)..(252): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgccatctgacgagcgacgactgagcgggctggcaaggcgcatagnnnnn

SEQ ID NO: 94869 - DNA, 253 bp, Homo sapiens
  misc_feature: GYAE6OF01BS70K.21.71.G05.1.454.CMB.1.raw
  modified_base (247)..(253): a, c, t, g, unknown or other
  misc_feature (247)..(253): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgactgtggctgcaccatctgtcttcatcttcccgccatctgactcgtctctactgagcgggctggcaaggcgcatagnnnnnnn

SEQ ID NO: 94870 - DNA, 252 bp, Homo sapiens
  misc_feature: GYAE6OF01EZANF.21.71.G05.1.454.CMB.1.raw
  modified_base (247)..(252): a, c, t, g, unknown or other
  misc_feature (247)..(252): n is a, c, g, or t
tcagtcgtcgctcgcacgaccggtgctcgatttagtgtcgtcgcaagagagaggggtcaggctggaactgaggggcaggtggaggctgacgatgttggcatttattttgtatgcaaaatacagactggccttggacgttcggcctggggaccaggttggaaatcaaacgaactgtggctgcaccatctgtcttcatcttcccgccatctgactcgtctctactgagcgggctggcaaggcgcatagnnnnnn

SEQ ID NO: 94871 - DNA, 249 bp, Homo sapiens
  misc_feature: GYAE6OF01EUUOO.21.71.G05.1.454.CMB.1.raw
  modified_base (244)..(249): a, c, t, g, unknown or other
  misc_feature (244)..(249): n is a, c, g, or t
tcagtcgtcgctcgcacgaccggtgctcgatttagtgtcgtcgcaagagagaggggtcaggctggaactgagggcaggtggaggctgacgatgttggcatttattttgcatgcaaaatacagactggccttggacgttcggcctgggaccaggttggaaatcaaacgaactgtggctgcaccatctgtcttcatcttcccgccatctgactcgtctctactgagcggctggcaaggcgcatagnnnnnn

SEQ ID NO: 94872 - DNA, 258 bp, Homo sapiens
  misc_feature: GYAE6OF01DOCFF.21.71.G05.1.454.CMB.1.raw
  modified_base (248)..(258): a, c, t, g, unknown or other
  misc_feature (248)..(258): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggatcaggttggaaatcaaacgaactgtggctgcaccatctgtcttcatcttcccgccatctgactcgtctctactgagcgggctggcaaggcgcatagnnnnnnnnnnn

SEQ ID NO: 94873 - DNA, 253 bp, Homo sapiens
  misc_feature: GYAE6OF01A37LJ.21.71.G05.1.454.CMB.1.raw
  modified_base (248)..(253): a, c, t, g, unknown or other
  misc_feature (248)..(253): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgccatctgacgagcgacgactgagcgggctggcaaggcgcatagnnnnnn

SEQ ID NO: 94874 - DNA, 248 bp, Homo sapiens
  misc_feature: GYAE6OF01CCWFL.21.71.G05.1.454.CMB.1.raw
  modified_base (244)..(248): a, c, t, g, unknown or other
  misc_feature (244)..(248): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctgggatcaggttggaaatcaaacgaactgtggctgcaccatctgtcttcatcttccgcatctgactcgtctctactgagcggctggcaaggcgcatagnnnnn

SEQ ID NO: 94875 - DNA, 250 bp, Homo sapiens
  misc_feature: GYAE6OF01AWGBL.21.71.G05.1.454.CMB.1.raw
  modified_base (247)..(250): a, c, t, g, unknown or other
  misc_feature (247)..(250): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgcatctgactcgtctctactgagcgggctggcaaggcgcatagnnnn

SEQ ID NO: 94876 - DNA, 262 bp, Homo sapiens
  misc_feature: GYAE6OF01CX0J8.21.71.G05.1.454.CMB.1.raw
  modified_base (245)..(262): a, c, t, g, unknown or other
  misc_feature (245)..(262): n is a, c, g, or t
tcagtcgtcgctcgcacgaccggtgctcgatttagtgtcgtcgcaagagagaggggtcaggctggaactgaggggcaggtggaggctgacgatgttggcatttattttgcatgcaaaatacagactggccttggacgttcggcctggggaccaggttggaaatcaaacgactgtggctgcaccatctgtcttcatctcccgccatctgacgagcgacgactgagcgggctggcaaggcgcatagnnnnnnnnnnnnnnnnnn

SEQ ID NO: 94877 - DNA, 251 bp, Homo sapiens
  misc_feature: GYAE6OF01A5VWL.21.71.G05.1.454.CMB.1.raw
  modified_base (248)..(251): a, c, t, g, unknown or other
  misc_feature (248)..(251): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgccatctgactcgtctctactgagcgggctggcaaggcgcatagnnnn

SEQ ID NO: 94878 - DNA, 250 bp, Homo sapiens
  misc_feature: GYAE6OF01DXHB3.21.71.G05.1.454.CMB.1.raw
  modified_base (246)..(250): a, c, t, g, unknown or other
  misc_feature (246)..(250): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgcatctgactcgtctctactgagcggctggcaaggcgcatagnnnnn

SEQ ID NO: 94879 - DNA, 252 bp, Homo sapiens
  misc_feature: GYAE6OF01DKPKF.21.71.G05.1.454.CMB.1.raw
  modified_base (247)..(252): a, c, t, g, unknown or other
  misc_feature (247)..(252): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgccatctgactcgtctctactgagcggctggcaaggcgcatagnnnnnn

SEQ ID NO: 94880 - DNA, 254 bp, Homo sapiens
  misc_feature: GYAE6OF01BLJYS.21.71.G05.1.454.CMB.1.raw
  modified_base (247)..(254): a, c, t, g, unknown or other
  misc_feature (247)..(254): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctggggaccaggttggaaatcaaacgactgtggctgcaccatctgtcttcatcttcccgcatctgactcgtctctactgagcgggctggcaaggcgcatagnnnnnnnn

SEQ ID NO: 94881 - DNA, 255 bp, Homo sapiens
  misc_feature: GYAE6OF01DVZC9.21.71.G05.1.454.CMB.1.raw
  modified_base (248)..(255): a, c, t, g, unknown or other
  misc_feature (248)..(255): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgacaaaatacagactggccttggacgttcggcctgggaccaggttggaaatcaaacgaactgtggctgcaccatctgtcttcatcttcccgcatctgactcgtctctactgagcgggctggcaaggcgcatagnnnnnnnn

SEQ ID NO: 94882 - DNA, 250 bp, Homo sapiens
  misc_feature: GYAE6OF01B47XD.21.71.G05.1.454.CMB.1.raw
  modified_base (239)..(239): a, c, t, g, unknown or other
  misc_feature (239)..(239): n is a, c, g, or t
  modified_base (245)..(250): a, c, t, g, unknown or other
  misc_feature (245)..(250): n is a, c, g, or t
tcagtcgtcgctcgcacgaccggtgctcgatttagtgtcgtcgcaagagagagggggtcaggctggaactgaggtgcaggtggaggctgacgatgttggcatttattttgcatgcaaaatacagactggccttggacgttcggcctggggaccaggttggaaatcaaacgaactgtggctgcaccatctgtcttcatctccgcatctgactcgtctctactgagcgggctggcaaggcncatagnnnnnn

SEQ ID NO: 94883 - DNA, 256 bp, Homo sapiens
  misc_feature: GYAE6OF01CMYP3.21.71.G05.1.454.CMB.1.raw
  modified_base (246)..(256): a, c, t, g, unknown or other
  misc_feature (246)..(256): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgactgtggctgcaccatctgtcttcatcttcccgcatctgactcgtctctactgagcgggctggcaaggcgcatagnnnnnnnnnnn

SEQ ID NO: 94884 - DNA, 255 bp, Homo sapiens
  misc_feature: GYAE6OF01A5RHR.21.71.G05.1.454.CMB.1.raw
  modified_base (247)..(255): a, c, t, g, unknown or other
  misc_feature (247)..(255): n is a, c, g, or t
tcagtcgtcgctcgcacgaccggtgctcgatttagtgtcgtcgcaagagagaggggtcaggctggaactgaggggcaggtggaggctgacgatgttggcatttattttgtatgcaaaatacagactggccttggacgttcggcctggggaccaggttggaaatcaaacgaactgtggctgcaccatctgtcttcatcttcccgccatctgactcgtctctactgagcgggctggcaaggcgcatagnnnnnnnnn

SEQ ID NO: 94885 - DNA, 253 bp, Homo sapiens
  misc_feature: GYAE6OF01CFOJO.21.71.G05.1.454.CMB.1.raw
  modified_base (249)..(253): a, c, t, g, unknown or other
  misc_feature (249)..(253): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctggggaccaggttggaaatcaaacgaactgtggctgcaccatctgtcttcatcttcccgccatctgacgagcgacgactgagcgggctggcaaggcgcatagnnnnn

SEQ ID NO: 94886 - DNA, 516 bp, Homo sapiens
  misc_feature: GYAE6OF01DFRIW.21.71.G05.1.454.CMB.1.raw
  modified_base (367)..(367): a, c, t, g, unknown or other
  misc_feature (367)..(367): n is a, c, g, or t
tcagtcgtcgctcgcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtagtctgctttgctcagcgtcagggtgctgctaatgctctgggtcccagtgtccagtggggaattgtgatgactcagtctccactctccctgcccgtcgcccttggacagccggcctccatctcctgcaggtctagtcagagcgtcgtgtacagtgacggtaacacctacctcaactggtttcaccagaggccaggccaacctccacggcncctactttataaggtttcaagcggactcgtgggtcccagacagaatcagcgctttgggtcagctctgatttcaacactagaactatcagcgagggtggaggctgacgagtgttggctattttatttgactatagataaaatcgagtacg

SEQ ID NO: 94887 - DNA, 250 bp, Homo sapiens
  misc_feature: GYAE6OF01CY5YT.21.71.G05.1.454.CMB.1.raw
  modified_base (246)..(250): a, c, t, g, unknown or other
  misc_feature (246)..(250): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgactgtggctgcaccatctgtcttcatcttcccgcatctgactcgtctctactgagcgggctggcaaggcgcatagnnnnn

SEQ ID NO: 94888 - DNA, 535 bp, Homo sapiens
  misc_feature: GYAE6OF01ATZPB.21.71.G05.1.454.CMB.1.raw
  modified_base (496)..(496): a, c, t, g, unknown or other
  misc_feature (496)..(496): n is a, c, g, or t
tcagtcgtcgctcgcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtagtctgctttgctcagcgtcagggtgctgctaatgctctgggtcccagtgtccagtggggaagttgtgatgactcagtctccactctccctgcccgtcgcccttggacagccggcctccatctcctgcaggtctagtcagagcgtcgtgtacagtgacggtaacacctacctcaactggtttcaccgagacggccaggcccaacctccacggccgaccttactttataacggtttctaacggcgggactcgtcggggtcccagacaagactcaggcggtctttgggtcaggtctctgactttcacactagaactatcagcgagggtggaggcgtgagtntggttgctatttatttgactatgataaactgagtaccgg

SEQ ID NO: 94889 - DNA, 255 bp, Homo sapiens
  misc_feature: GYAE6OF01ALHF3.21.71.G05.1.454.CMB.1.raw
  modified_base (249)..(255): a, c, t, g, unknown or other
  misc_feature (249)..(255): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctggggaccaggttggaaatcaaacgaactgtggctgcaccatctgtcttcatcttcccgccatctgactcgtctctactgagcgggctggcaaggcgcatagnnnnnnn

SEQ ID NO: 94890 - DNA, 264 bp, Homo sapiens
  misc_feature: GYAE6OF01CQFYC.21.71.G05.1.454.CMB.1.raw
  modified_base (252)..(264): a, c, t, g, unknown or other
  misc_feature (252)..(264): n is a, c, g, or t
tcagtcgtcgctcgcacgaccggtgctcgatttagtgtcgtcgcaagagagagggggtcaggctggaactgaggggcaggtggaggctgacgatggttggcatttatttttgcatgcaaaatacagactggccttggacgttcggcctggggaccaggttggaaatcaaacgactgtggctgcaccatctgtcttcatccttcccgcatctgacgagcgacgactggagcgggctggaccaaggcgcatagnnnnnnnnnnnnn

SEQ ID NO: 94891 - DNA, 250 bp, Homo sapiens
  misc_feature: GYAE6OF01CWB41.21.71.G05.1.454.CMB.1.raw
  modified_base (240)..(240): a, c, t, g, unknown or other
  misc_feature (240)..(240): n is a, c, g, or t
  modified_base (245)..(250): a, c, t, g, unknown or other
  misc_feature (245)..(250): n is a, c, g, or t
tcagtcgtcgctcgcacgaccggtgctcgatttagtgtcgtcgcaagagagagggggtcaggctggaactgaggggcaggtggaggctgacgatgttggctatttatttttgcatgacaaaatacagactggccttggacgttcggcctgggaccaggttgaaatcaaacgactgtggctgcaccatctgtcttcatcttcccgccatctgactcgtctctactgagcggctggcaggcnatagnnnnnn

SEQ ID NO: 94892 - DNA, 257 bp, Homo sapiens
  misc_feature: GYAE6OF01CNASE.21.71.G05.1.454.CMB.1.raw
  modified_base (244)..(257): a, c, t, g, unknown or other
  misc_feature (244)..(257): n is a, c, g, or t
tcagtcgtcgctcgcacgaccggtgctcgatttagtgtcgtcgcaagagagaggggtcaggctggaactgagggcaggtggaggctgacgatgttggcatttatttttgcatgcaaaatacagactggccttggacgttcggcctggggaccaggttggaaatcaaacgactgtggctgcaccatctgtcttcatcttcccgcatctgactcgtctctactgagcggctggcaaggcgcatagnnnnnnnnnnnnnn

SEQ ID NO: 94893 - DNA, 247 bp, Homo sapiens
  misc_feature: GYAE6OF01BYVRW.21.71.G05.1.454.CMB.1.raw
  modified_base (242)..(247): a, c, t, g, unknown or other
  misc_feature (242)..(247): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgactgtggctgcaccatctgtcttcatcttccgcatctgactcgtctctactgagcggctggcaggcgcatgnnnnnn

SEQ ID NO: 94894 - DNA, 721 bp, Homo sapiens
  misc_feature: GYAE6OF01DGZG7.21.71.G05.1.454.CMB.1.raw
tcagtcgtcgctcgcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtagtctgctttgctcagcgtcgagggtgctgctaatgctcgtcgggtcccagtgtccgagtggggaagttgtgatgactcagtctccactctccctcgcccgtccgcccttggacacgcccggcctcctatcctcctgccgtaggtctacgtcaggacgcgtcgtgtacgagtacgaaccggtaaccaccctacctactaacgttcggtttaccaaccgaaggaccggaccgaacgggaccccaacccgtacccgaccgggtcccgtacccttaacgttttaacgttaaacgggttttaccgtaacgggtccgggtaaccgttccggtaccgggggttaccccaaaggacccgtaaggtaaccgtacgacggtcccgggttcggtttcggggacctacgggtcctttcgttagtaacctttccgaaacctaccgtaagaacctagtaccgagtcggtaggggtacggaacggtcgtacggaacgttaggttcggtttacggtatttagtttttacgttttcgacgttaagttacgtaaactaaaaacgttacgaacggttaacgg

SEQ ID NO: 94895 - DNA, 253 bp, Homo sapiens
  misc_feature: GYAE6OF01AVGVJ.21.71.G05.1.454.CMB.1.raw
  modified_base (247)..(253): a, c, t, g, unknown or other
  misc_feature (247)..(253): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctggggaccaggttggaaatcaaacgactgtggctgcaccatctgtcttcatcttcccgcatctgactcgtctctactgagcgggctggcaaggcgcatagnnnnnnn

SEQ ID NO: 94896 - DNA, 252 bp, Homo sapiens
  misc_feature: GYAE6OF01AXPY9.21.71.G05.1.454.CMB.1.raw
  modified_base (246)..(252): a, c, t, g, unknown or other
  misc_feature (246)..(252): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgactgtggctgcaccatctgtcttcatcttcccgcatctgactcgtctctactgagcgggctggcaaggcgcatagnnnnnnn

SEQ ID NO: 94897 - DNA, 258 bp, Homo sapiens
  misc_feature: GYAE6OF01BPOTR.21.71.G05.1.454.CMB.1.raw
  modified_base (242)..(242): a, c, t, g, unknown or other
  misc_feature (242)..(242): n is a, c, g, or t
  modified_base (248)..(258): a, c, t, g, unknown or other
  misc_feature (248)..(258): n is a, c, g, or t
tcagtcgtcgctcgcacgaccggtgctcgatttagtgtcgtcgcaagagagagggggtcaggctggaactgaggggcaggtggaggctgacgatgttggcatttatttttgtatgcaaaatacagactggccttggacgttcggcctggggaccaggttgaaaatcaaacgaactgtggctgcaccatctgtcttcatcttcccgcatctgactcgtctctactgagcgggctggcaaggcncatagnnnnnnnnnnn

SEQ ID NO: 94898 - DNA, 254 bp, Homo sapiens
  misc_feature: GYAE6OF01CZTZN.21.71.G05.1.454.CMB.1.raw
  modified_base (184)..(184): a, c, t, g, unknown or other
  misc_feature (184)..(184): n is a, c, g, or t
  modified_base (245)..(254): a, c, t, g, unknown or other
  misc_feature (245)..(254): n is a, c, g, or t
tcagtcgtcgctcgcacgaccggtgctcgatttagtgtcgtcgcaagagagagggggtcaggctggaactgaggggcaggtggaggctgacgatgttggcattttatttttgcatgacaaaatacagactggccttggacgttcggcctgggaccaggttgaaatcaaacgactgtgctgcacntctgtctcatccttccgctatctgactcgtctctactgagcggctggacaggcgacatagnnnnnnnnnn

SEQ ID NO: 94899 - DNA, 595 bp, Homo sapiens
  misc_feature: GYAE6OF01AN5A1.21.71.G05.1.454.CMB.1.raw
tcagtcgtcgctcgcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtagtctgctttgctcagcgtcagggtgctgctaatgctctgggtcccagtgtccagtggggaagttgtgatgactcagtctccactctccctgcccgtcgcccttggacagccggcctccatctcctgcaggtctagtcagagcgtcgtgtacagtgacggtaacacctacctcaacttggtttacaccgagaggccacggcccaacccgtccgacggccaccttaactttagttaacggtttctaaggcgggtactcggtcgggtccagacagaatcgaggcgtcgttggcaggtctcgtgtacttcactacgtagaactagtaccagccggtaaggggtcgggaacggtcgtacggaacggtagttggttcgggtactttacttttttagtttttcgacgtagttacgaaactaaaaacgtcgtaaggtaacccggg

SEQ ID NO: 94900 - DNA, 652 bp, Homo sapiens
  misc_feature: GYAE6OF01CMEYV.21.71.G05.1.454.CMB.1.raw
  modified_base (230)..(230): a, c, t, g, unknown or other
  misc_feature (230)..(230): n is a, c, g, or t
tcagtcgtcgctcgcacgaccggtgctcgatttagtgtcgtcgcaagagagagggggcacttctccctctaacactctcccctgttgaagctctttgtgacggcgagctcaggccctgatgggtgacttcgcaggcgtagactttgtgtttctcgtagtctgctttgctcagcgtcagggtgctgctaatgctctgggtcccagtgtccagtggggaattgtgatgactnagtctccactctccctgcccgtcgcccttggcagccggcctccatctcctgcgagtctagtcagacgtcgtacgtgtacagtcgacggtaacaccgtacctcgaacgtcggtttacaaccgtaggaacggcctacgggacccaacccgtccgaccgggccgtaccttaacttttacgtaacggtttcctaaggccgggtaactccggtcggggttccccaagactagtaacgtcgaggcggtcgtttacgggcgaaggtctacgtgtacgtttcaacgtactacggtaaacctattccgaacgtccggtaggggtaggtaacggtccgttaggacccggtaaggttcgggtttacggtactttacgtttttaagttttggaacttacgtacggtaaactaaaactacgtaacgttaaccggg

SEQ ID NO: 94901 - DNA, 594 bp, Homo sapiens
  misc_feature: GYAE6OF01DSBM6.21.71.G05.1.454.CMB.1.raw
  modified_base (316)..(316): a, c, t, g, unknown or other
  misc_feature (316)..(316): n is a, c, g, or t
tcagtcgtcgctcgcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtagtctgctttgctcagcgtcagggtgctgctaatgctcgtgggtcccagtgtccaggtgggggaattgtgatgactcagtcctccactcctccctgcccgtcgtcccttggacacggcccggcctccatcctcctgcaggtctagtcagacgcgtcgtntacgagtacgaacgtaacacctactctaactgttacacgagacggccacggacccaacctccgacggcctaccttaactttacgtaacggtttacaaggcgggtactcggtcgggtccagacagactcgacgcggtcgttgggcaggtctctgtacttcactactacgaactatcgagtcggtagggtggacggtcgtaggacgtagttcgggttaggtacttttaagttttacgttttggacttacgttaacgtaactaaaactcgacgttaaccgg

SEQ ID NO: 94902 - DNA, 257 bp, Homo sapiens
  misc_feature: GYAE6OF01DRLY5.21.71.G05.1.454.CMB.1.raw
  modified_base (245)..(257): a, c, t, g, unknown or other
  misc_feature (245)..(257): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgactgtggctgcaccatctgtcttcatcttcccgcatctgactcgtctctactgagcggctggcaaggcgcatagnnnnnnnnnnnnn

SEQ ID NO: 94903 - DNA, 266 bp, Homo sapiens
  misc_feature: GYAE6OF01BNC6A.21.71.G05.1.454.CMB.1.raw
  modified_base (255)..(266): a, c, t, g, unknown or other
  misc_feature (255)..(266): n is a, c, g, or t
tcagtcgtcgctcgcacgaccggtgctcgatttagtgtcgtcgcaagagagagggggtcaggctggaactgaggggcaggtggaggctgacgatgttggctatttattttgcatgacaaaatacagactggccttggacgttcggccgtgggaccaggttgaaatcaaacgactgtggctgcaccatctgtcttcattccttcccgctatctgactcgtactctactggacgcgggctggaccaaggcgcatagnnnnnnnnnnnn

SEQ ID NO: 94904 - DNA, 792 bp, Homo sapiens
  misc_feature: GYAE6OF01B6W0H.21.71.G05.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagtgtcgtcgcaagagagaggggggcacttctccctctaacactctcccctgttgaagctctttgtgacgggcgagctcaggccctgatgggtgacttcgcaggcgtagactttgtgtttctcgtagtctgtctttgctcagcgtcgagggtgctgactaatgctcgtcgggtcccagtcgtccaggtggggtaagttgtgatgactcagtcctccnctcctcccgtcgcccgtcgtcccgttggaccacggcccggtcctccacttcctcctgcgaggtcctagtcgaggcgtcgtcgtagtacgtagtacgtaaccggtaactaccctacctacctaacgttcggtttaccaaccgaggaccggacccgaaccggacccctaaacccgtcccgaaccgggtcccgtaacccgtttaacgttttaacgttaacggttttaccgtaacggggtccgggtacctttccggggtcgggggtaacccctaggaaccgtaaggtaacgtaccgtaccgggtccggtttaccgggttttcgggtaccgtacgggtcccttacggttacgttacctttacccgaactaccggttaacggaacctacgttaaccgacgggttacgggaacgggggtaggtaccgggtccgttacgggtaacggttaccggtttggggtttaccggttacgttttaaggttttttcgttttacgaacgtttacggtaaaccgttaaaattaaaccggttagtaccggtaacccgggg

SEQ ID NO: 94905 - DNA, 796 bp, Homo sapiens
  misc_feature: GYAE6OF01C17GK.21.71.G05.1.454.CMB.1.raw
tcagtcgtcgctcgcacgaccggtgctcgatttagtgtcgtcgcaagagagaggggcacttctccctctaacactctccctgttgaagctcttgtgacggcgagctcagccctgagtggtgacttcgcgaggcgtagtactttgtgtttctcgtagtcgtgtctttgctcgagcgtcgaggtgctgtactaagtcgcgttacggtcggtcccgtagttcgtccgtaaggttagggtaagttgtacgtagtacgaacctcgtacgttcctacccgtaccttccgtcccgtccgtccccgttccgtcccgttggaccgaccgtcccgtcctacctccgtccgtccgtacggcgttacggtacgtacgtacgagtaccggttcgtcggtaacgtacgtagtaacgtaacccgtaacctacccgtaccgttacgtaacgttcgtaaccgacgtacgacgacccgaccgtacccctaaccgccgaccgtaccgttaaccgtttaacgtttaacgttaacgtacgacggtaccggtacgttaccgggtaccggtacaaggaacgtaacgtaacgtcggtaccggtcggtttcgtccggtacgtaccgttacgttcgttacgtaccgttacccgaacgtaacgtaccgtaaacgtacggtacgacggtaaggtacggggtaagtaccgttacggtaacggtagttttaaccggtggtttaactttaacggtttttacgtttaacggttttacggaaacttaacgtaaaccgtaaaacgtttaagaccgttaccggttaacggg

SEQ ID NO: 94906 - DNA, 687 bp, Homo sapiens
  misc_feature: GYAE6OF01BHAEW.21.71.G05.1.454.CMB.1.raw
tcagtcgtcgctcgcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtagtctgctttgctcagcgtcagggtgctgctaatgctcgtgggtcccagtcgtccgaggtagggggaagttgtgatgactcacgtcctccaccttcctccctcgccccgtccgtcccgttggaccacggcccggcctccactcctccgtcgcctacggtctacgtcaacggtacggtcggttcggtagtaacgaggtacggaaccggtaacctacccttacctactaaccgttcggttaccaccgaggacggaccgacggacccaaccgtccgaccggccgtacctttaacgtttaacgttaacggtttacgtaacggccgggtacgtacggtcgggtaccagacagtaactcgacggtcggttcgtttcgggctacggtcctgtacgttacttaccaactactacgaactagtacgaggacggtaggggacggaggtcgtacggtacggttacgttacggttaggtactttaagtttttcgtttacgacgttaagtacgtaaactaaacggtacgtacggttaaccggg

SEQ ID NO: 94907 - DNA, 321 bp, Homo sapiens
  misc_feature: GYAE6OF01A202C.21.71.G05.1.454.CMB.1.raw
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
  modified_base (269)..(321): a, c, t, g, unknown or other
  misc_feature (269)..(321): n is a, c, g, or t
tcagtcgtcgctcgcacgaccggtgctcgatttagtgtcgtcgcaagagagagggggtcaggctggaactgaggggcaggtggaggctgacgatgttggcattttatttttgcatgacaaaatacagactggccttggacgttcggcctggggaccaggttggaaatcgaaacgaactgtaggctgcaccatctgtcttcatccttccgcatctgactcgtctctactggacgcgggtntcgggacaaggccgacagtagnatcagtcnnnnnnnnnnnnnnnnnnnnnnnnnnnnnnnnnnnnnnnnnnnnnnnnnnnnn

SEQ ID NO: 94908 - DNA, 272 bp, Homo sapiens
  misc_feature: GYAE6OF01CM4BV.21.71.G05.1.454.CMB.1.raw
  modified_base (244)..(244): a, c, t, g, unknown or other
  misc_feature (244)..(244): n is a, c, g, or t
  modified_base (251)..(272): a, c, t, g, unknown or other
  misc_feature (251)..(272): n is a, c, g, or t
tcagtcgtcgctcgcacgaccggtgctcgatttagtgtcgtcgcaagagagagggggtcaggctggaactgaggggcaggtggaggctgacgatgttggctatttattttgcatgacaaaatcagactggccttggacgttcggcctggggaccaggttaggaaatcaaaacgactgtggctgcaccatctgtcttcatcctcccgcatctgactcgtctctatgaggcggctggacaaaggcnctatagnnnnnnnnnnnnnnnnnnnnnn

SEQ ID NO: 94909 - DNA, 792 bp, Homo sapiens
  misc_feature: GYAE6OF01D5QW2.21.71.G05.1.454.CMB.1.raw
  modified_base (185)..(185): a, c, t, g, unknown or other
  misc_feature (185)..(185): n is a, c, g, or t
  modified_base (775)..(775): a, c, t, g, unknown or other
  misc_feature (775)..(775): n is a, c, g, or t
tcagtcgtcgctcgcacgaccggtgctcgatttagtgtcgtcgcaagagagagggggcacttctccctctaacactctcccctgttgaagctctttgtgacgggcgagctcacggccctggatgggtgacttcgcgaggcgtagtactttgttgtttctcgtagtctgtctttgctcagcgtcgnggtgctgtctaatcgctcgtcggtccagtcgtcgaggtaggggtagttgtgagtcgactctacgtctacctactcctccgtcgtcccgtccgtccgtacggaccgacgcccggtcctacctactcctccgtcgcgtacggtactacgtcgacgacggtcgttcgtagtacgaggtaccgaaccgtaacctaccctaccttacgtaaccgttcggttaccaaccgtagaccggacccgaccggaaccctaaacccgtcccgtaacggtacccgttaccgtttaacgtttaaacggttaacggtttaaccggtaacggaccgggtaccgttcgggtaccgggtaccaacgtaacgaagtaaacgttccgacggttacggttaccggtttacgggaccgtacgggtaccttacgtagtttaccgtttaacaaccgttaacgtaccgtaacttaccgtaacgtacgggtacgggtaacggggttggaacgtacgtaccgggtaaggtttaaacggttcgggtttaaccgttatttttaaggtttttacggttttaacgtagttaaacgttaaacgaaaacccgtttaaaacggngttaacccggttacggg

SEQ ID NO: 94910 - DNA, 249 bp, Homo sapiens
  misc_feature: GYAE6OF02JERF3.21.71.G05.1.454.CMB.1.raw
  modified_base (246)..(249): a, c, t, g, unknown or other
  misc_feature (246)..(249): n is a, c, g, or t
tcagtcgtcgctcgcacgaccggtgctcgatttagtgtcgtcgcaagagagaggggtcaggctggaactgagggcaggtggaggctgacgatgttggcatttattttgtatgcaaaatacagactggccttggacgttcggcctggggaccaggttggaaatcaaacgaactgtggctgcaccatctgtcttcatcttcccgccatctgactcgtctctactgagcgggctggcaaggcgcatagnnnn

SEQ ID NO: 94911 - DNA, 245 bp, Homo sapiens
  misc_feature: GYAE6OF02GHS76.21.71.G05.1.454.CMB.1.raw
  modified_base (243)..(245): a, c, t, g, unknown or other
  misc_feature (243)..(245): n is a, c, g, or t
tcagtcgtcgctcgcacgaccggtgctcgatttagtgtcgtcgcaagagagagggtcaggctggaactgagggcaggtggaggctgacgatgttggcatttattttgcatgcaaatacagactggccttggacgttcggcctgggaccaggttggaaatcaaacgaactgtggctgcaccatctgtcttcatcttcccgccatctgactcgtctctactgagcgggctggcaaggcgcatagnnn

SEQ ID NO: 94912 - DNA, 251 bp, Homo sapiens
  misc_feature: GYAE6OF02H3E1K.21.71.G05.1.454.CMB.1.raw
  modified_base (247)..(251): a, c, t, g, unknown or other
  misc_feature (247)..(251): n is a, c, g, or t
tcagtcgtcgctcgcacgaccggtgctcgatttagtgtcgtcgcaagagagaggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgccatctgactcgtctctactgagcgggctggcaaggcgcatagnnnnn

SEQ ID NO: 94913 - DNA, 246 bp, Homo sapiens
  misc_feature: GYAE6OF02GQYCS.21.71.G05.1.454.CMB.1.raw
  modified_base (244)..(246): a, c, t, g, unknown or other
  misc_feature (244)..(246): n is a, c, g, or t
tcagtcgtcgctcgcacgaccggtgctcgatttagtgtcgtcgcaagagagagggtcaggctggaactgagggcaggtggaggctgacgatgttggcatttattttgcatgcaaatacagactggccttggacgttcggcctggggaccaggttggaaatcaaacgaactgtggctgcaccatctgtcttcatcttcccgccatctgactcgtctctactgagcgggctggcaaggcgcatagnnn

SEQ ID NO: 94914 - DNA, 249 bp, Homo sapiens
  misc_feature: GYAE6OF02FVASF.21.71.G05.1.454.CMB.1.raw
  modified_base (247)..(249): a, c, t, g, unknown or other
  misc_feature (247)..(249): n is a, c, g, or t
tcagtcgtcgctcgcacgaccggtgctcgatttagtgtcgtcgcaagagagaggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgccatctgactcgtctctactgagcgggctggcaaggcgcatagnnn

SEQ ID NO: 94915 - DNA, 249 bp, Homo sapiens; identical to SEQ ID NO: 94914
  misc_feature: GYAE6OF02GJFJL.21.71.G05.1.454.CMB.1.raw
  modified_base (247)..(249): a, c, t, g, unknown or other
  misc_feature (247)..(249): n is a, c, g, or t

SEQ ID NO: 94916 - DNA, 252 bp, Homo sapiens
  misc_feature: GYAE6OF02HJE9G.21.71.G05.1.454.CMB.1.raw
  modified_base (246)..(252): a, c, t, g, unknown or other
  misc_feature (246)..(252): n is a, c, g, or t
tcagtcgtcgctcgcacgaccggtgctcgatttagtgtcgtcgcaagagagaggggtcaggctggaactgaggggcaggtggaggctgacgatgttggcatttattttgcatgcaaatacagactggccttggacgttcggcctggggaccaggttggaaatcaaacgaactgtggctgcaccatctgtcttcatcttcccgccatctgactcgtctctactgagcgggctggcaaggcgcatagnnnnnnn

SEQ ID NO: 94917 - DNA, 251 bp, Homo sapiens; identical to SEQ ID NO: 94912
  misc_feature: GYAE6OF02ITKZ8.21.71.G05.1.454.CMB.1.raw
  modified_base (247)..(251): a, c, t, g, unknown or other
  misc_feature (247)..(251): n is a, c, g, or t

SEQ ID NO: 94918 - DNA, 251 bp, Homo sapiens
  misc_feature: GYAE6OF02HFN1L.21.71.G05.1.454.CMB.1.raw
  modified_base (246)..(251): a, c, t, g, unknown or other
  misc_feature (246)..(251): n is a, c, g, or t
tcagtcgtcgctcgcacgaccggtgctcgatttagtgtcgtcgcaagagagaggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgccatctgactcgtctctactgagcggctggcaaggcgcatagnnnnnn

SEQ ID NO: 94919 - DNA, 251 bp, Homo sapiens
  misc_feature: GYAE6OF02G3MP8.21.71.G05.1.454.CMB.1.raw
  modified_base (246)..(251): a, c, t, g, unknown or other
  misc_feature (246)..(251): n is a, c, g, or t
tcagtcgtcgctcgcacgaccggtgctcgatttagtgtcgtcgcaagagagaggggtcaggctggaactgagggcaggtggaggctgacgatgttggcatttattttgcatgcaaaatacagactggccttggacgttcggcctggggatcaggttggaaatcaaacgaactgtggctgcaccatctgtcttcatcttcccgccatctgactcgtctctactgagcgggctggcaaggcgcatagnnnnnn

SEQ ID NO: 94920 - DNA, 286 bp, Homo sapiens
  misc_feature: GYAE6OF02GXY5I.21.71.G05.1.454.CMB.1.raw
  modified_base (248)..(249): a, c, t, g, unknown or other
  misc_feature (248)..(249): n is a, c, g, or t
  modified_base (252)..(286): a, c, t, g, unknown or other
  misc_feature (252)..(286): n is a, c, g, or t
tcagtcgtcgctcgcacgaccggtgctcgatttagtgtcgtcgcaagagagaggggtcaggctggaactgaggggcaggtggaggctgacgatgttggcatttattttgcatgcaaaatacagactggccttggacgttcggcctggggaccaggttggaaatcaaacgaactgtaggctgcaccatctgtcttcatcttcccgcagtctgactcgtctctacgtgagcggctggcaaggcgcatagnnagnnnnnnnnnnnnnnnnnnnnnnnnnnnnnnnnnnn

SEQ ID NO: 94921 - DNA, 252 bp, Homo sapiens
  misc_feature: GYAE6OF02IAA1B.21.71.G05.1.454.CMB.1.raw
  modified_base (246)..(252): a, c, t, g, unknown or other
  misc_feature (246)..(252): n is a, c, g, or t
tcagtcgtcgctcgcacgaccggtgctcgatttagtgtcgtcgcaagagagaggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgcatctgactcgtctctactgagcgggctggcaaggcgcatagnnnnnnn

SEQ ID NO: 94922 - DNA, 254 bp, Homo sapiens
  misc_feature: GYAE6OF02GL47V.21.71.G05.1.454.CMB.1.raw
  modified_base (247)..(254): a, c, t, g, unknown or other
  misc_feature (247)..(254): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgcatctgacgagcgacgactgagcgggctggcaaggcgcatagnnnnnnnn

SEQ ID NO: 94923 - DNA, 251 bp, Homo sapiens; identical to SEQ ID NO: 94912
  misc_feature: GYAE6OF02GEQ10.21.71.G05.1.454.CMB.1.raw
  modified_base (247)..(251): a, c, t, g, unknown or other
  misc_feature (247)..(251): n is a, c, g, or t

SEQ ID NO: 94924 - DNA, 255 bp, Homo sapiens
  misc_feature: GYAE6OF02H9DS6.21.71.G05.1.454.CMB.1.raw
  modified_base (247)..(255): a, c, t, g, unknown or other
  misc_feature (247)..(255): n is a, c, g, or t
tcagtcgtcgctcgcacgaccggtgctcgatttagtgtcgtcgcaagagagaggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgccatctgactcgtctctactgagcgggctggcaaggcgcatagnnnnnnnnn

SEQ ID NO: 94925 - DNA, 253 bp, Homo sapiens
  misc_feature: GYAE6OF02HVIY9.21.71.G05.1.454.CMB.1.raw
  modified_base (245)..(253): a, c, t, g, unknown or other
  misc_feature (245)..(253): n is a, c, g, or t
tcagtcgtcgctcgcacgaccggtgctcgatttagtgtcgtcgcaagagagaggggtcaggctggaactgaggggcaggtggaggctgacgatgttggcatttattttgtatgcaaaatacagactggccttggacgttcggcctggggaccaggttggaaatcaaacgaactgtggctgcaccatctgtcttcatcttcccgcatctgactcgtctctactgagcggctggcaaggcgcatagnnnnnnnnn

SEQ ID NO: 94926 - DNA, 252 bp, Homo sapiens
  misc_feature: GYAE6OF02GQMJ0.21.71.G05.1.454.CMB.1.raw
  modified_base (247)..(252): a, c, t, g, unknown or other
  misc_feature (247)..(252): n is a, c, g, or t
tcagtcgtcgctcgcacgaccggtgctcgatttagtgtcgtcgcaagagagaggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgccatctgactcgtctctactgagcgggctggcaaggcgcatagnnnnnn

SEQ ID NO: 94927 - DNA, 253 bp, Homo sapiens; identical to SEQ ID NO: 94865
  misc_feature: GYAE6OF02GK4U0.21.71.G05.1.454.CMB.1.raw
  modified_base (248)..(253): a, c, t, g, unknown or other
  misc_feature (248)..(253): n is a, c, g, or t

SEQ ID NO: 94928 - DNA, 316 bp, Homo sapiens
  misc_feature: GYAE6OF02GF6ST.21.71.G05.1.454.CMB.1.raw
  modified_base (255)..(255): a, c, t, g, unknown or other
  misc_feature (255)..(255): n is a, c, g, or t
  modified_base (257)..(264): a, c, t, g, unknown or other
  misc_feature (257)..(264): n is a, c, g, or t
  modified_base (266)..(269): a, c, t, g, unknown or other
  misc_feature (266)..(269): n is a, c, g, or t
  modified_base (274)..(316): a, c, t, g, unknown or other
  misc_feature (274)..(316): n is a, c, g, or t
tcagtcgtcgctcgcacgaccggtgctcgatttagtgtcgtcgcaagagagagggggtcaggggctggaacgtggaggggcaggtggaggcgtgacgatgttggcatttagtttttgcatgctaaaatcagtactggccttggacgttcggcctggggaccagggttcgaaatcaaacgacctgtggctgcaccatctgtcttcatcttccgcatctgactcgtctctactgagcgggctggcaaggcgcatagntnnnnnnnnannnncacannnnnnnnnnnnnnnnnnnnnnnnnnnnnnnnnnnnnnnnnnn

SEQ ID NO: 94929 - DNA, 512 bp, Homo sapiens
  misc_feature: GYAE6OF02I6BU3.21.71.G05.1.454.CMB.1.raw
tcagtcgtcgctcgcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtagtctgctttgctcagcgtcagggtgctgctaatgctctgggtcccagtgtccagtggggaagttgtgatgactcagtctccactctccctgcccgtcgcccttggacagccggcctccatctcctgcaggtctagtcagagcgtcgtgtacagtgacggtaacacctacctcaactggtttcaccagaggccaggccaacctccacggcgcctactttataaggtttctaagcggactctggggtcccagacagaatcagcggctttggtcaggctctgatttcacactgaacatcagcaggtggaggctgacgagtgttggctattttattttgctatgacaaatacagtacg

SEQ ID NO: 94930 - DNA, 263 bp, Homo sapiens
  misc_feature: GYAE6OF02JRVYV.21.71.G05.1.454.CMB.1.raw
  modified_base (244)..(263): a, c, t, g, unknown or other
  misc_feature (244)..(263): n is a, c, g, or t
tcagtcgtcgctcgcacgaccggtgctcgatttagtgtcgtcgcaagagagaggggtcgaggctggaactgagggcaggtggaggctgacgatgttggcatttattttcgcatgccaaatacagactggccttggacgttcggcctgggaccaggttgaaatcaaacgactgtggctgcaccatctgtcttcatccttccgcatctgactcgtctctactgagcgggctggcaaggcgcatagnnnnnnnnnnnnnnnnnnnn

SEQ ID NO: 94931 - DNA, 250 bp, Homo sapiens
  misc_feature: GYAE6OF02GB1RO.21.71.G05.1.454.CMB.1.raw
  modified_base (247)..(250): a, c, t, g, unknown or other
  misc_feature (247)..(250): n is a, c, g, or t
tcagtcgtcgctcgcacgaccggtgctcgatttagtgtcgtcgcaagagagaggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgccatctgactcgtctctactgagcgggctggcaaggcgcatagnnnn

SEQ ID NO: 94932 - DNA, 252 bp, Homo sapiens
  misc_feature: GYAE6OF02FJHVY.21.71.G05.1.454.CMB.1.raw
  modified_base (247)..(252): a, c, t, g, unknown or other
  misc_feature (247)..(252): n is a, c, g, or t
tcagtcgtcgctcgcacgaccggtgctcgatttagtgtcgtcgcaagagagaggggtcaggctggaactgaggggcaggtggaggctgacgatgttggcatttatttttgcatgcaaaatacagactggccttggacgttcggcctggggaccaggttggaaatcaaacgaactgtggctgcaccatctgtcttcatcttcccgcatctgactcgtctctactgagcgggctggcaaggcgcatagnnnnnn

SEQ ID NO: 94933 - DNA, 250 bp, Homo sapiens
  misc_feature: GYAE6OF02I8R87.21.71.G05.1.454.CMB.1.raw
  modified_base (245)..(250): a, c, t, g, unknown or other
  misc_feature (245)..(250): n is a, c, g, or t
tcagtcgtcgctcgcacgaccggtgctcgatttagtgtcgtcgcaagagagaggggtcaggctggaactgaggggcaggtggaggctgacgatgttggcatttattttgcatgcaaatacagactggccttggacgttcggcctgggaccaggttggaaatcaaacgaactgtggctgcaccatctgtcttcatcttcccgccatctgactcgtctctactgagcgggctggcaaggcgcatagnnnnnn

SEQ ID NO: 94934 - DNA, 249 bp, Homo sapiens
  misc_feature: GYAE6OF02GSEQJ.21.71.G05.1.454.CMB.1.raw
  modified_base (248)..(249): a, c, t, g, unknown or other
  misc_feature (248)..(249): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgccatctgactcgtctctactgagcgggctggcaaggcgcatagnn

SEQ ID NO: 94935 - DNA, 252 bp, Homo sapiens
  misc_feature: GYAE6OF02IGCXV.21.71.G05.1.454.CMB.1.raw
  modified_base (245)..(252): a, c, t, g, unknown or other
  misc_feature (245)..(252): n is a, c, g, or t
tcagtcgtcgctcgcacgaccggtgctcgatttagtgtcgtcgcaagagagagggggtcaggctggaactgaggggcaggtggaggctgacgatgttggcatttattttgtatgcaaaatacagactggccttggacgttcggcctgggaccaggttggaaatcaaacgactgtggctgcaccatctgtcttcatcttcccgccatctgactcgtctctactgagcggctggcaaggcgcatagnnnnnnnn

SEQ ID NO: 94936 - DNA, 255 bp, Homo sapiens
  misc_feature: GYAE6OF02GXQ2F.21.71.G05.1.454.CMB.1.raw
  modified_base (247)..(255): a, c, t, g, unknown or other
  misc_feature (247)..(255): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgcatctgactcgtctctactgagcgggctggcaaggcgcatagnnnnnnnnn

SEQ ID NO: 94937 - DNA, 252 bp, Homo sapiens; identical to SEQ ID NO: 94926
  misc_feature: GYAE6OF02G6R5Y.21.71.G05.1.454.CMB.1.raw
  modified_base (247)..(252): a, c, t, g, unknown or other
  misc_feature (247)..(252): n is a, c, g, or t

SEQ ID NO: 94938 - DNA, 254 bp, Homo sapiens
  misc_feature: GYAE6OF02I8SPI.21.71.G05.1.454.CMB.1.raw
  modified_base (248)..(254): a, c, t, g, unknown or other
  misc_feature (248)..(254): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctggggaccaggttggaaatcaaacgaactgtggctgcaccatctgtcttcatcttcccgcatctgactcgtctctactgagcgggctggcaaggcgcatagnnnnnnn

SEQ ID NO: 94939 - DNA, 260 bp, Homo sapiens
  misc_feature: GYAE6OF02JE4BZ.21.71.G05.1.454.CMB.1.raw
  modified_base (249)..(260): a, c, t, g, unknown or other
  misc_feature (249)..(260): n is a, c, g, or t
tcagtcgtcgctcgcacgaccggtgctcgatttagtgtcgtcgcaagagagagggggtcaggctggaactgaggggcaggtggaggctgacgatgttggcatttatttttgtatgcaaaatacagactggccttggacgttcggcctggggaccaggttggaaatcaaacgaactgtggctgcaccatctgtcttcatcttcccgccatctgactcgtctctactgagcgggctggcaaggcgcatagnnnnnnnnnnnn

SEQ ID NO: 94940 - DNA, 256 bp, Homo sapiens
  misc_feature: GYAE6OF02G8IZI.21.71.G05.1.454.CMB.1.raw
  modified_base (249)..(256): a, c, t, g, unknown or other
  misc_feature (249)..(256): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctggggaccaggttggaaatcaaacgaactgtggctgcaccatctgtcttcatcttcccgccatctgactcgtctctactgagcgggctggcaaggcgcatagnnnnnnnn

SEQ ID NO: 94941 - DNA, 257 bp, Homo sapiens
  misc_feature: GYAE6OF02HFEIY.21.71.G05.1.454.CMB.1.raw
  modified_base (248)..(257): a, c, t, g, unknown or other
  misc_feature (248)..(257): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctggggaccaggttggaaatcaaacgactgtggctgcaccatctgtcttcatcttcccgccatctgacgagcgacgactgagcgggctggcaaggcgcatagnnnnnnnnnn

SEQ ID NO: 94942 - DNA, 252 bp, Homo sapiens
  misc_feature: GYAE6OF02HBCGZ.21.71.G05.1.454.CMB.1.raw
  modified_base (246)..(252): a, c, t, g, unknown or other
  misc_feature (246)..(252): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctggggaccaggttggaaatcaaacgactgtggctgcaccatctgtcttcatcttcccgcatctgactcgctctactgagcgggctggcaaggcgcatagnnnnnnn

SEQ ID NO: 94943 - DNA, 251 bp, Homo sapiens
  misc_feature: GYAE6OF02HZ1B7.21.71.G05.1.454.CMB.1.raw
  modified_base (247)..(251): a, c, t, g, unknown or other
  misc_feature (247)..(251): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctggggaccaggttggaaatcaaacgaactgtggctgcaccatctgtcttcatctcccgcatctgactcgtctctactgagcgggctggcaaggcgcatagnnnnn

SEQ ID NO: 94944 - DNA, 255 bp, Homo sapiens
  misc_feature: GYAE6OF02H84DW.21.71.G05.1.454.CMB.1.raw
  modified_base (251)..(255): a, c, t, g, unknown or other
  misc_feature (251)..(255): n is a, c, g, or t
tcagtcgtcgctcgcacgaccggtgctcgatttagtgtcgtcgcaagagagaggggtcaggctggaactgaggggcaggtggaggctgacgatgttggcatttatttttgcatgacaaaatacagactggccttggacgttcggcctggggaccaggttggaaatcaaacgaactgtggctgcaccatctgtcttcatccttcccgcatctgactcgtctctactgagcgggctggcaaggcgacagtagnnnnn

SEQ ID NO: 94945 - DNA, 252 bp, Homo sapiens
  misc_feature: GYAE6OF02GS72J.21.71.G05.1.454.CMB.1.raw
  modified_base (248)..(252): a, c, t, g, unknown or other
  misc_feature (248)..(252): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctggggaccaggttggaaatcaaacgaactgtggctgcaccatctgtcttcatcttcccgcatctgactcgtctctactgagcgggctggcaaggcgcatagnnnnn

SEQ ID NO: 94946 - DNA, 252 bp, Homo sapiens
  misc_feature: GYAE6OF02FQV3W.21.71.G05.1.454.CMB.1.raw
  modified_base (247)..(252): a, c, t, g, unknown or other
  misc_feature (247)..(252): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctggggaccaggttggaaatcaaacgaactgtggctgcaccatctgtcttcatctcccgcatctgactcgtctctactgagcgggctggcaaggcgcatagnnnnnn

SEQ ID NO: 94947 - DNA, 586 bp, Homo sapiens
  misc_feature: GYAE6OF02IMQQW.21.71.G05.1.454.CMB.1.raw
tcagtcgtcgctcgcacgaccggtgctcgatttagtgtcgtcgcaagagagaggggggcacttctccctctaacactctcccctgttgaagctctttgtgacgggcgagctcaggccctgatgggtgacttcgcaggcgtagactttgtgtttctcgtagtctgctttgctcagcgtcagggtgctgctaatgctctgggtcccagtgtccagtggggaagttgtgatgactcagtctccactctccctgcccgtcgcccttggacacgccggcctccatctcctgcaggtctagtcagagcgtcgtgtacagtgacggtaacacctacctcaactggttacaccagacggccacggacccaacctccgacggccgccttactttacgtaaggtttctaagcgggactcgtcggggtacccagacagaactcgaggcggtcgtttgggcacggtccttctgtactttcactacgtacgaacatacgacgcgtagggtggacggcgtaggaacgtagttggttcggtacttaagtttttacgttttggacttaacgtacgtaactaaaacgttccgaagtaacccgg

SEQ ID NO: 94948 - DNA, 564 bp, Homo sapiens
  misc_feature: GYAE6OF02JU7YP.21.71.G05.1.454.CMB.1.raw
  modified_base (183)..(183): a, c, t, g, unknown or other
  misc_feature (183)..(183): n is a, c, g, or t
  modified_base (311)..(311): a, c, t, g, unknown or other
  misc_feature (311)..(311): n is a, c, g, or t
  modified_base (451)..(451): a, c, t, g, unknown or other
  misc_feature (451)..(451): n is a, c, g, or t
tcagtcgtcgctcgcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtagtctgctttgctcagcgtcagggtnctgctaatgctctgggtcccagtgtccagtggggaagttgtgatgactcagtctccactctccctgcccgtcgcccttggacagccggcctccatcctcctgcaggtctagtcagagcgtcgtgtacngtgacggtacacctacctcaacttggttcaccagacggccaggcccaaccgtccacggccgccttacgtttataaggtttcaaggcggactcgtcggggtcccagacagaactcgagcggtctttgggtcaggcctcgtntactttcactacgtgaaccatcgagtcgtagggtggaacggtctggtaacggtagttcggttggtactagtttttaatttggtactgtagtaccgtaaagtacgagttaccgg

SEQ ID NO: 94949 - DNA, 589 bp, Homo sapiens
  misc_feature: GYAE6OF02HLHYI.21.71.G05.1.454.CMB.1.raw
  modified_base (477)..(477): a, c, t, g, unknown or other
  misc_feature (477)..(477): n is a, c, g, or t
tcagtcgtcgctcgcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtagtctgctttgctcagcgtcagggtgctgctaatgctctgggtcccagtgtccagtggggaagttgtgatgactcagtctccactctcctcgcccgtcgccttggacagccggcctccatctcctgcaggtctagtcagagcgtcgtgtacagtgacggtaacacctacctcaacttgttacaccgagacggccaggacccaacctccgaccggccgtacccttaactttaacgttaacggttttacgtaacggcgggtacttcggtacgggggtcccaaggaacaaggaactcgaggtcggtcgtttgggcaggtcctntgactttacaactactagaactatcagcggagggtgaggtctaggacgtgttggttggtacttagtttttacgttttggacttagtacgtaactaaaagtacgaaggtaccg

SEQ ID NO: 94950 - DNA, 536 bp, Homo sapiens
  misc_feature: GYAE6OF02HP6FW.21.71.G05.1.454.CMB.1.raw
  modified_base (370)..(370): a, c, t, g, unknown or other
  misc_feature (370)..(370): n is a, c, g, or t
  modified_base (440)..(440): a, c, t, g, unknown or other
  misc_feature (440)..(440): n is a, c, g, or t
  modified_base (459)..(459): a, c, t, g, unknown or other
  misc_feature (459)..(459): n is a, c, g, or t
tcagtcgtcgctcgcacgaccggtgctcgatttagtgtcgtcgcaagagagaggggggcacttctccctctaacactctcccctgttgaagctctttgtgacgggcgagctcaggccctgatgggtgacttcgcaggcgtagactttgtgtttctcgtagtctgctttgctcagcgtcagggtgctgctaatgctctgggtcccagtgtccagtggggaagttgtgatgactcagtctccactctccctgcccgtcgcccttggacagccggcctccatctcctgcaggtctagtcagagcgtcgtgtacagtgacggtaacacctacctcaactggttcaccagacggccaggccaacctccacggccncctactttataaggtttctaagcggactcgtcggggtcccagacagaatcagcggtcttgggtcaggctntgtactttcacactgaacntcagcgagggtcgaggctaggacgtagttggttcggacttagttttacttttgactagtgaactaaatacagtacgg

SEQ ID NO: 94951 - DNA, 254 bp, Homo sapiens
  misc_feature: GYAE6OF02HBALO.21.71.G05.1.454.CMB.1.raw
  modified_base (249)..(254): a, c, t, g, unknown or other
  misc_feature (249)..(254): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctggggaccaggttggaaatcaaacgaactgtggctgcaccatctgtcttcatcttcccgccatctgactcgtctctactgagcgggctggcaaggcgcatagnnnnnn

SEQ ID NO: 94952 - DNA, 255 bp, Homo sapiens
  misc_feature: GYAE6OF02GJ08F.21.71.G05.1.454.CMB.1.raw
  modified_base (248)..(255): a, c, t, g, unknown or other
  misc_feature (248)..(255): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgccatctgactcgtctctactgagcgggctggcaaggcgcatagnnnnnnnn

SEQ ID NO: 94953 - DNA, 528 bp, Homo sapiens
  misc_feature: GYAE6OF02IV6F1.21.71.G05.1.454.CMB.1.raw
  modified_base (309)..(309): a, c, t, g, unknown or other
  misc_feature (309)..(309): n is a, c, g, or t
tcagtcgtcgctcgcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtagtctgctttgctcagcgtcagggtgctgctaatgctctgggtcccagtgtccagtggggaattgtgatgactcagtctccactctccctgcccgtcgcccttggacagccggcctccatctcctgcaggtctagtcagagcgtcgtgtacngtgacggtaacacctacctcaactggttacacagacgccaggcccaacgtccacggcgcctactttataaggtttcaagcgggactcgtcgggtcccagacagaatcaggcggtcgtttgggcacgggctcgtgatttccactactgaactatcagcgaagggtgagtctagacgtagtgttagctattttagtttagctatagactaaatacagtacg

SEQ ID NO: 94954 - DNA, 259 bp, Homo sapiens
  misc_feature: GYAE6OF02H347D.21.71.G05.1.454.CMB.1.raw
  modified_base (252)..(259): a, c, t, g, unknown or other
  misc_feature (252)..(259): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctggggaccaggttggaaatcaaacgaactgtggctgcaccatctgtcttcatccttcccgccatctgactcgtctctactgacgcgggctggcaaggcgacatagnnnnnnnn

SEQ ID NO: 94955 - DNA, 253 bp, Homo sapiens
  misc_feature: GYAE6OF02FO18V.21.71.G05.1.454.CMB.1.raw
  modified_base (248)..(253): a, c, t, g, unknown or other
  misc_feature (248)..(253): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctggggaccaggttggaaatcaaacgaactgtggctgcaccatctgtcttcatcttcccgcatctgactcgtctctactgagcgggctggcaaggcgcatagnnnnnn

SEQ ID NO: 94956 - DNA, 254 bp, Homo sapiens
  misc_feature: GYAE6OF02GAN6H.21.71.G05.1.454.CMB.1.raw
  modified_base (248)..(254): a, c, t, g, unknown or other
  misc_feature (248)..(254): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaacgaactgtggctgcaccatctgtcttcatcttcccgccatctgactcgtctctactgagcgggctggcaaggcgcatagnnnnnnn

SEQ ID NO: 94957 - DNA, 255 bp, Homo sapiens
  misc_feature: GYAE6OF02H73J9.21.71.G05.1.454.CMB.1.raw
  modified_base (248)..(255): a, c, t, g, unknown or other
  misc_feature (248)..(255): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgacaaaatacagactggccttggacgttcggcctggggaccaggttgaaatcaaacgaactgtggctgcaccatctgtcttcatccttcccgcatctgactcgtctctactgagcgggctggcaaggcgcatagnnnnnnnn

SEQ ID NO: 94958 - DNA, 270 bp, Homo sapiens
  misc_feature: GYAE6OF02FIHCJ.21.71.G05.1.454.CMB.1.raw
  modified_base (246)..(270): a, c, t, g, unknown or other
  misc_feature (246)..(270): n is a, c, g, or t
tcagtcgtcgctcgcacgaccggtgctcgatttagtgtcgtcgcaagagagagggggtcaggctggaactgagggcaggtggaggctgacgatgttggcatttatttttgcatgcaaaatacagactggccttggacgttcggcctggggaccaggttggaaatcaaacgactgtggctgcaccatctgtcttcatcttcccgcatctgactcgtctctactgacgcggctggcaaggcgcatagnnnnnnnnnnnnnnnnnnnnnnnnn

SEQ ID NO: 94959 - DNA, 254 bp, Homo sapiens
  misc_feature: GYAE6OF02FPIO5.21.71.G05.1.454.CMB.1.raw
  modified_base (240)..(240): a, c, t, g, unknown or other
  misc_feature (240)..(240): n is a, c, g, or t
  modified_base (247)..(254): a, c, t, g, unknown or other
  misc_feature (247)..(254): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctgggaccaggttggaaatcaaacgactgtgctgcaccatctgtcttcatccttcccgcatctgactcgtctctactgagcgggctggcaaggcncagtagnnnnnnnn

SEQ ID NO: 94960 - DNA, 274 bp, Homo sapiens
  misc_feature: GYAE6OF02IGBI2.21.71.G05.1.454.CMB.1.raw
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (260)..(274): a, c, t, g, unknown or other
  misc_feature (260)..(274): n is a, c, g, or t
tcagtcgtcgctcgcacgaccggtgctcgatttagtgtcgtcgcaagagagagggggtcaggctggaactggaggggcaggtggaggctgacgatgttggctattttatttttgcatgacaaaatacagactggccttggacgttcggcctggggaccaggttggaaatcaaacgactgtggctgcaccatctgtcttcatcctcccgctatctgactcgtctctacnggagcggctggacaaggccganagtagnatgnnnnnnnnnnnnnnn

SEQ ID NO: 94961 - DNA, 257 bp, Homo sapiens
  misc_feature: GYAE6OF02GSTVU.21.71.G05.1.454.CMB.1.raw
  modified_base (248)..(257): a, c, t, g, unknown or other
  misc_feature (248)..(257): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgcaaaatacagactggccttggacgttcggcctggggaccaggttggaaatcaaacgaactgtggctgcaccatctgtcttcatcttcccgccatctgactcgtctctactgagcggctggcaaggcgcatagnnnnnnnnnn

SEQ ID NO: 94962 - DNA, 676 bp, Homo sapiens
  misc_feature: GYAE6OF02I2QST.21.71.G05.1.454.CMB.1.raw
  modified_base (172)..(172): a, c, t, g, unknown or other
  misc_feature (172)..(172): n is a, c, g, or t
tcagtcgtcgctcgcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtagtctgctttgctcngcgtcagggtgctgctaatgctctgggtcccagtgtccaggtgggaagttgtgatgactcagtcctccactcctccctgcccgtcgcccgtgacagcccggcctccatctcctgctaggtctagtcagagcgtcgtgtacgagtagaccggtaacacctacctactaacgtcgtttccaacgtacgacggccacgggacccaacctccgacggccgcccttaacgtttagtaacggttttacgtaacggtccgggtaacctcggtccggggtaccctaggactaagaactcgacggtccggttcgtttacgggtacctacgggtccttcttacgtacgtttaccgacaaccgttagaaaccgtacgtacgacgtacgggtaacggggtcgggtaacggttaccgtcgggtaacgtacgtttggttaccgggttactttaacggttttttattttacggtccgttaagttaaccgtaactaaacgttacggtaacggttacccgg

SEQ ID NO: 94963 - DNA, 259 bp, Homo sapiens
  misc_feature: GYAE6OF02H9WN8.21.71.G05.1.454.CMB.1.raw
  modified_base (248)..(259): a, c, t, g, unknown or other
  misc_feature (248)..(259): n is a, c, g, or t
tcagtcgtcgctcgcacgaccggtgctcgatttagtgtcgtcgcaagagagaggggtcaggctggaactgaggggcaggtggaggctgacgatgttggcatttattttgcatgcaaaatcagactggcttggacgttcggcctggggaccaggttggaaatcaaacgactgtggctgcaccatctgtcttcatccttcccgcatctgactcgtctctactggagcgggactggcaaggccgcagtagnnnnnnnnnnnn

SEQ ID NO: 94964 - DNA, 717 bp, Homo sapiens
  misc_feature: GYAE6OF02GKAN1.21.71.G05.1.454.CMB.1.raw
  modified_base (231)..(231): a, c, t, g, unknown or other
  misc_feature (231)..(231): n is a, c, g, or t
tcagtcgtcgctcgcacgaccggtgctcgatttagtgtcgtcgcaagagagaggggggcacttctccctctaacactctcccctgttgaagctctttgtgacgggcgagctcaggccctgatgggtgacttcgcaggcgtagactttgtgtttctcgtagtctgctttgctcagcgtcagggtgctgctaatgctctgggtcccagtcgtccaggtgggggtaaagtttgngattgactcagtcctccactcctccctcggccccgtcgtccccttggaccacgcccggacctccatcctcctgcaggttcctagtacgagacggcgttcgtagtacgagtcggtaaccggtaactaccctaccgtactaacgttcggtttccaccgtaggacggccgtaacggcccaaccgtaccggacggaccgtccctttaacgtttaacgtaacggttttacaacggtccgggtaacgtccggtcgggggtaccccacgtacgagtaactcggacggtcggttacggtttacgggaccgtagggttaccctttcgtacggtttatttacccgaagttaccgtacgtaaacctacgtacgtaacgggccggttacggggtaagggtaccggcgttacggaacggttaggttcggttacggttaactttcgttttttaagtttcgtacgttaacgtacgtaactaacgtacgtaagtaacccggg

SEQ ID NO: 94965 - DNA, 268 bp, Homo sapiens
  misc_feature: GYAE6OF02JA4WP.21.71.G05.1.454.CMB.1.raw
  modified_base (243)..(243): a, c, t, g, unknown or other
  misc_feature (243)..(243): n is a, c, g, or t
  modified_base (248)..(268): a, c, t, g, unknown or other
  misc_feature (248)..(268): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatcagactggccttggacgttcggcctggggaccaggttggaaatcaaacgaactgtggctgcaccatctgtcttcatccttcccgctatctgactcgtactctactgagcgggctggcaaggcnatagnnnnnnnnnnnnnnnnnnnnn

SEQ ID NO: 94966 - DNA, 257 bp, Homo sapiens
  misc_feature: GYAE6OF02IADL2.21.71.G05.1.454.CMB.1.raw
  modified_base (251)..(257): a, c, t, g, unknown or other
  misc_feature (251)..(257): n is a, c, g, or t
tcagtcgtcgctcgcacgaccggtgctcgatttagtgtcgtcgcaagagagagggggtcaggctggaactgaggggcaggtggaggctgacgatgttggcattttatttttgcatgcaaaatacagactggcctttggacgttcggcctggggaccaggttggaaatcaaacgaactgtggctgcaccatctgtcttcatcttcccgcatctgactcgtctctactgagcgggctgggcaaggcgcatagnnnnnnn

SEQ ID NO: 94967 - DNA, 863 bp, Homo sapiens
  misc_feature: GYAE6OF02G24GE.21.71.G05.1.454.CMB.1.raw
  modified_base (186)..(186): a, c, t, g, unknown or other
  misc_feature (186)..(186): n is a, c, g, or t
tcagtcgtcgctcgcacgaccggtgctcgatttagtgtcgtcgcaagagagagggggcacttctccctctaacactctcccctgttgaagctctttatgacgggcgagctcaggccctgatgggtgacttcgcaggcgtagtactttgtgtttctcgtagtctgtctttgctcagcgtcgagggtnctgctaatgctcgtgggtccagtcgtccgaggtggggtaagttgtgatgactcagtcctcctactcctcccgtcgcccgtcgtcccttggaccaggccgcctcactcctccgtcgctaggtctacgtcgaggtacgcggttcgtacgtacacggtacgaaccggtaacctaacccttacccgtacgtaaccgttacggtttaccaaccggtaacgggaccggacccgaaccgggtacccctaaaccccgttacccggaacccgggtaccccgtttaacccgttttaaaccgttttaaacggtttaaacggggtttttaaccctaaacgggggtacccgggttaacccgtttacccgggggtttaacccggggggttaacccccaaacgggtaacccgtaaacgggtaaacctaccgggtaacccgggttccgggttaccgggtttttacggggtacccgtaacggggtccttaaccgttaggtttaaccgttacccgaacctaaccggtaaccgaaacttagtaccgaacgggtaccggtaagggggtagggtacggaccgttacgggaacggttagggtttagggttcggtttaacgttttaagtttttacggttttaagaccgttacggttaaacgtaaacccgttaaaacggttaccggtaaggttaccccggg

SEQ ID NO: 94968 - DNA, 252 bp, Homo sapiens
  misc_feature: GYAE6OF02G4UVP.21.71.G05.1.454.CMB.1.raw
  modified_base (243)..(243): a, c, t, g, unknown or other
  misc_feature (243)..(243): n is a, c, g, or t
  modified_base (246)..(252): a, c, t, g, unknown or other
  misc_feature (246)..(252): n is a, c, g, or t
tcagtcgtcgctcgcacgaccggtgctcgatttagtgtcgtcgcaagagagagggggtcaggatggaactgaggggcaggtggaggctgacgatgttggcatttattttgcatgacaaaatacagactggccttggacgttcggcctggggaccaggttgaaatcaaacgactgtgctgcaccatctgtcttcactccttcccgcatcgtgacctcgcttctactgacgcggctggcaggcanatnnnnnnn

SEQ ID NO: 94969 - DNA, 300 bp, Homo sapiens
  misc_feature: GYAE6OF02IGYF6.21.71.G05.1.454.CMB.1.raw
  modified_base (198)..(198): a, c, t, g, unknown or other
  misc_feature (198)..(198): n is a, c, g, or t
  modified_base (265)..(265): a, c, t, g, unknown or other
  misc_feature (265)..(265): n is a, c, g, or t
  modified_base (271)..(300): a, c, t, g, unknown or other
  misc_feature (271)..(300): n is a, c, g, or t
tcagtcgtcgctcgcacgaccggtgctcgatttagtgtcgtcgcaagagagaggggtcaggctggaactgaggggcaggtggaggctgacgatgttggctatttatttttgcatgacaaaatacagactggaccttggacgtttcggcctggggaccaggttggaaatcaaacgaactgtgctgcaccatctgtcttnatccttccgcattctgacttcgtacttctacgtgacgtcgggctcggaccaagggcctacaagtagnctgcannnnnnnnnnnnnnnnnnnnnnnnnnnnnn

SEQ ID NO: 94970 - DNA, 657 bp, Homo sapiens
  misc_feature: GYAE6OF02JHJSP.21.71.G05.1.454.CMB.1.raw
  modified_base (280)..(280): a, c, t, g, unknown or other
  misc_feature (280)..(280): n is a, c, g, or t
  modified_base (287)..(287): a, c, t, g, unknown or other
  misc_feature (287)..(287): n is a, c, g, or t
  modified_base (454)..(454): a, c, t, g, unknown or other
  misc_feature (454)..(454): n is a, c, g, or t
  modified_base (473)..(473): a, c, t, g, unknown or other
  misc_feature (473)..(473): n is a, c, g, or t
tcagtcgtcgctcgcacgaccggtgctcgatttagtgtcgtcgcaagagagagggggcacttctccctctaacactctcccctgttgaagctctttgtgacgggcgagctcaggccctgatgggtgacttcgcaggcgtagactttgtgtttctcgtagtctgctttgctcagcgtcagggtgctgctaatgctcgtgggtcccagtgtccaggtggggaattgtgatgactcagtctccactcctccctgcccgtcgcccttggacagcccgcctaccnctctccngcgagtctagtcagacgtcgtgtagtacagtacggtaacggtaaccaccttacctaccgtaacgttggttaccaaccagacggtccacggtacccaaccctccgaccggccgtacctttaacgtttattaacggtttacacggccggtactcggtcgggtaccaganagtactagacggtccggtntttcgggacgagtcttcgttatactttcccaacgttcgtaacgtaacctacgtacggacgtacgggtaggggtacggtacggtacgtacgggtaagttacggtttgggttaaccggttcttttaacgttttttagtttcgacctttaggtacctaaacgtaaacggttactaacgggttaccgg

SEQ ID NO: 94971 - DNA, 349 bp, Homo sapiens
  misc_feature: GYAE6OF02GWRR7.21.71.G05.1.454.CMB.1.raw
  modified_base (197)..(197): a, c, t, g, unknown or other
  misc_feature (197)..(197): n is a, c, g, or t
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (284)..(349): a, c, t, g, unknown or other
  misc_feature (284)..(349): n is a, c, g, or t
tcagtcgtcgctcgcacgaccggtgctcgatttagtgtcgtcgcaagagagagggggtcaggctggaactgaggggcaggtggaggctgacgatgttggcatttatttttgcatgacaaaaatacagactggccttggacgttcggcctggggaccaggttggaaatcaaaacgactgtgctgcaccatctgtcttnacttccttcccgcctatctacgaccttccgttcctctaacgtggagtccgggctggacgaaggccacaagtagntgcagcancancnnnnnnnnnnnnnnnnnnnnnnnnnnnnnnnnnnnnnnnnnnnnnnnnnnnnnnnnnnnnnnnnnn

SEQ ID NO: 94972 - DNA, 274 bp, Homo sapiens
  misc_feature: GYAE6OF02HU0JT.21.71.G05.1.454.CMB.1.raw
  modified_base (251)..(251): a, c, t, g, unknown or other
  misc_feature (251)..(251): n is a, c, g, or t
  modified_base (257)..(274): a, c, t, g, unknown or other
  misc_feature (257)..(274): n is a, c, g, or t
tcagtcgtcgctcgcacgaccggtgctcgatttagtgtcgtcgcaagagagagggggtcaggctggaactgaggggcaggtggaggctgacgatgttggcatttattttgcatgcaaaatacagactggccttggacgttcggcctggggaccaggttggaaatcaaaacgaactgtggctgcaaccatctgtcttcattccttcccgccatctgactcgtctctactgacgcgggctcggacaaggccanagtagnnnnnnnnnnnnnnnnnn

SEQ ID NO: 94973 - DNA, 281 bp, Homo sapiens
  misc_feature: GYAE6OF02HVBWF.21.71.G05.1.454.CMB.1.raw
  modified_base (257)..(281): a, c, t, g, unknown or other
  misc_feature (257)..(281): n is a, c, g, or t
tcagtcgtcgctcgcacgaccggtgctcgatttagtgtcgtcgcaagagagagggggtcaggctggaactgaggggcaggtggaggctgacgatgttggcattatttttgcatgcaaatacagactggccttggacgttcggacctggggacctaggttaggaaatcgaaacgaactgtggctgcaccatctgtcttcgactccttccgcctatctcgtactcgtctctctgagcggctggacaggtcgactatagnnnnnnnnnnnnnnnnnnnnnnnnn

SEQ ID NO: 94974 - DNA, 712 bp, Homo sapiens
  misc_feature: GYAE6OF02F2IZ6.21.71.G05.1.454.CMB.1.raw
  modified_base (181)..(181): a, c, t, g, unknown or other
  misc_feature (181)..(181): n is a, c, g, or t
  modified_base (660)..(660): a, c, t, g, unknown or other
  misc_feature (660)..(660): n is a, c, g, or t
tcagtcgtcgctcgcacgaccggtgctcgatttagtgtcgtcgcaagagagagggggcacttctccctctaacactctcccctgttgaagctctttgtgacgggcgagctcaggccctgatgggtgacttcgcaggcgtagacttgtgttctcgtagtctgcttgctcagcgtcagggtcnctgtactaatcgctcgtcgggtcccagtcgtccgaggtcgggggtaagttgtagaacgttcggacctacgtagtcctacctaccgttcctacccgtcggtaccccgtccgcccgttggactaccggccggtcctccatccttccgtcgtacgtacggtcgttacgtcaacggcgtccgtggtactacgtaggtaccgtacggtaacctaccgtactacgtaaccgttcgtacctaccgaacggtccgacctaccggtaccctaccgtaccgacgggtacccttacccttaagttaacgttacgtaccgtaacgggtcggtaactcggtcggaccacgtacgtacgaagtcgacgtacggttcgttacggtactcggtacctgttaccgtattccgtaccacgttacctaacgtataccgttacgacggtacgggacgtagttacgtggtacggaccgtttgggtaccgtaaccgttttnttttaacggtccgtacgacgttaaccgtactaaacgttccgagttaacccgg

SEQ ID NO: 94975 - DNA, 479 bp, Homo sapiens
  misc_feature: GYAE6OF01D40L7.29.74.G08.1.454.CMB.1.raw
  modified_base (269)..(269): a, c, t, g, unknown or other
  misc_feature (269)..(269): n is a, c, g, or t
  modified_base (345)..(345): a, c, t, g, unknown or other
  misc_feature (345)..(345): n is a, c, g, or t
  modified_base (398)..(398): a, c, t, g, unknown or other
  misc_feature (398)..(398): n is a, c, g, or t
  modified_base (465)..(479): a, c, t, g, unknown or other
  misc_feature (465)..(479): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttacnctcactattagcagcctgcagcctgaagatattgcaacatattactgtacaaacaatatgatgaactgcctccganattcggcaagggccagggtggagtcagacgaatgtgctgccacatctgtcttnattcttccccgcattctagaacttctctaatcgtaggagccgggtctgggaccaagggcacagtagnnnnnnnnnnnnnnn

SEQ ID NO: 94976 - DNA, 458 bp, Homo sapiens
  misc_feature: GYAE6OF01BPVQQ.29.74.G08.1.454.CMB.1.raw
  modified_base (446)..(446): a, c, t, g, unknown or other
  misc_feature (446)..(446): n is a, c, g, or t
  modified_base (453)..(458): a, c, t, g, unknown or other
  misc_feature (453)..(458): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttactctcactattagcagcctgcagcctgaagatattgcaacatattactgtcaacaatatgatgaactgcctccgacattcggccaagggaccagggtgaggtcagacgaactgtggctgcaccatctgtcttcatccttcccgcatctgaagtctctatctgagcgggctggcaaggcncagtagnnnnnn

SEQ ID NO: 94977 - DNA, 466 bp, Homo sapiens
  misc_feature: GYAE6OF01AO0BT.29.74.G08.1.454.CMB.1.raw
  modified_base (382)..(382): a, c, t, g, unknown or other
  misc_feature (382)..(382): n is a, c, g, or t
  modified_base (448)..(448): a, c, t, g, unknown or other
  misc_feature (448)..(448): n is a, c, g, or t
  modified_base (455)..(466): a, c, t, g, unknown or other
  misc_feature (455)..(466): n is a, c, g, or t
tcagatagagtactcacgaccggtgctcgatttagtagctctatcagggtgctgctgaggctgtaggtgctgtccttgctgtcctgctctgtgacactctcctggggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttactctcactattagcagcctgcagcctgaagatattgcaacatattactgtcaacaatatgatgaactgcctccgacagttcggccaagggaccagggtggagtcagacgactgngctgcacatctgtcttcattccttcccgctatctgaagttctctatctgagcgggctggacaggcncagtagnnnnnnnnnnnn

SEQ ID NO: 94978 - DNA, 450 bp, Homo sapiens
  misc_feature: GYAE6OF01EIJCR.29.74.G08.1.454.CMB.1.raw
  modified_base (416)..(416): a, c, t, g, unknown or other
  misc_feature (416)..(416): n is a, c, g, or t
  modified_base (444)..(450): a, c, t, g, unknown or other
  misc_feature (444)..(450): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagccctaaactcctcatctacgatgtatccaatttggaacctgggtcccatcaagttcagtggaggcggaggtgggacagattttactctcactattagcagcctgcagcctgaagatattgcaacatattactgtcaacaatatgatgaactgcctcgacattcggccaagggaccagggtgaggtcagacgaactgtgctgcacatctgtctcatcttcccgcatctagaagtctntatctgagcggctggcaaggcgcatagnnnnnnn

SEQ ID NO: 94979 - DNA, 466 bp, Homo sapiens
  misc_feature: GYAE6OF01B5LJV.29.74.G08.1.454.CMB.1.raw
  modified_base (379)..(379): a, c, t, g, unknown or other
  misc_feature (379)..(379): n is a, c, g, or t
  modified_base (407)..(407): a, c, t, g, unknown or other
  misc_feature (407)..(407): n is a, c, g, or t
  modified_base (457)..(466): a, c, t, g, unknown or other
  misc_feature (457)..(466): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaagcccctaaactcctcatctacgatgtatccaatttggaacctggggtcccatcaaggttcagtggaggcggaggtgggacagattttactctcactattagcagcctgcagcctgaagatattgcaacatattactgtcaacaatatgatgaactgcctccgacattcggcaagggaccagggtggaggtcagacgactgnggctgcacatctgtcttcatcttcccgnatctgaactactctatctgacgcgggtctgggccaagggcgacatacggnnnnnnnnnn

SEQ ID NO: 94980 - DNA, 448 bp, Homo sapiens
  misc_feature: GYAE6OF01C8JSR.29.74.G08.1.454.CMB.1.raw
  modified_base (269)..(269): a, c, t, g, unknown or other
  misc_feature (269)..(269): n is a, c, g, or t
  modified_base (377)..(377): a, c, t, g, unknown or other
  misc_feature (377)..(377): n is a, c, g, or t
  modified_base (429)..(429): a, c, t, g, unknown or other
  misc_feature (429)..(429): n is a, c, g, or t
  modified_base (438)..(438): a, c, t, g, unknown or other
  misc_feature (438)..(438): n is a, c, g, or t
  modified_base (442)..(448): a, c, t, g, unknown or other
  misc_feature (442)..(448): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttacnctcactattagcagcctgcagcctgaagatattgcaacatattactgtacaacaatatgatgaactgcctcgacattcggcaagggccagggtgagtcagacgactgngctgcacatctgtctcatcttcccgctatctgaacgtctctatctgagcggntggcaggcnatgnnnnnnn

SEQ ID NO: 94981 - DNA, 600 bp, Homo sapiens
  misc_feature: GYAE6OF01DKAEZ.29.74.G08.1.454.CMB.1.raw
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (316)..(316): a, c, t, g, unknown or other
  misc_feature (316)..(316): n is a, c, g, or t
  modified_base (586)..(600): a, c, t, g, unknown or other
  misc_feature (586)..(600): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatattaaatgtatcagcagaaaccaggaaaacgccctaaactcctcatctacgatgtatccaatttggaacctgggtccatcaagttcagtggaggcggaggtggacagtattttacnctnactattagcagcctgcagcctagaagtatattgacaaactatatttactntacaaacaattaatgaactagaactggtaccctccggaactacgttccgggaccgtaaagggggaccctaagggggtaggaacgggtcaacggaacggaaacgtgggtagggtcctacggaccaacccctagttaccgttcggttcctttacctaacgtttccctttcccccggaccctaatttcccgtaggtaaaacgttaccttccttaacttcgtacggtaacgggtccggggcttagggacccgaaaggggcccgacgaattaggnnnnnnnnnnnnnnn

SEQ ID NO: 94982 - DNA, 464 bp, Homo sapiens
  misc_feature: GYAE6OF01DYUCV.29.74.G08.1.454.CMB.1.raw
  modified_base (267)..(267): a, c, t, g, unknown or other
  misc_feature (267)..(267): n is a, c, g, or t
  modified_base (401)..(401): a, c, t, g, unknown or other
  misc_feature (401)..(401): n is a, c, g, or t
  modified_base (454)..(464): a, c, t, g, unknown or other
  misc_feature (454)..(464): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagccctaaactcctcatctacgatgtatccaatttggaacctgggtcccatcaaggttcagtggaggcggaggtgggacagattttacnctcactattagcagcctgcagcctgaagatattgcaacatattactgtacaacaatatgatgaactgcctccgacattcggccaagggaccaggggtgaggtcagacgaactgtggctgcaccatctgtccttnatcctcccgcatctgaatactctatctgagcgggctggcaagggcgcataggnnnnnnnnnnn

SEQ ID NO: 94983 - DNA, 536 bp, Homo sapiens
  misc_feature: GYAE6OF01BJUMD.29.74.G08.1.454.CMB.1.raw
  modified_base (493)..(493): a, c, t, g, unknown or other
  misc_feature (493)..(493): n is a, c, g, or t
  modified_base (521)..(521): a, c, t, g, unknown or other
  misc_feature (521)..(521): n is a, c, g, or t
  modified_base (523)..(536): a, c, t, g, unknown or other
  misc_feature (523)..(536): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatacaaaacattaagagatatttaaattgtatcagcagaaaccaggaaaacgcccctaaactcctcatctacgatgtatccaatttggaacctggggtccatcaaggttcagtggaggcggaggtgggacagtattttactctcactattagcagcctgcagcctgaagatattgctaaacattattacgtgtacaaacaatatgatgaactgccctcgacattcggccaagggaccgagggtggaggtcagaacgaactggtggacctggaccacccgtagtctcggtctttccaagttccctttaccccggccctaatctttacgggaaacttaccttctaactcgttaggaacgccggggntacgggaccgaaaggccgataaataggngnnnnnnnnnnnnnn

SEQ ID NO: 94984 - DNA, 461 bp, Homo sapiens
  misc_feature: GYAE6OF01B7CS6.29.74.G08.1.454.CMB.1.raw
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
  modified_base (446)..(446): a, c, t, g, unknown or other
  misc_feature (446)..(446): n is a, c, g, or t
  modified_base (453)..(461): a, c, t, g, unknown or other
  misc_feature (453)..(461): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttacnctcactattagcagcctgcagcctgaagntattgcaacatattactgtcaacaatatgatgaactgcctcgacattcggccaagggaccagggtggaggtcagacgaactgtggctgcaccatctgtcttcattcttcccgcatctgaatctctatctgagcgggctggcaagggcncagtagnnnnnnnnn

SEQ ID NO: 94985 - DNA, 469 bp, Homo sapiens
  misc_feature: GYAE6OF01CAA9U.29.74.G08.1.454.CMB.1.raw
  modified_base (454)..(454): a, c, t, g, unknown or other
  misc_feature (454)..(454): n is a, c, g, or t
  modified_base (460)..(469): a, c, t, g, unknown or other
  misc_feature (460)..(469): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttactctcactattagcagcctgcagcctgaagatattgcaacatattactgtcaacaatatgatgaactgcctccgacattcggaccaagggaccagggtggaggtcagacgaactggtggctgcaccatctgtcttcattcctcccgcatctgaagtctctatcgtgacgcgggtctgggcaagggcnagtagnnnnnnnnnn

SEQ ID NO: 94986 - DNA, 451 bp, Homo sapiens
  misc_feature: GYAE6OF01ANF3C.29.74.G08.1.454.CMB.1.raw
  modified_base (421)..(421): a, c, t, g, unknown or other
  misc_feature (421)..(421): n is a, c, g, or t
  modified_base (442)..(442): a, c, t, g, unknown or other
  misc_feature (442)..(442): n is a, c, g, or t
  modified_base (446)..(451): a, c, t, g, unknown or other
  misc_feature (446)..(451): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttactctcactattagcagcctgcagcctgaagatattgcaacatattactgtcaacaatatgatgaactgcctccgacattcggccaagggaccagggtgaggtcagacgactgtggctgcaccatctgtctcatcctcccgcatctgaacgtctntatctgagcggctggcaggcnatgnnnnnn

SEQ ID NO: 94987 - DNA, 452 bp, Homo sapiens
  misc_feature: GYAE6OF01BBKKU.29.74.G08.1.454.CMB.1.raw
  modified_base (439)..(439): a, c, t, g, unknown or other
  misc_feature (439)..(439): n is a, c, g, or t
  modified_base (445)..(452): a, c, t, g, unknown or other
  misc_feature (445)..(452): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtgggacagattttactctcactattagcagcctgcagcctgaagatattgcaacatattactgtcaacaatatgatgaactgcctccgacattcggccaagggaccagggtgagtcagacgactgtggctgcaccatctgtcttcatcttcccgcatctgagtctctatctgagcggctggcaggcncatagnnnnnnnn

SEQ ID NO: 94988 - DNA, 492 bp, Homo sapiens
  misc_feature: GYAE6OF01AZB8N.29.74.G08.1.454.CMB.1.raw
  modified_base (427)..(427): a, c, t, g, unknown or other
  misc_feature (427)..(427): n is a, c, g, or t
  modified_base (481)..(492): a, c, t, g, unknown or other
  misc_feature (481)..(492): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaagcccctaaactcctcatctacgatgtatccaatttggaacctgggtcccatcaaggttcagtggaggcggaggtgggacagattttactctcactattagcagcctgcagcctgaagatattgacaacatattactgtacaaactaatatagatagaactgccctccgaactacgttcggaccaaaggggacccgaggggtggacggtcaagacgaactggtaggctggcaccatctgtcttcattccncccgctatctagaatctctatctggacgcgggctgggacaagggcgacagtagnnnnnnnnnnnn

SEQ ID NO: 94989 - DNA, 566 bp, Homo sapiens
  misc_feature: GYAE6OF01BK61B.29.74.G08.1.454.CMB.1.raw
  modified_base (542)..(542): a, c, t, g, unknown or other
  misc_feature (542)..(542): n is a, c, g, or t
  modified_base (546)..(546): a, c, t, g, unknown or other
  misc_feature (546)..(546): n is a, c, g, or t
  modified_base (550)..(550): a, c, t, g, unknown or other
  misc_feature (550)..(550): n is a, c, g, or t
  modified_base (552)..(553): a, c, t, g, unknown or other
  misc_feature (552)..(553): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (561)..(562): a, c, t, g, unknown or other
  misc_feature (561)..(562): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtggacagtattttactctacactattagcagcctgcagcctgaagatattgacaactatattactgtacaacaatatgatgaactgacctcgactattacgggaccaaggggaccaggggtggaaggtcaaggacgtaaacgtggtacggctaggacctaccgtaagttccgttagtaccctttacgaactttcccgtttaccccggcctaagttccgtaggtaaacgttacctcgttaatccgtagacgggtcgggtcctggaccgaacgggcctacgaagttacgggncgtnagtnannagtnananngngn

SEQ ID NO: 94990 - DNA, 458 bp, Homo sapiens
  misc_feature: GYAE6OF01ATZ2Z.29.74.G08.1.454.CMB.1.raw
  modified_base (426)..(426): a, c, t, g, unknown or other
  misc_feature (426)..(426): n is a, c, g, or t
  modified_base (443)..(443): a, c, t, g, unknown or other
  misc_feature (443)..(443): n is a, c, g, or t
  modified_base (449)..(458): a, c, t, g, unknown or other
  misc_feature (449)..(458): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttactctcactattagcagcctgcagcctgaagatattgcaacatattactgtcaaacaatatgatgaactgcctccgacattcggccaaggggaccagggtggaggtcagacgaactgtgctgcacatctgtcttcatctcccgcatctgaatctctatcngagcggctggcaaggcncatagnnnnnnnnnn

SEQ ID NO: 94991 - DNA, 526 bp, Homo sapiens
  misc_feature: GYAE6OF01EX5DS.29.74.G08.1.454.CMB.1.raw
  modified_base (281)..(281): a, c, t, g, unknown or other
  misc_feature (281)..(281): n is a, c, g, or t
  modified_base (515)..(526): a, c, t, g, unknown or other
  misc_feature (515)..(526): n is a, c, g, or t
tcagatagagtactcacgaccggtgctcgatttagtagctctatctaggggttggctgctcgaggctggtaggtgctgtcccttgctgtcctgctctgtgacactctccgtgggagtccacccgtcacttgtcaggctaatcaaaacattaagagatatttaaattggtatcagcagaaaccaggaaaacgcccctaaactcctcatctacgatgtatccaatttggaacctggggtcccatcaaggttcagtggaggcggaggtgggacagtattttacnctcactattagcagcctgcagcctgaagatattgacaactatattactgtacaaacatatgatgaactgcctccgactattccggaccgaagggaccgaggggtggaggtcagacgaacgtgtaggctgaccacgtatctgtcttcacttcccttccccgctatcgtagtaacgttacctcttactccgtgggacggtccggggtactcgggacgaacggccgacaagtggagnnnnnnnnnnnn

SEQ ID NO: 94992 - DNA, 623 bp, Homo sapiens
  misc_feature: GYAE6OF01CQXWL.29.74.G08.1.454.CMB.1.raw
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (613)..(613): a, c, t, g, unknown or other
  misc_feature (613)..(613): n is a, c, g, or t
  modified_base (615)..(623): a, c, t, g, unknown or other
  misc_feature (615)..(623): n is a, c, g, or t
tcagatagagtactcacgaccggtgctcgatttagtagctctatcagggtgctgctgaggctgtaggtgctgtccctgctgtcctgctctgtgacactctcctgggagtcaccctcacttgtcaggctaatcaaaacattaagagatatttaaattggtatcagcagaaaccaggaaagcccctaaactcctcatctacgatgtatccaatttggaacctggggtcccatcaaggttcagtggaggcgggaggtgggacagtattttactctacacttattagcagcctgcacgcctagaagatattgacaacattattactgtacaacaatatgatgaactcgccctaccgactacgttccgggaccgtaaaggggacccgtaagggggtggacgggttacaagggaccgtaacgtgggtagggccttaggccaaccccgtatttccgtggttacccttttccgaactttcccgtttcccccgacccttaacttccgttaaggtaaaccgtttacctttaccttaacgttcccgttaggggaaccgggtccgggggttaccgttacgggggaccaaacgggggtcccgaccgtaaagttacggctgngngcngnnnnnnnnn

SEQ ID NO: 94993 - DNA, 683 bp, Homo sapiens
  misc_feature: GYAE6OF01D8VKC.29.74.G08.1.454.CMB.1.raw
  modified_base (678)..(678): a, c, t, g, unknown or other
  misc_feature (678)..(678): n is a, c, g, or t
  modified_base (680)..(680): a, c, t, g, unknown or other
  misc_feature (680)..(680): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaacgcccctaaactcctcatctacgatgtatccaatttggaacctgggtcccatcaaggttcagtggaggcggaggtgggacagtattttactctcactattagcagcctgcagcctagaagatattgacaactatatttactgtacaactaatatagatagaactcgccctaccgactacgttccggaccgaaggggaccgaggggtacggaagggtacgaacggtaaccgtaacgttgggtacgggaccgttacggaccctaacccgtattccgttaggttaccctttaccgtaaccgtttccccgttaccccccggtacccttaagtttcccgtttaacgggtaaaaccgttttacccttaccgtttaacgtttaccggttacggggtaaccgggttcccggggggtaccctttagggggggaacccctaaaggggggtaccccgtaacgtaacggttaagggacttcggtagacgtcgacgacgacgtcgcgagcgngngcg

SEQ ID NO: 94994 - DNA, 559 bp, Homo sapiens
  misc_feature: GYAE6OF01BRXPW.29.74.G08.1.454.CMB.1.raw
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
  modified_base (538)..(538): a, c, t, g, unknown or other
  misc_feature (538)..(538): n is a, c, g, or t
  modified_base (544)..(544): a, c, t, g, unknown or other
  misc_feature (544)..(544): n is a, c, g, or t
  modified_base (546)..(559): a, c, t, g, unknown or other
  misc_feature (546)..(559): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaacaggaaacgcccctaaactcctcatctacgatgtatccaattcggaacctgggtcccatcaaggttcagtggaggcggaggtgggacagtattttactctactactattagcacgcctgcacgcctaggaanatattcgactaacatattactgtacaactaatagtagatanaactcgaccctacgactagttaccggacgaacgggacctaggggtaggaggtacgaggacgacgtcggtggtactcggacctaaccgattcgttacgtctttccacttcccttaccccgctattccgtaagtaaccgtacttcgtaattcgtacgggacgtccggggtacttacgggaccgtaagggcccgtaanagtagngnnnnnnnnnnnnnn

SEQ ID NO: 94995 - DNA, 568 bp, Homo sapiens
  misc_feature: GYAE6OF01DH9M5.29.74.G08.1.454.CMB.1.raw
  modified_base (268)..(268): a, c, t, g, unknown or other
  misc_feature (268)..(268): n is a, c, g, or t
  modified_base (554)..(554): a, c, t, g, unknown or other
  misc_feature (554)..(554): n is a, c, g, or t
  modified_base (556)..(560): a, c, t, g, unknown or other
  misc_feature (556)..(560): n is a, c, g, or t
  modified_base (562)..(568): a, c, t, g, unknown or other
  misc_feature (562)..(568): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattgtatcagcagaaaccaggaaaacgccctaaactcctcatctacgatgtatccaatttggaacctgggtcccatcaaggttcagtggaggcggaggtgggacagtattttacnctcactattagcagcctgcagcctagaagtatattgacaacatattactgtacaaactaatatagatagaactcgaccctaccgactacgttcgggaccgaaaggggaccaggggtggacggtcgaaggacgaacgttgggtaggccgtggacccaccgtattccgttgttaccttcctacttcccgtttacccccgactacgttccgtagtaaacgttacttctaacgtccgtaggacggccggggcttacgggaccgaacgggtccgtacgaagttaggctagngnnnnngnnnnnnn

SEQ ID NO: 94996 - DNA, 460 bp, Homo sapiens
  misc_feature: GYAE6OF01D2BK4.29.74.G08.1.454.CMB.1.raw
  modified_base (432)..(432): a, c, t, g, unknown or other
  misc_feature (432)..(432): n is a, c, g, or t
  modified_base (442)..(442): a, c, t, g, unknown or other
  misc_feature (442)..(442): n is a, c, g, or t
  modified_base (452)..(452): a, c, t, g, unknown or other
  misc_feature (452)..(452): n is a, c, g, or t
  modified_base (456)..(460): a, c, t, g, unknown or other
  misc_feature (456)..(460): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtgggacagattttactctcactattagcagcctgcagcctgaagatattgcaacatattactgtacaacaatatgatgaactgcctccgacattcggccaagggaccagggtggaggtcagacgaactggtgctgccacatctgtctcacttctcccgctatctagaagttctctatcgnggagccgggntggcaaggcnatgnnnnn

SEQ ID NO: 94997 - DNA, 609 bp, Homo sapiens
  misc_feature: GYAE6OF01B2PP8.29.74.G08.1.454.CMB.1.raw
  modified_base (321)..(321): a, c, t, g, unknown or other
  misc_feature (321)..(321): n is a, c, g, or t
  modified_base (587)..(587): a, c, t, g, unknown or other
  misc_feature (587)..(587): n is a, c, g, or t
  modified_base (594)..(594): a, c, t, g, unknown or other
  misc_feature (594)..(594): n is a, c, g, or t
  modified_base (598)..(598): a, c, t, g, unknown or other
  misc_feature (598)..(598): n is a, c, g, or t
  modified_base (601)..(601): a, c, t, g, unknown or other
  misc_feature (601)..(601): n is a, c, g, or t
  modified_base (606)..(606): a, c, t, g, unknown or other
  misc_feature (606)..(606): n is a, c, g, or t
tcagatagagtactcacgaccggtgctcgatttagtagctctatcagggtaggctgctgagggctcgtaggtcgcgtgttccttggcttgtccttgctctgtggacactctcctgggagtcaccctcacttgttcgaggctaatcaaaacattaagtagtatattttaaatttagggtatcagcagaaaccgaggaaaacgcccttaaactcctcatcgtacgatgtatccaagtttcggaacctgggtccatcaaggttcagtggaggcggaggtggacagtattttactctcactattagcagcctgcagcctggaagntagtgcacatattactgtcaagatatgatgaactgccctccgactacgttccggacccaaggggacccgaggggtcggacggttcacggacgaacgtggtacggacttgccgtacccagttaccgttggttacctttctactttccttaccccggcctaacgttcctagtaacggttacttcgttaacgtccgttacgggaaccgggtccgggtacgttcgggtaccgaaacggggtccgaccgtaaaggttaccggatcgagtcncgtccgnctcnctntctgngcg

SEQ ID NO: 94998 - DNA, 675 bp, Homo sapiens
  misc_feature: GYAE6OF01CK9FH.29.74.G08.1.454.CMB.1.raw
  modified_base (272)..(272): a, c, t, g, unknown or other
  misc_feature (272)..(272): n is a, c, g, or t
  modified_base (660)..(660): a, c, t, g, unknown or other
  misc_feature (660)..(660): n is a, c, g, or t
  modified_base (664)..(675): a, c, t, g, unknown or other
  misc_feature (664)..(675): n is a, c, g, or t
tcagatagagtactcacgaccggtgctcgatttagtagctctatcagggtgctgctgaggctgtaggtgctgtccttgctgtcctgctctgtgacactctcctggggagtcaccctcacttgtcaggctaatcaaaacattaagagatatttaaatggtatcagcagaaaccaggaaaacgacccctaaactcctcatctacgatgtatccaatttggaacctgggtccatcaaggttcaggtggaggcggagggtgggacagtattttacnctacactattagcagcctgcagcctagaagtatattgacaactattacttactgtacaaactaatatagaatagaactcgaccctaccgaactaacgttccgggaaccgaaacggggtacccgagggggttacggaacgggtaccgaacgggtaaccggtaacgttagggttacgggaccgttacggaccctaaccccgtaacgtttccggttacgtttacctttacccgtaaccgtttccccgtttacccccggacccttacgtttacccgttaacggtaaaccgtttaccctttaccttaaacggttccggttaacgggaccggggtaccgggggttacccttacgggggacccgaaacggggtcccgtaaccgtaacgttaggcngagnnnnnnnnnnnn

SEQ ID NO: 94999 - DNA, 509 bp, Homo sapiens
  misc_feature: GYAE6OF01C42UX.29.74.G08.1.454.CMB.1.raw
  modified_base (329)..(329): a, c, t, g, unknown or other
  misc_feature (329)..(329): n is a, c, g, or t
  modified_base (496)..(509): a, c, t, g, unknown or other
  misc_feature (496)..(509): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttactctcactattagcagcctgcagcctagagatatgacaactatattactgtacaacaatatnatagaactcgccctccgactacgttccggaccgaaggggaccgaggggtggaggtcgaagacgaactggtcggctgaccaccattctgtccttcacttcccttcccgctattcagtaacgttctctatcgtggacggccgggtctcgggacaaggccgacagtagcnnnnnnnnnnnnnn

SEQ ID NO: 95000 - DNA, 556 bp, Homo sapiens
  misc_feature: GYAE6OF01EDXZB.29.74.G08.1.454.CMB.1.raw
  modified_base (275)..(275): a, c, t, g, unknown or other
  misc_feature (275)..(275): n is a, c, g, or t
  modified_base (536)..(536): a, c, t, g, unknown or other
  misc_feature (536)..(536): n is a, c, g, or t
  modified_base (538)..(539): a, c, t, g, unknown or other
  misc_feature (538)..(539): n is a, c, g, or t
  modified_base (542)..(544): a, c, t, g, unknown or other
  misc_feature (542)..(544): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (554)..(556): a, c, t, g, unknown or other
  misc_feature (554)..(556): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaaacattaagagtattatttaaattggttatcagcaagaaaccaggaaaagcccctaaactcctcatctacgatgtatccaatttcggaacctgggtccatcaaggttcagtggaggcggaggtgggacagtacttttacnctacactattagctagcctgcagcctgaagtatattgcaagtattattactgtacaaactataatgaactagaactcgaccgtaccgaactacgttccgggaccgaaaggggtaccagggggtcggaacggtcgaaggtaaccgtaacgtggtacggctacgaccacctaatctgtacccttcaacttcctcccgactatctaagaactactcgtactctagggacggcgggtctacgggacgaacggcgaacttacgagngnnagnnncncncntctnnn

SEQ ID NO: 95001 - DNA, 685 bp, Homo sapiens
  misc_feature: GYAE6OF01DCXMY.29.74.G08.1.454.CMB.1.raw
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaatggtatcagcagaaaccaggaaaagcccctaaactcctcatctacgatgtatccaattggaacctgggtccatcaaggttcagtggaggcggaggtgggacagtattttactctcactattagcagcctgcagcctagaagtatattgacaactatattactagtacaaacaaatatagattagaaaccttgaccctaccgactaacgttccggaccgaaacggggtacccgaggggtcggaacggtaccgaaggtaaccgaacgttggtcgggaccttggaccaacccgtattccgtacggttcctttccgaacgtttccccgttacccccgacccttaagtttacccgtaagggtaaaaccgtttaccgttaccgttaaccgttccggtttaaggggaaccgggttcccggggggttacccttacggggggaacccaaacgggggtaccctaaccgtaaaacgtttagggccttacgaagtaccggtacgtacgtacgtacgtacgtacgtacgtacgtcgtacgtacg

SEQ ID NO: 95002 - DNA, 614 bp, Homo sapiens
  misc_feature: GYAE6OF01EH54S.29.74.G08.1.454.CMB.1.raw
  modified_base (315)..(315): a, c, t, g, unknown or other
  misc_feature (315)..(315): n is a, c, g, or t
  modified_base (528)..(528): a, c, t, g, unknown or other
  misc_feature (528)..(528): n is a, c, g, or t
  modified_base (553)..(553): a, c, t, g, unknown or other
  misc_feature (553)..(553): n is a, c, g, or t
  modified_base (589)..(589): a, c, t, g, unknown or other
  misc_feature (589)..(589): n is a, c, g, or t
  modified_base (594)..(594): a, c, t, g, unknown or other
  misc_feature (594)..(594): n is a, c, g, or t
  modified_base (599)..(599): a, c, t, g, unknown or other
  misc_feature (599)..(599): n is a, c, g, or t
  modified_base (602)..(602): a, c, t, g, unknown or other
  misc_feature (602)..(602): n is a, c, g, or t
  modified_base (606)..(606): a, c, t, g, unknown or other
  misc_feature (606)..(606): n is a, c, g, or t
  modified_base (610)..(610): a, c, t, g, unknown or other
  misc_feature (610)..(610): n is a, c, g, or t
tcagatagagtactcacgaccggtgctcgatttagtagctctatcagggtgggctcgctgaggtctgtaggtgctgtccttgctgtcctgctctgtgacactctcctgggagttcgaccctcacttgtcgtaggtcttaatactaaaaactaagttaagagtattagtttaaagttgggtatcgagcaagaaaccgaagggtaaacgcccctaaactccgtcgacggtcctaagatgtactcctaatttcggaacctgggtcccaactcgtaaggttcaggtcggaggcggaggtcggacaggtacgttttaccnctactacttacgtaaggccgacgtccgttggcgtacggtcctaggaaacgtaattaacgttcgactaaacgtattaattacctgttacaaactaatagtgtaagtacgaaacgtcgacctacgactacgttccggaccaaggggacaggggtgacggtacaacgaacgtacgtgtacgactagaccactatcgtagtctctactccgtcccgntatctagtactcttgtactcgtagnggtcggacttgggacgtagggctcgtagtacgctgngcgancgtgngtnacgntcgntgcg

SEQ ID NO: 95003 - DNA, 486 bp, Homo sapiens
  misc_feature: GYAE6OF01CHO12.29.74.G08.1.454.CMB.1.raw
  modified_base (269)..(269): a, c, t, g, unknown or other
  misc_feature (269)..(269): n is a, c, g, or t
  modified_base (476)..(486): a, c, t, g, unknown or other
  misc_feature (476)..(486): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtgggacagtattttacnctcactattagcagcctgcagcctgaagatattgcaacatattactgtacaacaatatgatgaactgcctaccgacagttccggccaaaggggacccaggggtggaaggtcaaggacgaacgtggtggcctgaccaccatctgtcttcattccttccccgcatctgaattctctaatctggagcgggctgggcaagggcacataggnnnnnnnnnnn

SEQ ID NO: 95004 - DNA, 600 bp, Homo sapiens
  misc_feature: GYAE6OF01BR91N.29.74.G08.1.454.CMB.1.raw
  modified_base (282)..(282): a, c, t, g, unknown or other
  misc_feature (282)..(282): n is a, c, g, or t
  modified_base (588)..(600): a, c, t, g, unknown or other
  misc_feature (588)..(600): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatacaaaacattaagagattaatttaaattggtatcagacaagaaaccaaggaaaacgacccctaaactcctacatctacgatgtatacctaatttggaacctcgggtaccatacaaggttcaggtggaggcggaggtggacagtattttacnctacactatagcagcctgctacgccgtagaagtatagttgacaactatattactagtacaaacaatatgatagaactcgacctaccgaactacgttaccggaccgaaacgggggaccagggggttacggaacggtaccgaaggtaaccggtaacgttgggtacggtcgttacggacctaaccccgtagttccgtcgttctttaccgacctttacccttacccccggactacgtccttaagttaaaccgttcttacttacgttcgtagggaccgggacgggtctacgggacgaacggcgactatagnnnnnnnnnnnnn

SEQ ID NO: 95005 - DNA, 498 bp, Homo sapiens
  misc_feature: GYAE6OF01D32O2.29.74.G08.1.454.CMB.1.raw
  modified_base (464)..(464): a, c, t, g, unknown or other
  misc_feature (464)..(464): n is a, c, g, or t
  modified_base (484)..(498): a, c, t, g, unknown or other
  misc_feature (484)..(498): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtgggacagtattttactctcactattagcagcctgcagcctgaagatattgacaacatattactgtacaacaatatgatgaactgcctccgactagttccggaccgaaggggaccaggggtggaaggtcaggacgaacgtgtggctgcaccatctgtcttcacttcccttcccgccattcgtagtaacgtactcttatcgtggagtccgggntgggacgaaggcgacagtgnnnnnnnnnnnnnnn

SEQ ID NO: 95006 - DNA, 470 bp, Homo sapiens
  misc_feature: GYAE6OF01C6AP2.29.74.G08.1.454.CMB.1.raw
  modified_base (269)..(269): a, c, t, g, unknown or other
  misc_feature (269)..(269): n is a, c, g, or t
  modified_base (328)..(328): a, c, t, g, unknown or other
  misc_feature (328)..(328): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (454)..(454): a, c, t, g, unknown or other
  misc_feature (454)..(454): n is a, c, g, or t
  modified_base (460)..(470): a, c, t, g, unknown or other
  misc_feature (460)..(470): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttacnctcactattagcagcctgcagcctgaagatattgacaacatattactgtacaacaatangatgaaactgcctccgacattcggaccaaggggaccgagggtggaggtcagacgaactgtggctgcaccatctgtctcatcctcccgcatcngaatacnctatctgagcgggctgggcaaggcganagtagnnnnnnnnnnn

SEQ ID NO: 95007 - DNA, 475 bp, Homo sapiens
  misc_feature: GYAE6OF01CCK4O.29.74.G08.1.454.CMB.1.raw
  modified_base (297)..(297): a, c, t, g, unknown or other
  misc_feature (297)..(297): n is a, c, g, or t
  modified_base (467)..(475): a, c, t, g, unknown or other
  misc_feature (467)..(475): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtgggacagattttactctcactattagcagcctgcagcctgaagntattgcaacatattactgtacaacaatatgatgaactgccctccgactattcggaccaaggggaccaggggtggaggtcagacgaactgtggctgcacatctgtcttcattccttcccgctatctagaacgttctctatctggagccgggtctggacaaggcacagtagnnnnnnnnn

SEQ ID NO: 95008 - DNA, 585 bp, Homo sapiens
  misc_feature: GYAE6OF01C7ZFK.29.74.G08.1.454.CMB.1.raw
  modified_base (264)..(264): a, c, t, g, unknown or other
  misc_feature (264)..(264): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaacattaagagatatttaaatggtatcagcagaaaccaggaaaacgccctaaactcctcatctacgatgtatccaatttggaacctgggtcccatcaagttcagtggaggcgaggtgggacagattttacntcactattagctagcctgctagcctgaagatattgacaacatattactgtacaactaatatcgatgaactgaccctccgactagttccggaccgaaaggggacccaggggtcggaggtccaaggacgaacgtgtaggctgcgaccatctgtcttcacttcctcccgcgaacttcgtagaacgttactcgttaacgtcgttcgaacggtccgggggtacttacgggaccgaaaacggggtcccgtaaccgtaacgttaaaccgggtccgtaccgtacgtacgtacgtacgtacgtacgtacgtacacgtacgtcgtcgtacg

SEQ ID NO: 95009 - DNA, 483 bp, Homo sapiens
  misc_feature: GYAE6OF01ATAMX.29.74.G08.1.454.CMB.1.raw
  modified_base (343)..(343): a, c, t, g, unknown or other
  misc_feature (343)..(343): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (469)..(483): a, c, t, g, unknown or other
  misc_feature (469)..(483): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtgggacagattttactctcactattagcagcctgcagcctgaagatattgcaacatattactgtacaacaatatgatgaactgcctccganttcggcaagggccagggtgagtcagacgactgngntgcacatctgtcttcattcctccccgctatcgtagaacgttactcgtactcgtggacgccggggtctcgggacaacgggccgacagttagnnnnnnnnnnnnnnn

SEQ ID NO: 95010 - DNA, 529 bp, Homo sapiens
  misc_feature: GYAE6OF01EMH6L.29.74.G08.1.454.CMB.1.raw
  modified_base (518)..(521): a, c, t, g, unknown or other
  misc_feature (518)..(521): n is a, c, g, or t
  modified_base (523)..(529): a, c, t, g, unknown or other
  misc_feature (523)..(529): n is a, c, g, or t
tcagatagagtactcacgaccggtgctcgatttagtagctctatcagggtgctgctgaggctgtaggtgctgtccttgctgtcctgctctgtgacactctccctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtggacagtattttactctacactattagcagcctgcagcctagaagatatgacaactatattactgtacaactaatatgatgaactgccctccgactagttccggaccgaaggggacccgaggggtggacggtcaggacgtaactggtacggctggaccacatcgtgtacttcacttcccttaccccgctattccgtagtaacgtttacctcttatccgtaggacggccgggtctgggaccaagggccgactagtaggctgagtnnnnannnnnnn

SEQ ID NO: 95011 - DNA, 544 bp, Homo sapiens
  misc_feature: GYAE6OF01E4GW9.29.74.G08.1.454.CMB.1.raw
  modified_base (532)..(544): a, c, t, g, unknown or other
  misc_feature (532)..(544): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagataatttaaattggtatcagcaagaaaccaaggaaaacgcccctaaactcctcatctacgatgtatccaatttggaacctgggtcccatcaaggttcagtggaggcggaggtgggacagtattttactctcactatagcagcctgcagcctagaagatattgacaaactattaattactgtacaaactaatatgatagaactcgccctaccgactagttccggaccgaaaggggaccgaggggtggacggtcgaaggaacgtaacgtggtggcctagacctaccctattccgttgttccttactacttcccttcccccgactacttcgtagaacgttactctaatcgtaggacggtccggggctacgggacaagggccacaagtagnnnnnnnnnnnnn

SEQ ID NO: 95012 - DNA, 594 bp, Homo sapiens
  misc_feature: GYAE6OF01C9XAL.29.74.G08.1.454.CMB.1.raw
  modified_base (274)..(274): a, c, t, g, unknown or other
  misc_feature (274)..(274): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (584)..(585): a, c, t, g, unknown or other
  misc_feature (584)..(585): n is a, c, g, or t
  modified_base (587)..(588): a, c, t, g, unknown or other
  misc_feature (587)..(588): n is a, c, g, or t
  modified_base (590)..(594): a, c, t, g, unknown or other
  misc_feature (590)..(594): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatacaaaacattaagagatatttaaattggtatcagcaagaaaccaggaaaacgacccctaaactcctacatctacgatgtatccaatttggaacctggggtcccatacaggttcagtggaggcggaggtgggacagtatttacnctacactattagcagcctgcagacctagaagtattatagacaactataattactagtacaaacaatatagatagaactcgaccctccgaactacgttaccgggacgtaaacggggtaccgagggggtacggacggtacgaacggtacgaacgtaggtcggacgtcgacaactaacgttcgtacgttacttcctaacgttcccgttaccccgactacttaccgtacggtaaacgttaccttaccttacgtacggtaggtacggtcccgggtgtaaccgggacgaacgggccgactaagtaggacntngnannannannnnn

SEQ ID NO: 95013 - DNA, 614 bp, Homo sapiens
  misc_feature: GYAE6OF01B7TG4.29.74.G08.1.454.CMB.1.raw
  modified_base (270)..(270): a, c, t, g, unknown or other
  misc_feature (270)..(270): n is a, c, g, or t
  modified_base (594)..(594): a, c, t, g, unknown or other
  misc_feature (594)..(594): n is a, c, g, or t
  modified_base (600)..(603): a, c, t, g, unknown or other
  misc_feature (600)..(603): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (612)..(614): a, c, t, g, unknown or other
  misc_feature (612)..(614): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagtattttacnctcactattagcagcctgcagcctagaagtatattgacaactatattactgtacaaactaatatagatagaaactgaccctaccgaactacgttccggaccgaaacggggtacccgaagggggttaggaacgggttaccgaaggaacccggaacgttgggtacgggcttacggacctaacccgaattccgttacggttacttttacccgaactttcccgttccccccggactaactttccgtaagtaaaccggttaccttcgttaattccggtaggacggtaccggggctacgggtacaaaggggtccgaccttaagtaaggcngtatannnngtnanancnnn

SEQ ID NO: 95014 - DNA, 546 bp, Homo sapiens
  misc_feature: GYAE6OF01EQDYW.29.74.G08.1.454.CMB.1.raw
  modified_base (530)..(531): a, c, t, g, unknown or other
  misc_feature (530)..(531): n is a, c, g, or t
  modified_base (533)..(546): a, c, t, g, unknown or other
  misc_feature (533)..(546): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagtattttactctcactattagcagcctgcagcctagaagtatatgacaacattattactgtacaaactaatatagatagaactgccctccgactagttccgggaccaaacggggacccgaggggtgggaaggtacgaaggaacgaacgttggtcggcttcggccaacccgtattccgttgtcctttcctacttcccctttccccgactactcgttagaacgttacgtcgtggacggccggggtctcgggacaagggcccgatagtagcgnngnnnnnnnnnnnnnn

SEQ ID NO: 95015 - DNA, 528 bp, Homo sapiens
  misc_feature: GYAE6OF01APKAG.29.74.G08.1.454.CMB.1.raw
  modified_base (306)..(306): a, c, t, g, unknown or other
  misc_feature (306)..(306): n is a, c, g, or t
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
  modified_base (510)..(510): a, c, t, g, unknown or other
  misc_feature (510)..(510): n is a, c, g, or t
  modified_base (514)..(528): a, c, t, g, unknown or other
  misc_feature (514)..(528): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagattatttaaattggtatcagcaagaaaccaggaaacgcccctaaactcctcatctacgatgtatccaatttggaacctggggtcccatcgaaggttcaggtggaggcggaggtgggacagtattttactctcacttattagcagcctgcacgccgtagaanattatgacaacattattactgtacaactaatactnatgaactcnctcgacgtagtccggacgaacgggaccgtaggggtaggaggtacaaggacgtaacgtgtcggctacgccgacctagttccgtgttccttactacgtcctttccccgactacgtctagtacgtactcttagtcctaggacgcgggtctgggaccaggccantagnnnnnnnnnnnnnnn

SEQ ID NO: 95016 - DNA, 592 bp, Homo sapiens
  misc_feature: GYAE6OF01B0138.29.74.G08.1.454.CMB.1.raw
  modified_base (284)..(284): a, c, t, g, unknown or other
  misc_feature (284)..(284): n is a, c, g, or t
  modified_base (325)..(325): a, c, t, g, unknown or other
  misc_feature (325)..(325): n is a, c, g, or t
  modified_base (578)..(578): a, c, t, g, unknown or other
  misc_feature (578)..(578): n is a, c, g, or t
  modified_base (580)..(592): a, c, t, g, unknown or other
  misc_feature (580)..(592): n is a, c, g, or t
tcagatagagtactcacgaccggtgctcgatttagtagctctatcagggtgctgctgaggctgtaggtgctgtccttgctgtcctgctctgtgacactctcctggggatcaccctcacttgtcaggctaatcaaaacattaagagattaatttaaattggtatcagacaagaaaccaaggaaaacgacccctaaactcctcatctacgatgtataccaatttggaaccgtgggtccatcaaggttcaggtgggaggcggagggtgggacagtattttactctanactattagcacgcctagcacgacctagaaagtattacgttnaccaaatattaattactagtacaaacaatatgatagaactgaccctacgaactacgtacggaccgaaacggggaccgaggggtggaggtacgaaggtaacgtaacgtggtacggctacgacctaacctatcgttcgttcttacctacgttcccttacccccgacttaacgtccttaaggaaacgtttcctactaacgtccgtagggtaacgggtccgggtacgtacgggaccgaaaggggcctaacacgtagngnnnnnnnnnnnnn

SEQ ID NO: 95017 - DNA, 681 bp, Homo sapiens
  misc_feature: GYAE6OF01DITTD.29.74.G08.1.454.CMB.1.raw
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
  modified_base (670)..(670): a, c, t, g, unknown or other
  misc_feature (670)..(670): n is a, c, g, or t
  modified_base (672)..(675): a, c, t, g, unknown or other
  misc_feature (672)..(675): n is a, c, g, or t
  modified_base (677)..(681): a, c, t, g, unknown or other
  misc_feature (677)..(681): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaacgcccctaaactcctcatctacgatgtatccaatttggaacctgggtcccatcaaggttcaggtgggaggcggaggtgggacagtattttactctcacttattagcagcctgcagcctagaagattattgacaatattattactgtacaaacaatatgatagaactcgaccctaccgacgtacgttccggacccgaaacggggtacccgaagggggttacgggaacggtacgaagggaaccggaaacgttgggtacgggtccttacggaccctaaccccgtacgtttccgttacggtttaccttttaccctaacgtttccccccgttttaccccccggacccgttaaccgttttcccgttaacgggttaaaccgttttaacccgtttaccttttacgttaccccgggttgggtaacccgggggtcccggggtacgtttaccgggggaccgttaaacgggggccccgtaaccgtaagttacggcgtntngcncnnnncnnnnn

SEQ ID NO: 95018 - DNA, 600 bp, Homo sapiens
  misc_feature: GYAE6OF01AV39Q.29.74.G08.1.454.CMB.1.raw
  modified_base (276)..(276): a, c, t, g, unknown or other
  misc_feature (276)..(276): n is a, c, g, or t
  modified_base (580)..(580): a, c, t, g, unknown or other
  misc_feature (580)..(580): n is a, c, g, or t
  modified_base (588)..(588): a, c, t, g, unknown or other
  misc_feature (588)..(588): n is a, c, g, or t
  modified_base (591)..(592): a, c, t, g, unknown or other
  misc_feature (591)..(592): n is a, c, g, or t
  modified_base (594)..(594): a, c, t, g, unknown or other
  misc_feature (594)..(594): n is a, c, g, or t
  modified_base (596)..(600): a, c, t, g, unknown or other
  misc_feature (596)..(600): n is a, c, g, or t
tcagatagagtactcacgaccggtgctcgatttagtagctctatcagggtggctgctgaggctgtaggtgctgtccttgctgtcctgctctgtgacactctcctgggatcacctcacttgtcaggcctaatcaaaacattaagagataatttaaattggtatcagcagaaaccaggaaagccctaaactcctcatctacgatgtatcctaatttcggaacctggggtacccagtacaaggttcgagtggaggcggagggtgggacagtattttacnctcactattagcagcctgcagcctgaagactattgacaacagttattactgtacaaactaatatagatcgaactcgaccgtccgtaactacgttccggaccgaaacggggaccgaggggtacggtaggtaccgacggtaacggtaacgtggttacggaccgttccgaccctaaaccctagttcccgttacgtttaccttacctaacgtttccccttccccggaactagttccgtaaggaactttcccgtactacgtcgtagggcggtccgggacgttagggaccgtaacggctacgaacgtggntcgatcgntanntncnnnnn

SEQ ID NO: 95019 - DNA, 495 bp, Homo sapiens
  misc_feature: GYAE6OF01ALLRA.29.74.G08.1.454.CMB.1.raw
  modified_base (347)..(347): a, c, t, g, unknown or other
  misc_feature (347)..(347): n is a, c, g, or t
  modified_base (480)..(480): a, c, t, g, unknown or other
  misc_feature (480)..(480): n is a, c, g, or t
  modified_base (486)..(495): a, c, t, g, unknown or other
  misc_feature (486)..(495): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttactctcactattagcagcctgcagcctgaagatattgcaacatattactgtacaacaatatagatgaactgccctccgacnttccggcgaagggaccagggtggaggtcagacgactggtcggctggccacattctcgttcttcacttcccttccccgcctatcctaggaacgttaccttctaatccgtggacgtccgggctgggacaagggcncagtgnnnnnnnnnn

SEQ ID NO: 95020 - DNA, 743 bp, Homo sapiens
  misc_feature: GYAE6OF01CCBVX.29.74.G08.1.454.CMB.1.raw
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcaagaaaccaggaaaacgacccctaaactcctcatctacgatgtatcctaatttcggaaccgtgggtcccatacaaggttcaggtggaggcggagggtggactagtaattttactctacaacttattagcacgcctgcagcctagaagtatatcgacaactagttaacttactagtactaaactaaattataggtaactacgaaaccgttcgtaccccgtaccgtaactacgttacccgggaaccggtaaagggggtacccgaagggggttacggaacggtacgaacggtaaccggtaacgttggtaccggtaccttacggaaccctaacccgttattaccgtttaccggtttaccttacccgtaaccgtttccccccgttaccccggtacccttaagtttcccgttaacgggttaaaacctttcccttaccgtttaacggtcccggtaagggggtacccggggtaccgggttacgtaaccggggacggttaaacccggggacccgttaacggtaaaagttaccgggacgtacgtagtacgtacgtacgtagtacgtacgtacgtagtacgtgtgtacg

SEQ ID NO: 95021 - DNA, 603 bp, Homo sapiens
  misc_feature: GYAE6OF01EBP1U.29.74.G08.1.454.CMB.1.raw
  modified_base (590)..(595): a, c, t, g, unknown or other
  misc_feature (590)..(595): n is a, c, g, or t
  modified_base (597)..(598): a, c, t, g, unknown or other
  misc_feature (597)..(598): n is a, c, g, or t
  modified_base (600)..(603): a, c, t, g, unknown or other
  misc_feature (600)..(603): n is a, c, g, or t
tcagatagagtactcacgaccggtgctcgatttagtagctctatcagggtgctgctgaggctgtaggtgctgtccttgctgtcctgctctgtgacactctcctgggagtccaccctcacttgtcaggctaatacaaaacattaagagattatttaaattggtatcagacaagaaaccaaggaaaacgacccctaaactcctcatctacgatgtatcctaatttggaacctgggtccatcgaaggtcagtggaggcggagggtgggacagtattttactctcacttattagcagcctgcacgcctaggaagtaatagttagaccaactattaattactagtacaaactaatatgatagactcgcctaccgactacgttccggaccgaagggaccgaggggtggaggtacgaacggtacgaacgttggtacgggctccggactaccctagttcgttcgtccctttcgtaccgttcccgttacccccgacttacgttcgtaacgttaaccgttaccttccttaacgttccgtacggggtacggcccgggggttataccgggggacgaaacgggcccgtaacgtaggtagctannnnnngnnannnn

SEQ ID NO: 95022 - DNA, 707 bp, Homo sapiens
  misc_feature: GYAE6OF01EUWKU.29.74.G08.1.454.CMB.1.raw
  modified_base (267)..(267): a, c, t, g, unknown or other
  misc_feature (267)..(267): n is a, c, g, or t
  modified_base (330)..(330): a, c, t, g, unknown or other
  misc_feature (330)..(330): n is a, c, g, or t
  modified_base (674)..(674): a, c, t, g, unknown or other
  misc_feature (674)..(674): n is a, c, g, or t
  modified_base (686)..(686): a, c, t, g, unknown or other
  misc_feature (686)..(686): n is a, c, g, or t
  modified_base (700)..(700): a, c, t, g, unknown or other
  misc_feature (700)..(700): n is a, c, g, or t
  modified_base (704)..(704): a, c, t, g, unknown or other
  misc_feature (704)..(704): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaatggtatcagcaagaaaccaggaaacgccctaaactcctcatctacgatgtatccaattcggaaccgtgggtccatcaaggttcagtggaggcggaggtggacagtattttacnctacactattagcagcctgcagcctagaagactatgacaatatattactgtaacaactaatanagtatagtaactcgtaccctaccgtaactacgttacccgggaccgaaacggggtaccgtaagggggttcggaagggttaccgaacgggtaaccggtaacgttcgggtacggtaccgtacgacccgtaaccctaacgttccgtttacggttacccttttaccgtaaccgtttccccgttacccccgtaaccgttaagttttaacccgttaaacgggtaaaccgtttaaccccttttcgttaaaccgttccgggtttaagggaccgggggttccccggggttaacggtacggggtaacccgaaaacggggggccctaaccggttaaaggttaacgcgtacggtaanacgttacgacgngacgtacgtacgangtgngtg

SEQ ID NO: 95023 - DNA, 520 bp, Homo sapiens
  misc_feature: GYAE6OF01CTHZB.29.74.G08.1.454.CMB.1.raw
  modified_base (281)..(281): a, c, t, g, unknown or other
  misc_feature (281)..(281): n is a, c, g, or t
  modified_base (313)..(313): a, c, t, g, unknown or other
  misc_feature (313)..(313): n is a, c, g, or t
  modified_base (419)..(419): a, c, t, g, unknown or other
  misc_feature (419)..(419): n is a, c, g, or t
  modified_base (453)..(453): a, c, t, g, unknown or other
  misc_feature (453)..(453): n is a, c, g, or t
  modified_base (483)..(483): a, c, t, g, unknown or other
  misc_feature (483)..(483): n is a, c, g, or t
  modified_base (502)..(502): a, c, t, g, unknown or other
  misc_feature (502)..(502): n is a, c, g, or t
  modified_base (509)..(510): a, c, t, g, unknown or other
  misc_feature (509)..(510): n is a, c, g, or t
  modified_base (512)..(520): a, c, t, g, unknown or other
  misc_feature (512)..(520): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaacgcccctaaactcctcatctacgatgtatccaatttgggaacctggggtcccatcaaggttcaggtgggagggcgggagggtgggactaggtatttttaccncttacacttattagcagcctgcagcctgaagntattgacaactatattactgtacaactaatatgaatgaactcgaccctccgactattccgggaccgaacgggggacctaggggtggaggtcgaaggacgaagtggnggctggccaccatctcgttcctcacttcctcccnctatctagaacttctcttatcgtggacggngggtcgtaggacgagggcnctagtgnngnnnnnnnnn

SEQ ID NO: 95024 - DNA, 626 bp, Homo sapiens
  misc_feature: GYAE6OF01CW40R.29.74.G08.1.454.CMB.1.raw
  modified_base (183)..(183): a, c, t, g, unknown or other
  misc_feature (183)..(183): n is a, c, g, or t
  modified_base (282)..(282): a, c, t, g, unknown or other
  misc_feature (282)..(282): n is a, c, g, or t
  modified_base (317)..(317): a, c, t, g, unknown or other
  misc_feature (317)..(317): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatacaaaacattaagagattaatttaaatggtatcagcaagaaacaggaaaacnccctaaactcctcatctacgatgtactaccaatttcggaaccgtcgggtacccatcaaggttcaggtgggaggcgggaggtgggaactagtattttacnctacacttattacgcacgcctgcagcctagaacgnttatcgacaatattattactgtacaactatagtgatggaactcgaccctacgactacgttccggaaccgaagggccgtaggggtaggtacggtacgacggacgtaacgtcgggtacgcgtacgacctacctagtcgttcgtctttaccgtaccgttcccgttacccgactagttcgtaacgtaacgttcctaccgttagttccggtagggtcgggtaccggtcgtacgggacgtaacgggccgttaacgacggttagcgacgtagtacgtcgtacgtacgtacgtacgtacgtacgtacgtacgtgtcg

SEQ ID NO: 95025 - DNA, 639 bp, Homo sapiens
  misc_feature: GYAE6OF01B0FLY.29.74.G08.1.454.CMB.1.raw
  modified_base (625)..(625): a, c, t, g, unknown or other
  misc_feature (625)..(625): n is a, c, g, or t
  modified_base (630)..(630): a, c, t, g, unknown or other
  misc_feature (630)..(630): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatacaaaacattaagagatatttaaattggtatcagcagaaaccaggaaaacgcccctaaactcctcatctacgatgtatcctaagtttggaaccgtgggtcccatcgaaggttcaggtggaggcgggaggtgggacagtattttactctcactattagcagcctgcagcctagaagtattatgacaactattattactgtacaacaatatgatacgaactcgccctaccgactacgttccggaccgaacggggaccgaggggtcggacggtacgaacggtaacggtaacgtggtacggtcctacggacctaacccgtagttccgttcggttaccctttaccaccgttttccccgttaccccgaccttagttacccggttaaggtaaaccgtttaccttccttaacgttccggtaggggtacggggtacccggggtcgttacggggaacccgtaaacggggtccgtaacgtaacgttaggctctacgcgtgctacngtcanagcngngcg

SEQ ID NO: 95026 - DNA, 644 bp, Homo sapiens
  misc_feature: GYAE6OF01BCRF8.29.74.G08.1.454.CMB.1.raw
  modified_base (267)..(267): a, c, t, g, unknown or other
  misc_feature (267)..(267): n is a, c, g, or t
  modified_base (296)..(296): a, c, t, g, unknown or other
  misc_feature (296)..(296): n is a, c, g, or t
  modified_base (621)..(621): a, c, t, g, unknown or other
  misc_feature (621)..(621): n is a, c, g, or t
  modified_base (626)..(627): a, c, t, g, unknown or other
  misc_feature (626)..(627): n is a, c, g, or t
  modified_base (631)..(631): a, c, t, g, unknown or other
  misc_feature (631)..(631): n is a, c, g, or t
  modified_base (640)..(640): a, c, t, g, unknown or other
  misc_feature (640)..(640): n is a, c, g, or t
  modified_base (642)..(644): a, c, t, g, unknown or other
  misc_feature (642)..(644): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaagcccctaaactcctcatctacgatgtatccaatttggaacctgggtcccatcaaggttcagtggaggcggaggtgggacagattttacnctcactattagcagcctgcagcctgaagntattgcaacatattactgtacaacaattatgaactgaaactcggcctaccgactacgtttaccgggacccgtaaagggggacccaagggggttcggaacgggtttaccgaaagggttaacccgggaaaccgttgggttaccggggaccctttgggaccctaaaccccgaactttccgttagggttcccttttaccgaaagttttccccctttacccccgggaccctaacgtttccgttaacgggaaacgttttaaccctccgttaattcccgtacggaagggcccggggtcttagggccgaaacgggcgtacctaagttaagggnacganncgangcgtcacancnnn

SEQ ID NO: 95027 - DNA, 636 bp, Homo sapiens
  misc_feature: GYAE6OF01D4OPJ.29.74.G08.1.454.CMB.1.raw
  modified_base (277)..(277): a, c, t, g, unknown or other
  misc_feature (277)..(277): n is a, c, g, or t
  modified_base (619)..(619): a, c, t, g, unknown or other
  misc_feature (619)..(619): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (628)..(628): a, c, t, g, unknown or other
  misc_feature (628)..(628): n is a, c, g, or t
  modified_base (630)..(630): a, c, t, g, unknown or other
  misc_feature (630)..(630): n is a, c, g, or t
  modified_base (632)..(633): a, c, t, g, unknown or other
  misc_feature (632)..(633): n is a, c, g, or t
  modified_base (635)..(636): a, c, t, g, unknown or other
  misc_feature (635)..(636): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagacaagaaaccaaggaaaacgcccctaaactcctcatctacgatgtatcctaatttcggaacctcgggtcccatcaaggttcagtggaggcggaggtgggactagtattttacnctactacttattagcagcctgcagcctagaagtattattcgactaaactattaacttactacgtaacaaactaattatagaatacgaactcgaccctccgaacgtcgttacggaccgaaaggggaccgaggggtcggaaggtacaacggacgtaagtggtacggactacgacctaaccctattccgttcgttacctttaccaacgtttccccgttaccccgtaccttaacgtttccgtttaacggtaaaccgttaccttacgttaaccttcggtacggggtaacgggtccggggaccgttacgggaaccgtaacggggccgtacctaagttaagctagctanagcncnganananngnn

SEQ ID NO: 95028 - DNA, 542 bp, Homo sapiens
  misc_feature: GYAE6OF01BEQ4Y.29.74.G08.1.454.CMB.1.raw
  modified_base (403)..(403): a, c, t, g, unknown or other
  misc_feature (403)..(403): n is a, c, g, or t
  modified_base (517)..(517): a, c, t, g, unknown or other
  misc_feature (517)..(517): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (528)..(529): a, c, t, g, unknown or other
  misc_feature (528)..(529): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (535)..(536): a, c, t, g, unknown or other
  misc_feature (535)..(536): n is a, c, g, or t
  modified_base (538)..(538): a, c, t, g, unknown or other
  misc_feature (538)..(538): n is a, c, g, or t
  modified_base (540)..(541): a, c, t, g, unknown or other
  misc_feature (540)..(541): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcagctaatcaaaacattaagagatatttaaattggtatcagcagaaaccaggaaaagcccctaaaactcctcatctacgatgtatccaatttcggaacctggggtcccatcaaggttcagtggaggcggaggtggacagagttttaactctcactattacgcaagcctgcagcctgaagatattagcaacatattactgtcaacaatatgatgaaactgcctaccgacacttcggaccaaggggacccagggtcggaggtcaggacaatggtgctgcaccntactctcgttcacttcccttcccgccctagtctacgaaacgttacctcttaacgtcgttaggaacggtccggggccttagggacccgtaaacgggccggacgtaacgtaaggcncgaccgngncnncncncnncncnnc

SEQ ID NO: 95029 - DNA, 483 bp, Homo sapiens
  misc_feature: GYAE6OF01ASR5L.29.74.G08.1.454.CMB.1.raw
  modified_base (270)..(270): a, c, t, g, unknown or other
  misc_feature (270)..(270): n is a, c, g, or t
  modified_base (470)..(483): a, c, t, g, unknown or other
  misc_feature (470)..(483): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaagcccctaaactcctcatctacgatgtatccaatttggaacctggggtcccatacaaggttcagtggaggcggaggtgggacagtattttacnctcactattagcagcctgcagcctagaagatattgacaacatattactgtacaacaatatgatagaactgacctccgactagttccggaccgaagggaccaggggtgaggtcagacgactgtgctgcacatctgtcttcattcctccgcatctagaacgttactctatctggacgcgggctggacaaggctcgatgcgtnnnnnnnnnnnnnn

SEQ ID NO: 95030 - DNA, 634 bp, Homo sapiens
  misc_feature: GYAE6OF01ESKHF.29.74.G08.1.454.CMB.1.raw
  modified_base (619)..(620): a, c, t, g, unknown or other
  misc_feature (619)..(620): n is a, c, g, or t
  modified_base (622)..(622): a, c, t, g, unknown or other
  misc_feature (622)..(622): n is a, c, g, or t
  modified_base (624)..(634): a, c, t, g, unknown or other
  misc_feature (624)..(634): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatacaaaacattaaagagtattaatttaaattggtatcagacaagaaaccaaggaaaacgacccctaaactcctcatctacgatgtatcctaagttcggaaccgtcgggtaccctatacgaaggttcgaggtgggaggcgggagggtggactagttatttactctctactattagcacgcctcgcagccgtagaacgtatattcgacaactacttattaactacgttacaaactaatatagtaatacggtaactcggaccctaccgaactacgttaccggaaccggtaacggggacggtacgggggtaggtaacggtacgaacggtaacgtacgtggtcggctcgaccctacgttacttccgttcgtttccttaccgtacctttccccgttaccccgtaccctagttacccggtttagtaaccgtttaccgtaacctttacggtccgttaagggcgggtccgggtggaccgacggacggcgacgtagagnngnannnnnnnnnnn

SEQ ID NO: 95031 - DNA, 572 bp, Homo sapiens
  misc_feature: GYAE6OF01EVT92.29.74.G08.1.454.CMB.1.raw
  modified_base (558)..(558): a, c, t, g, unknown or other
  misc_feature (558)..(558): n is a, c, g, or t
  modified_base (560)..(572): a, c, t, g, unknown or other
  misc_feature (560)..(572): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatacaaaacattaagagattaatttaaattggtatcagacaagaaaccaaggaaaacgacccctaaaactcctacatactacgatagtatacctaagtttcggaaccgtggggtccccatcgtaaggttcagtgggaggcggaggtggacagtatttactctcacttatagcagcctgcagccgagaagatattagacaatattattactagtacaaactaatatagatagaactcgacctaccgactacgttaccgggaccgaaacgggaccggaggggtaggacggtacgaaggaacgtagtggtggcctgacctaccgtatcgtcgttaccttctacgttcccgttacccccgctagttaccgtagtaacgttactcgtacttcggaggtacggcgggactagggacgaaggccgtataggtacancnnnnnnnnnnnnn

SEQ ID NO: 95032 - DNA, 627 bp, Homo sapiens
  misc_feature: GYAE6OF01EUXIN.29.74.G08.1.454.CMB.1.raw
  modified_base (294)..(294): a, c, t, g, unknown or other
  misc_feature (294)..(294): n is a, c, g, or t
  modified_base (606)..(606): a, c, t, g, unknown or other
  misc_feature (606)..(606): n is a, c, g, or t
  modified_base (613)..(613): a, c, t, g, unknown or other
  misc_feature (613)..(613): n is a, c, g, or t
  modified_base (615)..(627): a, c, t, g, unknown or other
  misc_feature (615)..(627): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatacaaaacattaagagattaattttaaattggtatcagcaagaaaccaaggaaaacgcccctaaactcctcatctacgatgtactcctaagtttacggaaccgttcggggtcccagtcgtaacggttcgaggtgggaggcgggagggtggacagtacttttacnctacgtacttattacgacacgtcctgacgtacgacctaggaagtaatttaagttcgacaaacgtattaactttacgtacgtaacaaactaattagtagagtacgtaaccgtacgtcccgttaccgaacttaccggttaccgggacccgggaaacgggtaccgggtacggggttacgggacggtacgaacggaacgtaaccgtgggtaccgcgtcgaacctacctacttcgttgttaccgttcttaccgttcccttcccgactattcgtacaacgtttcctcgttaactcgagggcggtcgacgtgacgagcnctagcgncnnnnnnnnnnnnn

SEQ ID NO: 95033 - DNA, 575 bp, Homo sapiens
  misc_feature: GYAE6OF01AN7GI.29.74.G08.1.454.CMB.1.raw
  modified_base (503)..(503): a, c, t, g, unknown or other
  misc_feature (503)..(503): n is a, c, g, or t
  modified_base (526)..(526): a, c, t, g, unknown or other
  misc_feature (526)..(526): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (564)..(575): a, c, t, g, unknown or other
  misc_feature (564)..(575): n is a, c, g, or t
tcagatagagtactcacgaccggtgctcgatttagtagctctatcagggtgctgctgaggctgtaggtgctgtccttgctgtcctgctctgtgacactctcctgggagtccaccctcacttgtcaggctaatacaaaacattaagagattatttaaattggtatcagcaagaaaccaaggaaacgacccctaaactcctcatctacgatgtatcctaagtttcggaaccgtcggggtacccatacgaaggttcaggtggagggcggagggtgggactagtattttactctcacttatagcagcctgcagcctagaagtatattagaccaaactattaattactagtacaaactaactatagtactaacgtaactcgaccctaccgaactacggttaccgggacccgaaaggggaccgagggggttaggaaggttccgaacgacgtaacgttgggacggtctacggacctactaattcttcgtacttcgtaccttccctccccngtacttcgaactacgttctctancggtagcggtcgagcggagacggcatgtanancgtagnnnnnnnnnnnn

SEQ ID NO: 95034 - DNA, 610 bp, Homo sapiens
  misc_feature: GYAE6OF01B9F22.29.74.G08.1.454.CMB.1.raw
  modified_base (295)..(295): a, c, t, g, unknown or other
  misc_feature (295)..(295): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
  modified_base (562)..(562): a, c, t, g, unknown or other
  misc_feature (562)..(562): n is a, c, g, or t
  modified_base (586)..(586): a, c, t, g, unknown or other
  misc_feature (586)..(586): n is a, c, g, or t
  modified_base (590)..(590): a, c, t, g, unknown or other
  misc_feature (590)..(590): n is a, c, g, or t
  modified_base (595)..(595): a, c, t, g, unknown or other
  misc_feature (595)..(595): n is a, c, g, or t
  modified_base (599)..(610): a, c, t, g, unknown or other
  misc_feature (599)..(610): n is a, c, g, or t
tcagatagagtactcacgaccggtgctcgatttagtagctctatcagggtgctgctgaggctgtaggtgctgtccttgctgtcctgctctgtgacactctcctgggagtccaccctcacttgtcaggctaatacaaaacattaagagtattatttaaattggtatcagcaagaaaccgaaggaaaacgaccccctaaactcctcactcacgatgtatacctaagtttaggaaccgtcgggtacccataccgaaggttcgaggtgggaagggcggagggtggactagtattttacnctacatattagcagcctgacagcctagatatatcgacaactattactactatacaaactaatancggtaatagaaccncgtaccctaccgacgtaacgtccgggaaccgaacgggtaccggaggggtaggacggtacgagaacgtacggtggtcgctacgacctaacttagtccttagttcccttacgtaacctttcccgtccccgtataccgttacgtaacggttaactcttaaccgtatttaccggacgggtcgggtacccgggngtaccggacgggaacgtcccgtanaagnggtancgannnnnnnnnnnn

SEQ ID NO: 95035 - DNA, 671 bp, Homo sapiens
  misc_feature: GYAE6OF01A1QHS.29.74.G08.1.454.CMB.1.raw
  modified_base (655)..(655): a, c, t, g, unknown or other
  misc_feature (655)..(655): n is a, c, g, or t
  modified_base (660)..(660): a, c, t, g, unknown or other
  misc_feature (660)..(660): n is a, c, g, or t
  modified_base (664)..(664): a, c, t, g, unknown or other
  misc_feature (664)..(664): n is a, c, g, or t
  modified_base (668)..(668): a, c, t, g, unknown or other
  misc_feature (668)..(668): n is a, c, g, or t
  modified_base (670)..(670): a, c, t, g, unknown or other
  misc_feature (670)..(670): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaacattaagagatatttaaatggtatcagcagaaaccaggaaacgccctaaactcctcatctacgatgtactccaatttcggaaccgtggggtcccatcgaaggttcaggtggaggcggaggtgggacagtacttttactctcactattagcaggccttgctacgccgttagaaggtattaacgttggtactaaactattacttaacgtcgtaacaaactaagttactagtagtacgaacttcgaccgttacccgaacgtacgttaccgggaccgtaacggggtaccgtaaggggtcggtacggtcgaacgtacggtaacgttcggcgggtacttacggaccctaactacggtttactcggtttaccttaccgtacgtttaccccgtccccgtacgtacgttaccgttacgggaaactttaccgtccttaaacgttccgtttccggggaacgggttcccggggtaacgtccgggttaacggaaaccggcggtacctaggtaacggcaggtccacgttgcacncgtcncgangtgngng

SEQ ID NO: 95036 - DNA, 749 bp, Homo sapiens
  misc_feature: GYAE6OF01DZSHJ.29.74.G08.1.454.CMB.1.raw
  modified_base (723)..(723): a, c, t, g, unknown or other
  misc_feature (723)..(723): n is a, c, g, or t
  modified_base (729)..(729): a, c, t, g, unknown or other
  misc_feature (729)..(729): n is a, c, g, or t
  modified_base (731)..(732): a, c, t, g, unknown or other
  misc_feature (731)..(732): n is a, c, g, or t
  modified_base (735)..(736): a, c, t, g, unknown or other
  misc_feature (735)..(736): n is a, c, g, or t
  modified_base (739)..(739): a, c, t, g, unknown or other
  misc_feature (739)..(739): n is a, c, g, or t
  modified_base (741)..(741): a, c, t, g, unknown or other
  misc_feature (741)..(741): n is a, c, g, or t
  modified_base (747)..(749): a, c, t, g, unknown or other
  misc_feature (747)..(749): n is a, c, g, or t
tcagatagagtactcacgaccggtgctcgatttagtagctctatcagggtgctgctgaggctgtaggtgctgtccttgctgtcctgctctgtgacactctcctgggagtccaccctcacttgtcaggctaatacaaaacattaagagtaattaattttaaattggtatcagacaagaaaccaaggaaaacgaccctaaactcctacatactacgatgtactacctaagttcggaaccgttcgggtaccctaagtacgtaacggttcagggtagggagggacgggtagggtacgggactagttaacttttaccgtactacctaacttagttacgacacgtcctacgaccgacgtaccgtaaggaaacgtagttaagttacgaacaaacgttaattactttacgtaagtaacaaactaaattagtagtaactacgtaaccgttcgacccgtaccgtaacgtaccggttacccgggaaccgtaacgggggaccgggtaaggggtaggtaacggtaacgaaacggtaaccggtaacgttcgggtaccggacgttacgacccgtaaccgttagttaccgttacgttaccctttctacccgtttaccccgttaccccgactttaacgtaccgtttaaggtaaccctttaccgtacctttaacgtaccggttacgggacgggttccgggtaccgttacggggacggaacgggtacccaaggtactacggntacgtncnnganncanangggggnnn

SEQ ID NO: 95037 - DNA, 787 bp, Homo sapiens
  misc_feature: GYAE6OF01CRIZK.29.74.G08.1.454.CMB.1.raw
  modified_base (778)..(778): a, c, t, g, unknown or other
  misc_feature (778)..(778): n is a, c, g, or t
  modified_base (783)..(783): a, c, t, g, unknown or other
  misc_feature (783)..(783): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatacaaaacattaagagtattaatttaaattggtatcagacagaaaccaaggaaacgaccctaaactcctcatctacgatgtactacctaagtttacggaaccgttcggggtacccctagtacgtaacgggtttacgaaggttggggaggggacgggggtagggtaggggaacctaggttactttttacctccttactaaccttagttaacggcacggcccttggcctaaggtccgtaaggaagtacttagttcgaacctaaactaattaactttaaccgtacgttaacaaactaattaagtagactacgtaacgtacgtcccctaccgtactacggttccggaaccgtaacggggaccggaggggtagggtacggtaccgaacggtaaccgaacgttacggtgggaccgttcggaccctaacccgtacgtttacccgttcggtttcctttacccgtaaccgttttcccccgtttacccccgtacccgtttaccgtttacccgttaacggttaaaccgttttcccgtttaaccgttacgtttacccgggtaacgggtaccggggtacccgggtacgggttacgggaccgggtaaaccggggacctaaccggtaaagttacggacgacgtcgagcgtgcacgacgacganagtgngtcg

SEQ ID NO: 95038 - DNA, 696 bp, Homo sapiens
  misc_feature: GYAE6OF01EUR34.29.74.G08.1.454.CMB.1.raw
  modified_base (678)..(678): a, c, t, g, unknown or other
  misc_feature (678)..(678): n is a, c, g, or t
  modified_base (681)..(681): a, c, t, g, unknown or other
  misc_feature (681)..(681): n is a, c, g, or t
  modified_base (683)..(684): a, c, t, g, unknown or other
  misc_feature (683)..(684): n is a, c, g, or t
  modified_base (686)..(687): a, c, t, g, unknown or other
  misc_feature (686)..(687): n is a, c, g, or t
  modified_base (689)..(693): a, c, t, g, unknown or other
  misc_feature (689)..(693): n is a, c, g, or t
  modified_base (695)..(695): a, c, t, g, unknown or other
  misc_feature (695)..(695): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagataatttaaattggtatcagcaagaaaccaaggaaaacgccctaaactcctcatctacgatgtactcctaatttggaacctggggtcccatcaaggttcaggtggaggcggagggtgggacagtattttactctacattatagcacgcctgacagcctagaagattatgacaactattaattactgtacaaaacgtaatatagtaagtacggaaaccttcggacccttaccggacgtaacggtttacccgggaaccgaaacgggggtacccggaaggggggttcgggaacgggttaccggaaggaaacccgggtaacgttcggggttacgggacccgtacggtacccaacccgttaattccgggtttactttacccgtttacctacccgtttacccccgttttaccccgaccccttaagtttaccccggttaaggtaaacccggtttaccttaccgtttaacgttccggttaaggggccggggttaccgggtcggttaccggggaacgtaacggggccacggttaacgacggncgngnncnntnnnnngng

SEQ ID NO: 95039 - DNA, 640 bp, Homo sapiens
  misc_feature: GYAE6OF01B0M4V.29.74.G08.1.454.CMB.1.raw
  modified_base (613)..(613): a, c, t, g, unknown or other
  misc_feature (613)..(613): n is a, c, g, or t
  modified_base (628)..(628): a, c, t, g, unknown or other
  misc_feature (628)..(628): n is a, c, g, or t
  modified_base (630)..(640): a, c, t, g, unknown or other
  misc_feature (630)..(640): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatacaaaacattaagagatatttaattggtatcagcagaaaccaggaaacgacccctaaactcctcatctacgatgtatcctaagtttcggaaccgtcggggtacccatacgaaggttcaggtggagggcggaggtgggacagtattttacgctacacttatagcagcctagcagcctagaagatagttgacaactattaacttacgtagtacaaactaatattagaatacgaaccttcgcccgttacccgtacgtacgttaccgggacccgaacgggggacccgtagggggtacgggaaggtcgaacgggtaacggtaacgtgggttacggcgtacggacctaaccgtactcgtttcgtaccttacgttacccttccgttcccccgacctaacgttacgtacggttaaaccgttaccgttactactttccgggagtaccgggggtccgggtaccttacggggacccgtaacgggtcccgtaanaaggttaggccagangnnnnnnnnnnn

SEQ ID NO: 95040 - DNA, 798 bp, Homo sapiens
  misc_feature: GYAE6OF01AO3I8.29.74.G08.1.454.CMB.1.raw
  modified_base (180)..(180): a, c, t, g, unknown or other
  misc_feature (180)..(180): n is a, c, g, or t
  modified_base (193)..(193): a, c, t, g, unknown or other
  misc_feature (193)..(193): n is a, c, g, or t
  modified_base (382)..(382): a, c, t, g, unknown or other
  misc_feature (382)..(382): n is a, c, g, or t
  modified_base (793)..(793): a, c, t, g, unknown or other
  misc_feature (793)..(793): n is a, c, g, or t
tcagatagagtactcacgaccggtgctcgatttagtagctctatcagggtgctgctgaggctgtaggtgctgtccttgctgtcctgctctgtgacactctcctgggatcacctcacttgtcaggctaatcaaaacattaagagataatttaaatggtatcagcaagaaaccaggaaaacnccctaaactcctnactctacgatgtatacctaatttggaaccgtgggtcccatcgaaacggttcaggtcgggaggtcgggagggttgggactaaggtacttttacctcgtacacttattacggactacgtcccgtgaccgacgtccgtagaaagtacttagttacgactaaactattacttaccgtagtaacaactaaattntacggtatacgtaaacctcggtaccctaccgaacttacgggttaccggaaccggtaaacgggggtaacccgtaaggggggttacgggtaaccgggtaccgaaacggttaacccgggtaacgttacggggtggttaccccggttacgaacccgtaaccgtttacctaacgtttcggtttaccctttaaccttaaccgtttcccccgtttaccccggacccttaaaccgttttccgttaaacgggttaaaccgtttaccctttaaccgttaacttttaccgggaaaccgggttaccgggggtccggttttaaccgggccgggtaaaacccggttccgggggaaccttaacccggtaaagggttacctaaccggtacgtacgtgtacgtacgtacggtacgtcgacgagcgtgngtacg

SEQ ID NO: 95041 - DNA, 654 bp, Homo sapiens
  misc_feature: GYAE6OF01EY3H4.29.74.G08.1.454.CMB.1.raw
  modified_base (277)..(277): a, c, t, g, unknown or other
  misc_feature (277)..(277): n is a, c, g, or t
  modified_base (315)..(315): a, c, t, g, unknown or other
  misc_feature (315)..(315): n is a, c, g, or t
  modified_base (544)..(544): a, c, t, g, unknown or other
  misc_feature (544)..(544): n is a, c, g, or t
  modified_base (641)..(645): a, c, t, g, unknown or other
  misc_feature (641)..(645): n is a, c, g, or t
  modified_base (647)..(651): a, c, t, g, unknown or other
  misc_feature (647)..(651): n is a, c, g, or t
  modified_base (653)..(654): a, c, t, g, unknown or other
  misc_feature (653)..(654): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcaagaaaccaggaaacgaccctaaactcctcatctacgatgtatccaatttcggaacctcggggtacccatcgaaggttcaggtggaggcggaggtgggacagtacttttacnctcactattagcagcctcgaccgacgtaccgtagtaanagttaattacgttactaacctaacttaactttaacttacgtaaccgtaaacctaaactaaactaagtaagtaacgtaacgtacgtaccgtacccgtaccgtaccgttaccggtaaccgggtaaccgggtaaccgggtacggggtacggggtacgggtacggaacgaacggtaacgtacggtacggtcggtacgtacgaccgtacctacgtttacttcgttacgttaccncttcccgttccccgtacgtaccttcgtacgtaacgttaccttactacgtacgtacgtacgggccggtacggtcggtacggacggtcgacgtacgtgnnnnncnnnnngnn

SEQ ID NO: 95042 - DNA, 763 bp, Homo sapiens
  misc_feature: GYAE6OF01DKLRB.29.74.G08.1.454.CMB.1.raw
  modified_base (741)..(741): a, c, t, g, unknown or other
  misc_feature (741)..(741): n is a, c, g, or t
  modified_base (750)..(750): a, c, t, g, unknown or other
  misc_feature (750)..(750): n is a, c, g, or t
  modified_base (758)..(760): a, c, t, g, unknown or other
  misc_feature (758)..(760): n is a, c, g, or t
  modified_base (762)..(763): a, c, t, g, unknown or other
  misc_feature (762)..(763): n is a, c, g, or t
tcagatagagtactcacgaccggtgctcgatttagtagctctatcagggtgctgctgaggctgtaggtgctgtccttgctgtcctgctctgtgacactctcctgggatcaccctcacttgtcgaggtctaatacaaaactattaagagtaattaatttaaattggtatcagacaacgaaaccgaaggaaaaccgtacccctaaactccctacacttcgtaaccgatcgtactacctaacgttacggtaccgtcgggtacccagtacgaaggttcagggtggagggtacgggagggtacggaacgtagttaactttttaccgtacttaccgtaaccttaagtttaacgacgtacggtacctagtaccgtaacgtaccgttaaggtaaacgtaacgttaacttacggaacctaaacttactttaacgtttaaccgtacgtaaaacctaaaccgtaaagttagtacgtaacgtacgtaaccggtccgtaacccgtacccgtaacgtaccgttacgggaacccggtaacggggaccgggtaggggtacggtaacgggtaccgtaacgggtaaccgtacggtcggtacggttaccgacgacccgtaacgttacgtccggttcttacccgttctaccggtttccctaccccgacttacgttacgtaaggtaccttacgttcgtaacctcggttacgggtcgggaccggtcgttaacgggccgtaacggccctagaccgtgactacgnaggtcagtnactacggnnngnn

SEQ ID NO: 95043 - DNA, 644 bp, Homo sapiens
  misc_feature: GYAE6OF01AD4PY.29.74.G08.1.454.CMB.1.raw
  modified_base (291)..(291): a, c, t, g, unknown or other
  misc_feature (291)..(291): n is a, c, g, or t
  modified_base (366)..(366): a, c, t, g, unknown or other
  misc_feature (366)..(366): n is a, c, g, or t
  modified_base (606)..(606): a, c, t, g, unknown or other
  misc_feature (606)..(606): n is a, c, g, or t
  modified_base (616)..(616): a, c, t, g, unknown or other
  misc_feature (616)..(616): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
  modified_base (631)..(631): a, c, t, g, unknown or other
  misc_feature (631)..(631): n is a, c, g, or t
  modified_base (637)..(637): a, c, t, g, unknown or other
  misc_feature (637)..(637): n is a, c, g, or t
  modified_base (639)..(640): a, c, t, g, unknown or other
  misc_feature (639)..(640): n is a, c, g, or t
  modified_base (642)..(642): a, c, t, g, unknown or other
  misc_feature (642)..(642): n is a, c, g, or t
  modified_base (644)..(644): a, c, t, g, unknown or other
  misc_feature (644)..(644): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagtattaatttaaattggtatcagcaagaaaccaggaaaacgccctaaactcctcatctacgatcgtatacctaagtttacggaaccgtcgggtaccagtacgaaggttcaggtgggaggcgggaggtgggactaggtacttttaacncctacatattagacacgcctgcacgtcctagaacgtatagttcgactaactattacttactagtacaaacattanagatacgaacgtcgtccctacgaactacgtccggacgaacgggaccgaggggtacgacggtcaacggtaactaacgtcggtcggactacggacttaaaccgtacgttcgttcgttacctttacctccgtttaccccttacccccggacttacgtttacgtaacgggttaacctttaccttcgttaacggttcgacgggtacgggtccgggtaccttacggggtaaccggacggttaccgngtttaaacgngactaganancgagnactcananngngn

SEQ ID NO: 95044 - DNA, 570 bp, Homo sapiens
  misc_feature: GYAE6OF01AVO7K.29.74.G08.1.454.CMB.1.raw
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
  modified_base (560)..(570): a, c, t, g, unknown or other
  misc_feature (560)..(570): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaacgcccctaaactcctcatctacgatgtactccaatttggaccgtgggtcccatcaaggttcagtggaggcggaggtgggactagtattttacnctcactattacgcagcctgcacgcctagaagtntattcgacaactattattactgtacaaactaatatgatcgtaactcgaccctaccgactacgttccgggaccgaacggggtaccgaggggtacggacggtcaaggaccgtaagtggtggctcggaccctaccgtagttccgttcgttccttactacgttcccctttccccgactacttcgaaggtaaccttacttctaatccggtgaccgggttcgggacgtcgggacctaacggggctacgtagtacgncgtngnnnnnnnnnnn

SEQ ID NO: 95045 - DNA, 842 bp, Homo sapiens
  misc_feature: GYAE6OF01A53O0.29.74.G08.1.454.CMB.1.raw
  modified_base (804)..(804): a, c, t, g, unknown or other
  misc_feature (804)..(804): n is a, c, g, or t
tcagatagagtactcacgaccggtgctcgatttagtagctctatcagggtgctgctgaggctgtaggtgctgtccttgctgtcctgctctgtgacactctccgtggggactccaccctctacttgtcgaggacttaaataccaaaatattaagagtattaatttaaagttggtatacagacaaacgaaaccgaacggaaacctaccccttaaactcctactacttactacgtattagtaaccttaccttaagttaccggaaccgttcgggtacccaagttacgtacggttacgagggtacgggacgggtacggggtagggtacggacgttacgtttaactttttacctacgtacttacgtttaacgtacgaccgtaacgtccgtaggaccgtacgtaccgtaaggaacgttattacggttacaacctaataacttaacgttacgtactaaacgaacttaattagtacgtagtaacgtaccgttcccgtacgtaacctacggttacccgtaacgggacccgggtaacgggaccgggtaaggggtacggtaacgtaccgtaacgggtacgtaacggttcgggtacgtaccgtaccgtaccgttaccgttacgttaccgttaccgtttaccttaccgttaccccgttaccccggttacccttaccggttacgttaacccgtttaacgttaacccgtttacgttacccgttacggttacccggtacggggttaaccggggtccgggttacggtaacccggggtaaccggaccggttacggtaacccgtaggtaacggcacgggtaccngtcgtagtacgtacgtacgacgtacgtctcgtcgtacg

SEQ ID NO: 95046 - DNA, 684 bp, Homo sapiens
  misc_feature: GYAE6OF01AOH10.29.74.G08.1.454.CMB.1.raw
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaaggaaaacgcccctaaactcctcatctacgatgtactccaatttggaaccgtgggtcccatcaaggttcagtggaggcggaggtgggacagattttactctcactattagcagcctgcagcctagaagatattgacaacatattactgtacaaacatatgactagtaactcgaccctccgaactacgttccgggaccgaaacggggacccgtaggggttacgggacgggttaccgaacgggtaaaccgtaaccgttgggtacgggtccttgggaccccaaccgtacttcgttcgttaccctttcaaccgtttccccgttcccccgacctacgtttaccgttacggtaaaccgtttacccttacgttaacgttccggttagggaacccgggggtccgggtaccgttaccgggggtaccgaaaccgggggtccccgtaagtaaaacccgggtttggtaccgcccggtagtacgtcgtacgtacgtcgtacgtacgtacgtacgtccgcgtacg

SEQ ID NO: 95047 - DNA, 810 bp, Homo sapiens
  misc_feature: GYAE6OF01AVNVS.29.74.G08.1.454.CMB.1.raw
  modified_base (786)..(786): a, c, t, g, unknown or other
  misc_feature (786)..(786): n is a, c, g, or t
  modified_base (794)..(794): a, c, t, g, unknown or other
  misc_feature (794)..(794): n is a, c, g, or t
  modified_base (798)..(801): a, c, t, g, unknown or other
  misc_feature (798)..(801): n is a, c, g, or t
  modified_base (803)..(803): a, c, t, g, unknown or other
  misc_feature (803)..(803): n is a, c, g, or t
  modified_base (805)..(805): a, c, t, g, unknown or other
  misc_feature (805)..(805): n is a, c, g, or t
  modified_base (807)..(810): a, c, t, g, unknown or other
  misc_feature (807)..(810): n is a, c, g, or t
tcagatagagtactcacgaccggtgctcgatttagtagctctatcagggtgctgctgaggctgtaggtgctgtccttgctgtcctgctctgtgacactcctccgtgggacgtccaccctcacttgtacgaggactaataccaaaaactattaaagaagtattaatttaaagttggtatcagtacgaaacgaaaccaacggaaaaccgtacccccttaaacctccctactacctacgtacgtattacgttaactaccttaagtttaccggaccggtccggggtacccctagtaccgtaacgggtttacgtagggtggggacgggacgggggtagggttacggggactaagtttaccttttacgtccttacgtaacgtttagttaacggacgacgtcccgtacggaccgtaaccggtaccgttaaagggaaacgttacgtttaactttacggaaacccctaaaacgttaacttttaacgtttaaccgtataaacctaaaactaaagtttagtaacgtacgtaaccgtaacgtaccccgtcccgtaaccctaacggtttaccggtaaccgggaaccggaacgggggtacccggtagggggtacggttaccggaacgtaacggtaaccggtaacggttcggtacggtacgtaccgtacccgacttaccgttcgtttacgttcccgttacctacccgttcccgtaccccgtccgtaattaccgggtaacgtaacccgttacttcttacggttacgtaggggtaccggtccgggcgtagggaccgaggaccngagagcancgannnngnanannnn

SEQ ID NO: 95048 - DNA, 455 bp, Homo sapiens
  misc_feature: GYAE6OF02FVOUW.29.74.G08.1.454.CMB.1.raw
  modified_base (450)..(455): a, c, t, g, unknown or other
  misc_feature (450)..(455): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaagcccctaaactcctcatctacgatgtatccaatttggaacctgggtcccatcaaggttcagtggaggcggaggtgggacagattttactctcactattagcagcctgcagcctgaagatattgcaacatattactgtcaacaatatgatgaactgcctccgacattcggccaagggaccagggtggaggtcagacgaactgtggctgcaccatctgtctcattcttcccgcatctgaagtctctatctgagcgggctggcaaggcgcatagnnnnnn

SEQ ID NO: 95049 - DNA, 453 bp, Homo sapiens
  misc_feature: GYAE6OF02HVMN2.29.74.G08.1.454.CMB.1.raw
  modified_base (392)..(392): a, c, t, g, unknown or other
  misc_feature (392)..(392): n is a, c, g, or t
  modified_base (419)..(419): a, c, t, g, unknown or other
  misc_feature (419)..(419): n is a, c, g, or t
  modified_base (442)..(442): a, c, t, g, unknown or other
  misc_feature (442)..(442): n is a, c, g, or t
  modified_base (447)..(453): a, c, t, g, unknown or other
  misc_feature (447)..(453): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtccatcaaggttcagtggaggcggaggtgggacagattttactctcactattagcagcctgcagcctgaagatattgcaacatattactgtcaacaatatgatgaactgcctcgacattcggacaagggaccaggggtggaggtcagacgaactgtggctgcacatcngtcttcattctcccgcatctgaatctntatctgagcgggctggcaaggcncatgnnnnnnn

SEQ ID NO: 95050 - DNA, 458 bp, Homo sapiens
  misc_feature: GYAE6OF02F95JD.29.74.G08.1.454.CMB.1.raw
  modified_base (446)..(446): a, c, t, g, unknown or other
  misc_feature (446)..(446): n is a, c, g, or t
  modified_base (452)..(458): a, c, t, g, unknown or other
  misc_feature (452)..(458): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtggggacagattttactctcactattagcagcctgcagcctgaagatattgcaacatattactgtcaacaatatgatgaactgcctccgacattcggccaagggaccagggtggaggtcagacgaactgtggctgcaccatctgtcttcatcttcccgcatctgaagtctctatctgagcggctggcaaggcncatagnnnnnnn

SEQ ID NO: 95051 - DNA, 459 bp, Homo sapiens
  misc_feature: GYAE6OF02GAKJ8.29.74.G08.1.454.CMB.1.raw
  modified_base (445)..(445): a, c, t, g, unknown or other
  misc_feature (445)..(445): n is a, c, g, or t
  modified_base (450)..(459): a, c, t, g, unknown or other
  misc_feature (450)..(459): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtggggacagattttactctcactattagcagcctgcagcctgaagatattgcaacatattactgtcaacaatatgatgaactgcctccgacattcggccaagggaccagggtggaggtcagacgaactgtggctgcaccatctgtcttcatcttcccgcatctgaatctctatctgagcggctggcaaggcnatagnnnnnnnnnn

SEQ ID NO: 95052 - DNA, 467 bp, Homo sapiens
  misc_feature: GYAE6OF02HFTR7.29.74.G08.1.454.CMB.1.raw
  modified_base (269)..(269): a, c, t, g, unknown or other
  misc_feature (269)..(269): n is a, c, g, or t
  modified_base (402)..(402): a, c, t, g, unknown or other
  misc_feature (402)..(402): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
  modified_base (457)..(467): a, c, t, g, unknown or other
  misc_feature (457)..(467): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtgggacagtattttacnctcactattagcagcctgcagcctgaagatattgcaacatattactgtacaactaatatgatgaactgcctccgactattcggaccaagggaccagggtgtaggtcagacaactggtgctgcacatctgtctnattctcccgcatctagaatctntatctgagtcggntgggacaagggcacgatagnnnnnnnnnnn

SEQ ID NO: 95053 - DNA, 478 bp, Homo sapiens
  misc_feature: GYAE6OF02FF3SL.29.74.G08.1.454.CMB.1.raw
  modified_base (297)..(297): a, c, t, g, unknown or other
  misc_feature (297)..(297): n is a, c, g, or t
  modified_base (344)..(344): a, c, t, g, unknown or other
  misc_feature (344)..(344): n is a, c, g, or t
  modified_base (384)..(384): a, c, t, g, unknown or other
  misc_feature (384)..(384): n is a, c, g, or t
  modified_base (469)..(478): a, c, t, g, unknown or other
  misc_feature (469)..(478): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaacgcccctaaactcctcatctacgatgtatccaatttggaacctgggtcccatcaaggttcagtggaggcggaggtgggacagattttactctcactattagcagcctgcagcctgaanatattgcaactatatactgtacaacaatatgatgaactgcctccganattcggccaaggggaccaggggtggaggtcagacgactgnggctgccaccatctgtcttcattccttcccgctatctagaacgttactctatcgtagacgcgggctggcaagggcgacagacggnnnnnnnnnn

SEQ ID NO: 95054 - DNA, 470 bp, Homo sapiens
  misc_feature: GYAE6OF02H1YS3.29.74.G08.1.454.CMB.1.raw
  modified_base (269)..(269): a, c, t, g, unknown or other
  misc_feature (269)..(269): n is a, c, g, or t
  modified_base (403)..(403): a, c, t, g, unknown or other
  misc_feature (403)..(403): n is a, c, g, or t
  modified_base (459)..(470): a, c, t, g, unknown or other
  misc_feature (459)..(470): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtgggacagtattttacnctcactattagcagcctgcagcctgaagatattgcaacatattactgtacaacaatatagatgaactgacctcgacatcggaccagggaccagggtgaggtcagacgaactggtggctgacaccatctgtcttnactccttcccgcatctagaacgtctatatctgacgcgggctggacaggcacagtgnnnnnnnnnnnn

SEQ ID NO: 95055 - DNA, 468 bp, Homo sapiens
  misc_feature: GYAE6OF02FLFF3.29.74.G08.1.454.CMB.1.raw
  modified_base (450)..(450): a, c, t, g, unknown or other
  misc_feature (450)..(450): n is a, c, g, or t
  modified_base (454)..(468): a, c, t, g, unknown or other
  misc_feature (454)..(468): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaagccctaaactcctcatctacgatgtatccaatttggaacctgggtcccatcaaggttcagtggaggcggaggtgggacagattttactctcacttattagcagcctgcagcctgaagatattgacaacatattactgtacaacaatatgattaactgcctccgacattcggaccaagggaccaggggtgaggtcagacgactgtggctgcacatctgtcttcattccttcccgctatctgaacgtctctatctgacgcgggctggcaggcanatgnnnnnnnnnnnnnnn

SEQ ID NO: 95056 - DNA, 465 bp, Homo sapiens
  misc_feature: GYAE6OF02IVVOY.29.74.G08.1.454.CMB.1.raw
  modified_base (270)..(270): a, c, t, g, unknown or other
  misc_feature (270)..(270): n is a, c, g, or t
  modified_base (442)..(442): a, c, t, g, unknown or other
  misc_feature (442)..(442): n is a, c, g, or t
  modified_base (453)..(453): a, c, t, g, unknown or other
  misc_feature (453)..(453): n is a, c, g, or t
  modified_base (459)..(465): a, c, t, g, unknown or other
  misc_feature (459)..(465): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtggggacagattttacnctcactattagcagcctgcagccctgaagatattgcaacatattactgtcaacaatatgatgaactgcctccgacattcggccaagggaccaggggtggaggtcagacgaactgtggctgcaccatctgtcttcattccttcccgcatctgaacgtctctatctgagcgggntgggcaaggcncatagnnnnnnn

SEQ ID NO: 95057 - DNA, 461 bp, Homo sapiens
  misc_feature: GYAE6OF02GSWSH.29.74.G08.1.454.CMB.1.raw
  modified_base (270)..(270): a, c, t, g, unknown or other
  misc_feature (270)..(270): n is a, c, g, or t
  modified_base (455)..(461): a, c, t, g, unknown or other
  misc_feature (455)..(461): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtggggacagattttacnctcactattagcagcctgcagcctgaagatattgcaacatattactgtcaacaatatgatgaactgcctcgacattcggccaagggaccagggtggaggtcagacgaatgtggctgcacatctgtcttcattcttcccgcatctgaatctctatctgagcgggctgggcaagggccgacagtagnnnnnnn

SEQ ID NO: 95058 - DNA, 672 bp, Homo sapiens
  misc_feature: GYAE6OF02JL0JI.29.74.G08.1.454.CMB.1.raw
  modified_base (276)..(276): a, c, t, g, unknown or other
  misc_feature (276)..(276): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaacattaagagatatttaattggtatcagcagaaaccaaggaaacgacccctaaactcctcatctacgatgtataccaatttaggaaccgttcggggtcccatcaaggttcaggtggaggcggaggtgggacagtattttacnctcactattagcagcctgcacgcctagaagatattgacaacattacttactgtacaaactaatatagatacgaactcgacctccgaactacgttaccggaccgaaacgggacccgtaaggggtacgggacggtacgaacggaacggtaaacgtgggttacgggccttacggacctaaccctagttccttaggttaccctttacaacggttccccggttacccccgaccttaagttccgtaacgggtaaacgtttaccttcgtttaacgttccggtaacggggacggggttcccggggccttcgggggaaaccgtaaaccggggtccgtacccgtaaagtttcgggactcggtacgcgtacgtacgtacgtacgtacgtacgacgtacgtacgagcg

SEQ ID NO: 95059 - DNA, 464 bp, Homo sapiens
  misc_feature: GYAE6OF02HHDF3.29.74.G08.1.454.CMB.1.raw
  modified_base (268)..(268): a, c, t, g, unknown or other
  misc_feature (268)..(268): n is a, c, g, or t
  modified_base (439)..(439): a, c, t, g, unknown or other
  misc_feature (439)..(439): n is a, c, g, or t
  modified_base (456)..(464): a, c, t, g, unknown or other
  misc_feature (456)..(464): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtgggacagattttacnctcactattagcagcctgcagcctgaagatattgacaacatattactgtacaacaatatgatgaactgcctcgacattcggcaagggccagggtggagtcagacgaactggtagctgcaccatctgtcttcattccttcccgctatctgaacgtctctatctgagccgggntgggacaaggcacatgnnnnnnnnn

SEQ ID NO: 95060 - DNA, 474 bp, Homo sapiens
  misc_feature: GYAE6OF02J1C7S.29.74.G08.1.454.CMB.1.raw
  modified_base (269)..(269): a, c, t, g, unknown or other
  misc_feature (269)..(269): n is a, c, g, or t
  modified_base (429)..(429): a, c, t, g, unknown or other
  misc_feature (429)..(429): n is a, c, g, or t
  modified_base (460)..(474): a, c, t, g, unknown or other
  misc_feature (460)..(474): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttacnctcactattagcagcctgcagcctgaagatattgacaacatattactgtacaacaatatgatgaactgcctccgacattcggccaagggaccagggtgaggtcagacgaatgtggctgacacatctgtcttcattccttcccgcatctagaacgtacctncgtgacgcgggctgggacaaggcacagtagnnnnnnnnnnnnnnn

SEQ ID NO: 95061 - DNA, 460 bp, Homo sapiens
  misc_feature: GYAE6OF02F9IOI.29.74.G08.1.454.CMB.1.raw
  modified_base (269)..(269): a, c, t, g, unknown or other
  misc_feature (269)..(269): n is a, c, g, or t
  modified_base (445)..(445): a, c, t, g, unknown or other
  misc_feature (445)..(445): n is a, c, g, or t
  modified_base (451)..(460): a, c, t, g, unknown or other
  misc_feature (451)..(460): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttacnctcactattagcagcctgcagcctgaagatattgcaacatattactgtcaacaatatgatgaactgcctccgacattcggccaagggaccaggggtgaggtcagacgaactgtggctgcaccatctgtctcattctcccgcatctgaagtctctatctgagcgggctggcaaggcncatagnnnnnnnnnn

SEQ ID NO: 95062 - DNA, 475 bp, Homo sapiens
  misc_feature: GYAE6OF02GKQO0.29.74.G08.1.454.CMB.1.raw
  modified_base (462)..(475): a, c, t, g, unknown or other
  misc_feature (462)..(475): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtgggacagattttactctcactattagcagcctgcagcctgaagatattgcaacatattactgtcaaacaatatgatgaactgcctcgacattcggccaagggaccagggtggaggtcagacgactgtggctgcaccatctgtcttcattccttcccgctatctagaagttctctatctgacggcgggtctggacaagggcgacagtagnnnnnnnnnnnnnn

SEQ ID NO: 95063 - DNA, 467 bp, Homo sapiens
  misc_feature: GYAE6OF02IZ1DE.29.74.G08.1.454.CMB.1.raw
  modified_base (269)..(269): a, c, t, g, unknown or other
  misc_feature (269)..(269): n is a, c, g, or t
  modified_base (396)..(396): a, c, t, g, unknown or other
  misc_feature (396)..(396): n is a, c, g, or t
  modified_base (457)..(467): a, c, t, g, unknown or other
  misc_feature (457)..(467): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtgggacagtattttacnctcactattagcagcctgcagcctagaagatattgacaacattattactgtacaacaatatgatgaactgcctccgacattcggaccaagggaccaggggtggaggtcagacgaactgtgctgcacntctgtctcatctcccgctatctgaactctctatctgcgcgggtctgggcaaggcacatagnnnnnnnnnnn

SEQ ID NO: 95064 - DNA, 482 bp, Homo sapiens
  misc_feature: GYAE6OF02I7Y6Q.29.74.G08.1.454.CMB.1.raw
  modified_base (344)..(344): a, c, t, g, unknown or other
  misc_feature (344)..(344): n is a, c, g, or t
  modified_base (468)..(482): a, c, t, g, unknown or other
  misc_feature (468)..(482): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttactctcactattagcagcctgcagcctgaagatattgcaacatattactgtacaacaatatgatgaactgcctccganattcggaccaagggccagggtggaggtcagacgactgtggctgcaccatctgtcttcatccttcccgctatctagaacgttactctatcgtgacggcgggtctgggacaagggcctacagtagnnnnnnnnnnnnnnn

SEQ ID NO: 95065 - DNA, 750 bp, Homo sapiens
  misc_feature: GYAE6OF02HCKB5.29.74.G08.1.454.CMB.1.raw
  modified_base (724)..(724): a, c, t, g, unknown or other
  misc_feature (724)..(724): n is a, c, g, or t
  modified_base (749)..(749): a, c, t, g, unknown or other
  misc_feature (749)..(749): n is a, c, g, or t
tcagatagagtactcacgaccggtgctcgatttagtagctctatcaggggtgcgtgcgtgacggctgtaggtgactggtccgttgtcctgttccgtgctcgtgtgacaactctccgtggggatccaaccctctacgttgttcggaggtctaaatccaaaaacggtatttaacgtaggtattaattttaaaattttagggtaagttcgacgacgtaaggaaaacccaagggtaaaacgccccctaaaaccttccgtacgaagttccgttaacgggaagtcggttacgtccctaaaagtttcggtaaaccggtcgggggttcccccagtacgtaaacggtttccacgttgggtaaggcgggacggtcgggtacaggttacttttacctctacgactaacttagcgagacctgccacgtccggttcgaacgtagtacttcgacgtaaccaagtacttacggtagtcgtaaacgaattaagttagtattacgaaacgtcgtacctaccgaacgtaacgtttccgggaaccgaaaggggtaccgtaagggggttcggaacggttacgaacggtaccggaaacgtgggtacggtattccgaacgtaccctagttcctggttaccttacaacgtttacccttacccgacctaatcttaacggaattcctactacttactacggaacgtccgggactacggactaaacgggtcgaacacgtaaggctggatnacgtgtgcgaacgcgtaggtcagtng

SEQ ID NO: 95066 - DNA, 699 bp, Homo sapiens
  misc_feature: GYAE6OF02JFZ54.29.74.G08.1.454.CMB.1.raw
  modified_base (163)..(163): a, c, t, g, unknown or other
  misc_feature (163)..(163): n is a, c, g, or t
  modified_base (340)..(340): a, c, t, g, unknown or other
  misc_feature (340)..(340): n is a, c, g, or t
  modified_base (671)..(671): a, c, t, g, unknown or other
  misc_feature (671)..(671): n is a, c, g, or t
  modified_base (677)..(677): a, c, t, g, unknown or other
  misc_feature (677)..(677): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (690)..(690): a, c, t, g, unknown or other
  misc_feature (690)..(690): n is a, c, g, or t
  modified_base (696)..(696): a, c, t, g, unknown or other
  misc_feature (696)..(696): n is a, c, g, or t
  modified_base (698)..(698): a, c, t, g, unknown or other
  misc_feature (698)..(698): n is a, c, g, or t
tcagatagagtactcacgaccggtgctcgatttagtagctctatctaggggttgggcgtagctgaggcttggtacggtgcgtacgtccttggactccgtcctgctctgttgacctcctcctcctgggatcacccgtcaccttgcacggccgtaatactaaagntttaagacgatatttaaattcggtatccaacgctagtaaaccgacggaaaaggacccctaaactccctacctatccttacgatggtactaccgtaatttacggaacctggggttaccccaattcctaaaggttcctaggtcggaacggcggaagggtcgggacacgtagttttaccncctacgaccttagttacgcctaagtcccttagctagtcccgtagaacgtataagttcgaacgaaccattagttacctgttacccaaagtaactagttgagttggaacctggtcccgttccgaacgtacttccgggacctaacgggccctaggggtacgaccggttcaacggacgaaacttcggtaggaccttcggacaacccgttatttcgttacggttactttacgtacttccctttacccccgatacctacgttcggaaacctttccgtcttaacggtccgttacggacgtaaccgggcttagggaacaaacggtccgaataccgttgnctacgntacntntntctcnctctcncnc

SEQ ID NO: 95067 - DNA, 470 bp, Homo sapiens
  misc_feature: GYAE6OF02GCN3Q.29.74.G08.1.454.CMB.1.raw
  modified_base (429)..(429): a, c, t, g, unknown or other
  misc_feature (429)..(429): n is a, c, g, or t
  modified_base (452)..(452): a, c, t, g, unknown or other
  misc_feature (452)..(452): n is a, c, g, or t
  modified_base (458)..(470): a, c, t, g, unknown or other
  misc_feature (458)..(470): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttactctcactattagcagcctgcagcctgaagatattgcaacatattactgtcaacaatatgatgaactgcctcgacattcggccaaaggggaccaggggtggaggtcagacgaactgtggctgcaccatctgtcttcattcttcccgcatctagaagtacctntatctgagcgggctggcaaggcnagtagnnnnnnnnnnnnn

SEQ ID NO: 95068 - DNA, 477 bp, Homo sapiens
  misc_feature: GYAE6OF02HIMOZ.29.74.G08.1.454.CMB.1.raw
  modified_base (428)..(428): a, c, t, g, unknown or other
  misc_feature (428)..(428): n is a, c, g, or t
  modified_base (469)..(477): a, c, t, g, unknown or other
  misc_feature (469)..(477): n is a, c, g, or t
tcagatagagtactcacgaccggtgctcgatttagtagctctatcagggtgctgctgaggctgtaggtgctgtccttgctgtcctgctctgtgacactctcctgggatcaccccacttgtcaggctaatacaaacaattaagagatatttaaattggtatcagcagaaaccaaggaaagacccctaaactcctcatctacgatgtatccaatttggaacctcggggtcccatcaaggttcagtggaggcgggaggtgggacagtattttactctcactattagcagcctgcagcctgaagattattgcaacattattactgtacaaacaatatgatgaactgcctccgacatttcggaccaagggaccaggggtggaggtcagacgaactgtggctgcacctatctgtcttcactccttcccgcatcngtaatctctatctgacgcgggtctgggacaaggcgcatagnnnnnnnnn

SEQ ID NO: 95069 - DNA, 626 bp, Homo sapiens
  misc_feature: GYAE6OF02IM714.29.74.G08.1.454.CMB.1.raw
  modified_base (613)..(617): a, c, t, g, unknown or other
  misc_feature (613)..(617): n is a, c, g, or t
  modified_base (619)..(626): a, c, t, g, unknown or other
  misc_feature (619)..(626): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaacgcccctaaactcctcatctacgatgtatccaatttggaacctgggtcccatcaaggttcagtggaggcggaggtgggacagattttactctcactattagcagcctgcagcctgaagatattgcaacattattactgtacaacaatatgatagaactgccctcccgaactagtttccgggaccaaaggggacccgagggggtagggaacgggttaccaagggtaaccggaaaccttgggttacgggccttaggcccaacccgtaatttcccgttaggtttcccttttaccgaactttccccgttttaccccccggacccttaaatttccccgttaaggtaaaaccgtttaccctttccgtttaaacttcccgttaggaacgggcccggggtccttcggggaaccgaaacggggccgtaccgtagttaggctgnnnnngnnnnnnnn

SEQ ID NO: 95070 - DNA, 491 bp, Homo sapiens
  misc_feature: GYAE6OF02JBSLK.29.74.G08.1.454.CMB.1.raw
  modified_base (400)..(400): a, c, t, g, unknown or other
  misc_feature (400)..(400): n is a, c, g, or t
  modified_base (421)..(421): a, c, t, g, unknown or other
  misc_feature (421)..(421): n is a, c, g, or t
  modified_base (480)..(491): a, c, t, g, unknown or other
  misc_feature (480)..(491): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtgggacagtattttactctcactattagcagcctgcagcctgagatattgcaacatattactgtacaacaatatgatgaactgcctcgactagttccggaccaacgggaccaggggtgggagtcgagacgaactggtggctgcacctntctgttcttcattccttcccncctatcctagtaacgtcttctatctggcggcgggcgtggacgtaacgggcgctagtagnnnnnnnnnnnn

SEQ ID NO: 95071 - DNA, 606 bp, Homo sapiens
  misc_feature: GYAE6OF02FHTP6.29.74.G08.1.454.CMB.1.raw
  modified_base (288)..(288): a, c, t, g, unknown or other
  misc_feature (288)..(288): n is a, c, g, or t
  modified_base (589)..(589): a, c, t, g, unknown or other
  misc_feature (589)..(589): n is a, c, g, or t
  modified_base (602)..(606): a, c, t, g, unknown or other
  misc_feature (602)..(606): n is a, c, g, or t
tcagatagagtactcacgaccggtgctcgatttagtagctctatcagggtgctgctgaggctgtaggtgctgtccttgctgtcctgctctgtgacactctcctggggagtcaccctacacttgtcagggctaactcgaaaactattaaggagattattaaagttggtactcagcagaaaccacggaaagcccctaaactccctcgatctacggactcgtatccaatttggaacctggggtcccagtcgaaggttcagttggaggcggaggtgggaacagtattttacnctcgacttatacgcaggccctaggccagcctgaacgatacttcgacaaccagtactacgtgttaccaaactaacgttactggaattggaaactggacccttaccggtaacaggtttccgggacctaaagggggtacctaggggtacgggaacggtccaacggtaccgtaaacgtggtacgggtacttaaggcctaacccgagttcgttcggtccttcacgttcgtacccgtcgtagtcttagaactctactatcgtgaggtcggtctaggccgtaaggccgtagacggtacgagtcgtagntgatgactgtcgnnnnn

SEQ ID NO: 95072 - DNA, 489 bp, Homo sapiens
  misc_feature: GYAE6OF02I691K.29.74.G08.1.454.CMB.1.raw
  modified_base (456)..(456): a, c, t, g, unknown or other
  misc_feature (456)..(456): n is a, c, g, or t
  modified_base (473)..(474): a, c, t, g, unknown or other
  misc_feature (473)..(474): n is a, c, g, or t
  modified_base (476)..(489): a, c, t, g, unknown or other
  misc_feature (476)..(489): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagccctaaactcctcatctacgatgtatccaatttggaacctgggtcccatcaaggttcagtggaggcggaggtgggacagtattttactctcactattagcagcctgcagcctagaagatattgcaacatattactgtaaacaatatgatgaactgcctccgacagttcggacaagggaccagggtggaggtcagacgaactggtacgctgccaccgatcctgtctttcacttcccttccccgctactctagaagttacctctatctgagcgggtcngggcaaggcacgatagnngnnnnnnnnnnnnnn

SEQ ID NO: 95073 - DNA, 504 bp, Homo sapiens
  misc_feature: GYAE6OF02G5786.29.74.G08.1.454.CMB.1.raw
  modified_base (492)..(492): a, c, t, g, unknown or other
  misc_feature (492)..(492): n is a, c, g, or t
  modified_base (496)..(504): a, c, t, g, unknown or other
  misc_feature (496)..(504): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaacgcccctaaactcctcatctacgatgtatccaatttggaacctgggtcccatcaaggttcagtggaggcggaggtgggacagtatttactctcactattagcagcctgcagcctagaagtatagttgacaactattattactagtacaaactaatatgatagtaactcgcctaccgactacgttccggacgaaacgggcccgaaggggtcggaggtacaaggaacgactggtggctgctaccatctagttccttcacttccgttcccgactatctagacgttactctatccgagagtcggctggacaaggcanatgnnnnnnnnn

SEQ ID NO: 95074 - DNA, 479 bp, Homo sapiens
  misc_feature: GYAE6OF02IGY76.29.74.G08.1.454.CMB.1.raw
  modified_base (468)..(479): a, c, t, g, unknown or other
  misc_feature (468)..(479): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagtattttactctcactattagcagcctgcagcctgaagatattgcaacatattactgtacaaacaatatgatgaactgcctccgacagttcggaccaagggaccaggggtggaggtcagacgaactggtggctgcacatctgtcttcattccttcccgctatctagaactctctatctagacggcgggctggacaaggcgacagtagnnnnnnnnnnnn

SEQ ID NO: 95075 - DNA, 568 bp, Homo sapiens
  misc_feature: GYAE6OF02JZ1UX.29.74.G08.1.454.CMB.1.raw
  modified_base (551)..(551): a, c, t, g, unknown or other
  misc_feature (551)..(551): n is a, c, g, or t
  modified_base (553)..(557): a, c, t, g, unknown or other
  misc_feature (553)..(557): n is a, c, g, or t
  modified_base (559)..(559): a, c, t, g, unknown or other
  misc_feature (559)..(559): n is a, c, g, or t
  modified_base (561)..(563): a, c, t, g, unknown or other
  misc_feature (561)..(563): n is a, c, g, or t
  modified_base (565)..(568): a, c, t, g, unknown or other
  misc_feature (565)..(568): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaggttcagtggagggcggaggtgggacagtattttactctcactattagcagcctgcaggcctaggaagtatattgacaacataactttactagtaccaactaaattagtagataggaacttcgcccgttaccactagtttcccggaccgaacgggacccgtaagggggtggacgggtcgaaggaccggtaaacgtgggtacggtcgtggacccaccgagttccgtcgttcttccgattccgttcccccacgtcttcgtacgtaagttacctcttagtcgttaggacgccgggtgtgaccggaacgtcgactacgtgcngnnnnngngnnngnnnn

SEQ ID NO: 95076 - DNA, 465 bp, Homo sapiens
  misc_feature: GYAE6OF02FK4VN.29.74.G08.1.454.CMB.1.raw
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
  modified_base (315)..(315): a, c, t, g, unknown or other
  misc_feature (315)..(315): n is a, c, g, or t
  modified_base (446)..(446): a, c, t, g, unknown or other
  misc_feature (446)..(446): n is a, c, g, or t
  modified_base (452)..(465): a, c, t, g, unknown or other
  misc_feature (452)..(465): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaggttcagtggaggcggaggtggggacagattttacnctcactattagcagcctgcagcctgaagntattgcaacatattacngtcaacaatatgatgaactgcctcgacattcggccaaggggccaggggtgaggtcagacgaactgtggctgcaccatctgtcttcattctcccgcatctgaagtactctatctgagcgggctggcaaggcncatagnnnnnnnnnnnnnn

SEQ ID NO: 95077 - DNA, 547 bp, Homo sapiens
  misc_feature: GYAE6OF02JCI1V.29.74.G08.1.454.CMB.1.raw
  modified_base (449)..(449): a, c, t, g, unknown or other
  misc_feature (449)..(449): n is a, c, g, or t
  modified_base (476)..(476): a, c, t, g, unknown or other
  misc_feature (476)..(476): n is a, c, g, or t
  modified_base (490)..(490): a, c, t, g, unknown or other
  misc_feature (490)..(490): n is a, c, g, or t
  modified_base (528)..(528): a, c, t, g, unknown or other
  misc_feature (528)..(528): n is a, c, g, or t
  modified_base (533)..(533): a, c, t, g, unknown or other
  misc_feature (533)..(533): n is a, c, g, or t
  modified_base (536)..(536): a, c, t, g, unknown or other
  misc_feature (536)..(536): n is a, c, g, or t
  modified_base (540)..(542): a, c, t, g, unknown or other
  misc_feature (540)..(542): n is a, c, g, or t
  modified_base (545)..(547): a, c, t, g, unknown or other
  misc_feature (545)..(547): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaacgacccctaaactcctcatctacgatgtatcctaatttggaacctggggtcccatactaaggtcagtggaggcggaggtgggacagtattttactctcatattagcagcctgcagcctagaagtatattgacaacatattactgtacaactaatatagatagaactcgacctccgaactacgttacggaccgaaacgggacgaggggtagacggtacaacggaactagtggtcggctacgcacctatctgtacttccattcccgttcccnctatccgtagaacgttctctacttcgngggacgtcccgggntacgggacaaacgggtcgaacctaggttacgctcgtanactcncgngcgnnngcnnn

SEQ ID NO: 95078 - DNA, 458 bp, Homo sapiens
  misc_feature: GYAE6OF02F7B0E.29.74.G08.1.454.CMB.1.raw
  modified_base (454)..(458): a, c, t, g, unknown or other
  misc_feature (454)..(458): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttactctcactattagcagcctgcagcctgaagatattgcaacatattactgtacaacaatatgatgaactgcctcgacattcggcaagggaccagggtggaggtcagacgactgtgctgcacatctgtctcattctcccgctatctagaacgttactctatcgtagacgcgggctggcaaggcgcatgnnnnn

SEQ ID NO: 95079 - DNA, 551 bp, Homo sapiens
  misc_feature: GYAE6OF02FSRE2.29.74.G08.1.454.CMB.1.raw
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (541)..(551): a, c, t, g, unknown or other
  misc_feature (541)..(551): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagacccctaaactcctcatctacgatgtatccaatttggaacctggggtcccatcaaggttcaggtggagggcggaggtgggacagattttactctcactattagcagcctgcagcctgaagatattgcaactatattactgtacaaacaatatgatagaactcgccctccgacagttaccggaccaaaggggaccaggggtggaggtacaaggacgtaacgtggtacggctcgacctaaccattcctcggttccttctaactttccctccccgccttaatccgtagtaaacggttacctacttacttccgtggtaacggccggggtcctagggtacgaacgggtcgactacgtagcngntcnnnnnnnnnnn

SEQ ID NO: 95080 - DNA, 523 bp, Homo sapiens
  misc_feature: GYAE6OF02IWW0N.29.74.G08.1.454.CMB.1.raw
  modified_base (509)..(509): a, c, t, g, unknown or other
  misc_feature (509)..(509): n is a, c, g, or t
  modified_base (511)..(514): a, c, t, g, unknown or other
  misc_feature (511)..(514): n is a, c, g, or t
  modified_base (516)..(523): a, c, t, g, unknown or other
  misc_feature (516)..(523): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcaggtggaggcggaggtgggacagtattttactctcactattagcagcctgcagcctagaagatattgaccaacatacttactgtacaacaatatgatagaactgccctaccgactacgttcggaccgaagggaccgtaggggtgggaggtcgaggaacgtactggtggctggcaccagttctgttccttacgacttcccgtttcccgactactctaggtaacttctatactcgtaggcgcgggtgtggaccgaagggcgacagtagcgangnnnngnnnnnnnn

SEQ ID NO: 95081 - DNA, 623 bp, Homo sapiens
  misc_feature: GYAE6OF02HFSM4.29.74.G08.1.454.CMB.1.raw
  modified_base (611)..(615): a, c, t, g, unknown or other
  misc_feature (611)..(615): n is a, c, g, or t
  modified_base (617)..(623): a, c, t, g, unknown or other
  misc_feature (617)..(623): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaaggaaaacgacccctaaactcctcatctacgatgtatacctaatttcggaaccgtcgggtcccatcaaggttcagtggaggcggagggtggacagtattttacgtctacacttattagcacgcctgcagcctagaagatattgacaactattattactgtacaactaatatagatacgaactcgcctaccgactacgttccggaccgaacggggaccgagggggtagggacggtacgaacggaaccgtaacgtgggtacggcgtacggacccaaccgtagttccgttcggtttaccctttaccaaccgtttccccgtttaccccgacctacgttaccgtaacggtaaacgtttaccttccgttaacttccggacgggtaccgggccgggttcgttaccgggaacgtaacggggccgtaacgtagttaacggcagtacnnnnncnnnnnnn

SEQ ID NO: 95082 - DNA, 294 bp, Homo sapiens
  misc_feature: GYAE6OF02HKB49.29.74.G08.1.454.CMB.1.raw
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtggacagattttactctcactattagcagcctgcagcctgaa

SEQ ID NO: 95083 - DNA, 487 bp, Homo sapiens
  misc_feature: GYAE6OF02II445.29.74.G08.1.454.CMB.1.raw
  modified_base (452)..(452): a, c, t, g, unknown or other
  misc_feature (452)..(452): n is a, c, g, or t
  modified_base (460)..(460): a, c, t, g, unknown or other
  misc_feature (460)..(460): n is a, c, g, or t
  modified_base (471)..(471): a, c, t, g, unknown or other
  misc_feature (471)..(471): n is a, c, g, or t
  modified_base (478)..(487): a, c, t, g, unknown or other
  misc_feature (478)..(487): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaagcccctaaactcctcatctacgatgtatccaatttggaacctggggtcccatcaaggttcagtggaggcggaggtggggacagattttactctcactattagcagcctgcagcctgaagatattgacaacatattactgtacaacaatatgatgaactgcctcgacattcggaccaagggaccaggggtggaggtcaggacgtaacgtggtggcttggaccacctatccgtgttccttcgacttccttcccgctattcagaactctctaatcgngagcgggntggcaacggcncagtagnnnnnnnnnn

SEQ ID NO: 95084 - DNA, 606 bp, Homo sapiens
  misc_feature: GYAE6OF02HV2D6.29.74.G08.1.454.CMB.1.raw
  modified_base (593)..(593): a, c, t, g, unknown or other
  misc_feature (593)..(593): n is a, c, g, or t
  modified_base (595)..(606): a, c, t, g, unknown or other
  misc_feature (595)..(606): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcaagaaaccaaggaaaacgcccctaaactcctcatctacgatgtatacctaatttggaaccgtcgggtcccatacaaggttcagtcgggaggcggaggtgggactagtattttactctactatattagcagcctgcagcctagaagtatattgacaacattattactgtacaaactaatatagaatacgaactcgacccttacgactacgttccggaaccgtaacgggaccgtagggggtacggaacggtacgaacggaaccggtaacgttgggtacggaccgttacggacccaaccgtagtttccgtcggtttaccctttactaaccgtttccccgtttacccccgacttacttacgtacggtaaacgttctttacgtattcgtagggacggccgggtcgtaggaacgaagggccagtacgtagctanannnnnnnnnnnn

SEQ ID NO: 95085 - DNA, 588 bp, Homo sapiens
  misc_feature: GYAE6OF02IHEG2.29.74.G08.1.454.CMB.1.raw
  modified_base (569)..(569): a, c, t, g, unknown or other
  misc_feature (569)..(569): n is a, c, g, or t
  modified_base (579)..(585): a, c, t, g, unknown or other
  misc_feature (579)..(585): n is a, c, g, or t
  modified_base (587)..(588): a, c, t, g, unknown or other
  misc_feature (587)..(588): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaagcccctaaactcctcatctacgatgtatccaatttggaacctgggtcccatcaaggttcagtggaggcggaggtggacagattttactctcactattagcagcctgcagcctgaagattattgacaacattattactgtacaactaatatgatgaactgccctaccgactagttcggaccgaagggacccgaggggtaggaggttacgaaggtaaccgaacgttggtacggccttggacctaccgtaacttcgttacggttcctttcaacgtttccgtttcccccgactaacttaccgttagtaaaccggttaccttaccgttaaagttccgttaggaacgggtccggggtacgttcgggaacgtaacgggtccgtactaattcgggtacngagtcagtannnnnnncnn

SEQ ID NO: 95086 - DNA, 596 bp, Homo sapiens
  misc_feature: GYAE6OF02G0YJJ.29.74.G08.1.454.CMB.1.raw
  modified_base (572)..(572): a, c, t, g, unknown or other
  misc_feature (572)..(572): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (595)..(595): a, c, t, g, unknown or other
  misc_feature (595)..(595): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaacgcccctaaactcctcatctacgatgtatcctaatttcggaacctggggtcccagtacgaaggttcaggtgggaggcggaggtgggacagtattttactctctactattagcagtcctgcgacgcctagaagattatgacaactattattactgtacaaacgtaatatagatagaactcgtacctaccgactacgttaccggaccgaacgggaccgtaggggtggacggtcgaacgtacgtaacgtggtggcgtcgacaccgtatcgtacgttccttacgtacttcccgttcccgacctacttacgtacgtaacgttaccttacttacgttcgtacgggacggtaccgggtcgtacgggacgtaacgggtccgacgtacgtagttacgctacncgntnagtctcgctagtcacgtnc

SEQ ID NO: 95087 - DNA, 583 bp, Homo sapiens
  misc_feature: GYAE6OF02HQ0MY.29.74.G08.1.454.CMB.1.raw
  modified_base (215)..(215): a, c, t, g, unknown or other
  misc_feature (215)..(215): n is a, c, g, or t
  modified_base (339)..(339): a, c, t, g, unknown or other
  misc_feature (339)..(339): n is a, c, g, or t
  modified_base (355)..(355): a, c, t, g, unknown or other
  misc_feature (355)..(355): n is a, c, g, or t
  modified_base (488)..(488): a, c, t, g, unknown or other
  misc_feature (488)..(488): n is a, c, g, or t
  modified_base (525)..(525): a, c, t, g, unknown or other
  misc_feature (525)..(525): n is a, c, g, or t
  modified_base (546)..(546): a, c, t, g, unknown or other
  misc_feature (546)..(546): n is a, c, g, or t
  modified_base (570)..(583): a, c, t, g, unknown or other
  misc_feature (570)..(583): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaaagagataatttaaattggtatcagcaagaaaccaaggaaaacgacccctaaaactcctaccactctaacgatntataccaatttaggaaccgttcggggtcccagtaccgtaaaggttcaggtgggagggcgggagggtgggacaggtattttactctcaactatgacagcctggcagtcctagaagtattatcganaacagtaacttacgtntacaaataaatatagactagactcgcctacgactaacgtccggaaccgaaagggggacccaaggggggtacgtaacggacgaaggaaccgaaagttcgggtggtccgcgacaaaccttgtctcgtttcttaancgtttccctcccgacctagttctagtaaacgtacttntaacctgtggaacgggtcggnggttcgacgaaggctacagttgannnnnnnnnnnnnn

SEQ ID NO: 95088 - DNA, 469 bp, Homo sapiens
  misc_feature: GYAE6OF02GYPW6.29.74.G08.1.454.CMB.1.raw
  modified_base (269)..(269): a, c, t, g, unknown or other
  misc_feature (269)..(269): n is a, c, g, or t
  modified_base (406)..(406): a, c, t, g, unknown or other
  misc_feature (406)..(406): n is a, c, g, or t
  modified_base (440)..(440): a, c, t, g, unknown or other
  misc_feature (440)..(440): n is a, c, g, or t
  modified_base (454)..(454): a, c, t, g, unknown or other
  misc_feature (454)..(454): n is a, c, g, or t
  modified_base (460)..(469): a, c, t, g, unknown or other
  misc_feature (460)..(469): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggaggcggaggtgggacagattttacnctcactattagcagcctgcagcctgaagatattgcaacatattactgtacaactaatatgatgaactgcctccgactacttcggccaagggaccaggggtggaggtcagacgacgtgtgctgcaccgatctgtctcntcctcccgcatctgacgtactctatcgtgacggnggcgtgcgaaggcncatagnnnnnnnnnn

SEQ ID NO: 95089 - DNA, 570 bp, Homo sapiens
  misc_feature: GYAE6OF02I4EKG.29.74.G08.1.454.CMB.1.raw
  modified_base (309)..(309): a, c, t, g, unknown or other
  misc_feature (309)..(309): n is a, c, g, or t
  modified_base (519)..(519): a, c, t, g, unknown or other
  misc_feature (519)..(519): n is a, c, g, or t
  modified_base (556)..(556): a, c, t, g, unknown or other
  misc_feature (556)..(556): n is a, c, g, or t
  modified_base (559)..(570): a, c, t, g, unknown or other
  misc_feature (559)..(570): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcgggaggtgggacagtattttactctcacttatagcagcctgcagcctagaagatattgcaanattattactgtacaataatatgatagaactcgacctccgactagttccgggaccgaaggggaccgaggggtgggaacggtacgaaggaaccgtaactgggtaggtacctcgggacaaccctattcctagttccttcgactttccctttccccgccttaacgttcctaggtaaacttaccgtcttacttccggtaggacgggtcccgggtntacggggacccgtaaaggggccctactaagttcgagncgnnnnnnnnnnnn

SEQ ID NO: 95090 - DNA, 510 bp, Homo sapiens
  misc_feature: GYAE6OF02HWBNQ.29.74.G08.1.454.CMB.1.raw
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
  modified_base (383)..(383): a, c, t, g, unknown or other
  misc_feature (383)..(383): n is a, c, g, or t
  modified_base (456)..(456): a, c, t, g, unknown or other
  misc_feature (456)..(456): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (502)..(510): a, c, t, g, unknown or other
  misc_feature (502)..(510): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtccccatcaaggttcagtggaggcggaggtggacagattttactctcactattagnagctgcagcctgagatattgcaacntaattactgtacaactaatatgatgaactgcctcgacacttcggcaagggacctagggtagaggtcagacgaactgnggtctggccacatcgagttcttacacttccgttccccgctatcctgaaacggtacttcgttaacttctacggnggtcggggtcttggggaccaaggtcgactagttagnagntagctgnnnnnnnnn

SEQ ID NO: 95091 - DNA, 590 bp, Homo sapiens
  misc_feature: GYAE6OF02G0WOO.29.74.G08.1.454.CMB.1.raw
  modified_base (580)..(581): a, c, t, g, unknown or other
  misc_feature (580)..(581): n is a, c, g, or t
  modified_base (583)..(590): a, c, t, g, unknown or other
  misc_feature (583)..(590): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaaggttcagtggagggcgggagggtgggacagtattttactctcactattagcagcctgcagcctaggaagattagttgacaacatattactgtacaactaatatgattacgaactcgcctaccggaactagtttccgggaccgtaaacggggacccgtagggggtcgggacgggtcgaagaccgggtaacgtgggtacggcttaggcctaaccgtagtcttcggttcctttcgacttcccgttccccgcctactcgtacgtaacgttaccttactacgttcgtacggacggtccggggtcgttacgggaccgaacgggtccgtacgtagtacggctagtcacgtcgnngnnnnnnnn

SEQ ID NO: 95092 - DNA, 682 bp, Homo sapiens
  misc_feature: GYAE6OF02HEAJU.29.74.G08.1.454.CMB.1.raw
  modified_base (176)..(176): a, c, t, g, unknown or other
  misc_feature (176)..(176): n is a, c, g, or t
  modified_base (363)..(363): a, c, t, g, unknown or other
  misc_feature (363)..(363): n is a, c, g, or t
  modified_base (397)..(397): a, c, t, g, unknown or other
  misc_feature (397)..(397): n is a, c, g, or t
  modified_base (659)..(659): a, c, t, g, unknown or other
  misc_feature (659)..(659): n is a, c, g, or t
  modified_base (663)..(663): a, c, t, g, unknown or other
  misc_feature (663)..(663): n is a, c, g, or t
  modified_base (667)..(667): a, c, t, g, unknown or other
  misc_feature (667)..(667): n is a, c, g, or t
  modified_base (672)..(672): a, c, t, g, unknown or other
  misc_feature (672)..(672): n is a, c, g, or t
  modified_base (680)..(680): a, c, t, g, unknown or other
  misc_feature (680)..(680): n is a, c, g, or t
tcagatagagtactcacgaccggtgctcgatttagtagctctatcgtaggggtgctgcctgaggctggtaggtgctgtccttgctgtcctgctctgtgacactctcgtgggatccaccctcactttgcaggctaatacaaaactattaagagtattaattttaaagtcggtatacncgagacgaaacgaaaccggaaacggaaacccgtaacccgtaactccctaagtacgtacgtagtagtatacctacgttacggtacgtaccggtcgtaccagtacgtagtcgagggtaggacgggaggtacggggtacgaacggttatttacgttacctagtactactatacgcacggttcaggcctanaccgtaaggactagtacgcaactagtaacgtttntaacgactaataacgtatcgagtaactacgacctccggtcctaaccagttaccgggaccggaaacggggtaacggtacggtgggacgtaacgacttaacgacgtacgtagggtacgtacgaccaacgtactagttcgtcgttacttacttccgttacccgtacgtaccgtaagttacgtaacggttaccttaaccgttcgttaccggacgtacgggtacccggtaggttcgaaacggtacgtacgacgtacgtagcgtaagntagnacgncgcgngagcacgncg

SEQ ID NO: 95093 - DNA, 667 bp, Homo sapiens
  misc_feature: GYAE6OF02HZ2KZ.29.74.G08.1.454.CMB.1.raw
  modified_base (284)..(284): a, c, t, g, unknown or other
  misc_feature (284)..(284): n is a, c, g, or t
  modified_base (653)..(653): a, c, t, g, unknown or other
  misc_feature (653)..(653): n is a, c, g, or t
  modified_base (655)..(667): a, c, t, g, unknown or other
  misc_feature (655)..(667): n is a, c, g, or t
tcagatagagtactcacgaccggtgctcgatttagtagctctatcagggtgctgctgaggctgtaggtgctgtccttgctgtcctgctctgtgacactctcctgggagtccaccctcacttgtcaggctaatacaaaacattaaagagtattatttaaattggtatcagcaagaaaccaaggaaacgcccctaaactcctcatctacgatgtatcctaatttcggaacctggggtcccatactaaggtcaggtgggaggcggagggtgggacaggtattttacnctcacttatagcagcctgcagtcctagaaagtattactgactaaactagttaacttacttacgtcctaaaataaattacgtagtaaagtactaaaccgtcgtaaccccgtccggaaactttaacgttcccggggaaaccgtaacggggggaaacccgttaagggggggttaccgggtaagggtaccgtaaacgggtaaaccggttaacgttggggtacccgggttccgtacgacccctaagttaccgttcgtacggttcctttaacacgtttccccgttacccgattactttagacgtaacctttctaaccgtttcgaaccgttgggaccggttccggaacgttccgggagaaccgtcccgatagtcgncnnnnnnnnnnnnn

SEQ ID NO: 95094 - DNA, 642 bp, Homo sapiens
  misc_feature: GYAE6OF02HQU1Z.29.74.G08.1.454.CMB.1.raw
  modified_base (281)..(281): a, c, t, g, unknown or other
  misc_feature (281)..(281): n is a, c, g, or t
  modified_base (630)..(633): a, c, t, g, unknown or other
  misc_feature (630)..(633): n is a, c, g, or t
  modified_base (635)..(636): a, c, t, g, unknown or other
  misc_feature (635)..(636): n is a, c, g, or t
  modified_base (638)..(642): a, c, t, g, unknown or other
  misc_feature (638)..(642): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagattaatttaaattggtatcagcaagaaaccaaggaaaacgacccctaaactcctcatctaacgatgtatccaatttaggaaccgtgggtcccatacgaaggttcagtggaggcggagggtgggacagtattttacnctacacttattagcagcctgcagcctagaagatattgacaacattattactgtacaacaatatgaatagaacctcgaccctaccgactacgttccggaaccgaacgggaccgtaaggggtagggaggtaccgaagaaccgtaacgtcgggtcggtacgtcggacctaaccgtaagttccttcggttaccttttaccgtaaccgtttccccgttttaccccccgacgttaacctttacgttaaccgggtaaaccgtttacccgttaccgtttaaaccgttccgggtcgggtaaccggggtcccggggtacttacggggaccgaaagggtcccgaagtagtaagctggacnnnnanngnnnnn

SEQ ID NO: 95095 - DNA, 645 bp, Homo sapiens
  misc_feature: GYAE6OF02G9AJO.29.74.G08.1.454.CMB.1.raw
  modified_base (622)..(622): a, c, t, g, unknown or other
  misc_feature (622)..(622): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (635)..(635): a, c, t, g, unknown or other
  misc_feature (635)..(635): n is a, c, g, or t
  modified_base (637)..(639): a, c, t, g, unknown or other
  misc_feature (637)..(639): n is a, c, g, or t
  modified_base (642)..(643): a, c, t, g, unknown or other
  misc_feature (642)..(643): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtgggacagtattttactctcactattagcagcctgcagcctgaagatattgacaactattattactgtacaaactaatagttacgaattagaaactcgtacccttaccgaactacgttacccggaccggaaacggggtacccgtaaagggggtgggaacggtaccgaaggaaccggtaaacgttgggtacgggaccgttcgaaccgtaaccctatttcgttacggtttccttaaccgtacgtttccccttttacccccggaccttacgttacccgttaggtaaaccgttaacccttaccttaacgtttcggtacgggaacgggtcccgggtacgttacgggacctaaggggtcccgtatacggtagccgngtagcgngngagngnnnganngc

SEQ ID NO: 95096 - DNA, 567 bp, Homo sapiens
  misc_feature: GYAE6OF02G0MG2.29.74.G08.1.454.CMB.1.raw
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (445)..(445): a, c, t, g, unknown or other
  misc_feature (445)..(445): n is a, c, g, or t
  modified_base (552)..(552): a, c, t, g, unknown or other
  misc_feature (552)..(552): n is a, c, g, or t
  modified_base (554)..(567): a, c, t, g, unknown or other
  misc_feature (554)..(567): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaacgcccctaaactcctcactctacgatgtatcctaagtttcggaaccgtggggttaccccataccgaaggttccaggtgggaggcgggaggtgggaccagtattttacnctcacttattagctagcctncacgccctaggaactattacgttgacctaactattacttactgacctaaataatatgatagaactcgtacctacctactacgttccggaccgtaagggcccgaaggggtggaggtcgaagtaccgaagtgggtagtcncgacctactgtacttgtccttcgacttccgttcccccgactcttctagtaacgttcctacttactcgtacggtaggtcgggagttccggagaccgtgacctgtacgngnnnnnnnnnnnnnn

SEQ ID NO: 95097 - DNA, 638 bp, Homo sapiens
  misc_feature: GYAE6OF02IO716.29.74.G08.1.454.CMB.1.raw
  modified_base (630)..(630): a, c, t, g, unknown or other
  misc_feature (630)..(630): n is a, c, g, or t
  modified_base (632)..(632): a, c, t, g, unknown or other
  misc_feature (632)..(632): n is a, c, g, or t
  modified_base (634)..(636): a, c, t, g, unknown or other
  misc_feature (634)..(636): n is a, c, g, or t
  modified_base (638)..(638): a, c, t, g, unknown or other
  misc_feature (638)..(638): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctggggtcccatcaacggttcagtggaggcgggaggtgggacaggtattttactctcgactattagcagcctgcagccctaggtaagtattattggacaacattatttactagtactaaataatatgatagaactcgtacctccgaacgtacttcggaccgaaacggggacccgaggggtacgggtacgggtaccgaacggtaccggtaaacgtttcgggtagggtaccgtacgtacccgtaaccctaacgtttcgttaccggttccctttacctaacgtttccccgtttaccccgacccgtatttcccgtaaacgtaacgtttacctcttaacgttccgtacgaacgggtccgggtactacggggacctaaacgggcgaacgtacgttaaggctggactgctactgcagngngnnntn

SEQ ID NO: 95098 - DNA, 695 bp, Homo sapiens
  misc_feature: GYAE6OF02FJXXM.29.74.G08.1.454.CMB.1.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
  modified_base (548)..(548): a, c, t, g, unknown or other
  misc_feature (548)..(548): n is a, c, g, or t
  modified_base (669)..(669): a, c, t, g, unknown or other
  misc_feature (669)..(669): n is a, c, g, or t
  modified_base (674)..(674): a, c, t, g, unknown or other
  misc_feature (674)..(674): n is a, c, g, or t
  modified_base (677)..(677): a, c, t, g, unknown or other
  misc_feature (677)..(677): n is a, c, g, or t
  modified_base (690)..(690): a, c, t, g, unknown or other
  misc_feature (690)..(690): n is a, c, g, or t
  modified_base (692)..(692): a, c, t, g, unknown or other
  misc_feature (692)..(692): n is a, c, g, or t
  modified_base (694)..(695): a, c, t, g, unknown or other
  misc_feature (694)..(695): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagtataatttaaattggtatcagacagaaaccaggaaaacgcccctaaatccncatctacatgtactaccaagttttggaacctggggtaccccataccgtaagggttcaggtagggacggggacggtaggggtggggaacagtatttttacncttcaacttattacgcgacgcctgacgacgaccgtagaaagtattattacggaactaactaatttacgtttactacgtaacctaaacgtaaattacgtaggtaactacggtaaacctccggtacccgtacccaacgtaacgttcccgggaacgaacgggggacccggtaaggggacgggtacgggtacgaagggtaacgtaacgtggtacgggtcctcggaccctaacgtacgtccggttcttaccgttacncctttaccccgtccccgtaactccgttcgtacggtaaactttcccttaggttacttaccggtacgggtaccggtaccggggtacggtccggtaccgaacgggttcccgaagtagtaacggntagcncgnagtagagtagagngnann

SEQ ID NO: 95099 - DNA, 625 bp, Homo sapiens
  misc_feature: GYAE6OF02F7FCF.29.74.G08.1.454.CMB.1.raw
  modified_base (308)..(308): a, c, t, g, unknown or other
  misc_feature (308)..(308): n is a, c, g, or t
  modified_base (610)..(610): a, c, t, g, unknown or other
  misc_feature (610)..(610): n is a, c, g, or t
  modified_base (615)..(621): a, c, t, g, unknown or other
  misc_feature (615)..(621): n is a, c, g, or t
  modified_base (623)..(625): a, c, t, g, unknown or other
  misc_feature (623)..(625): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtataccaatttggaacctgggtcccatcaaggttcagtgggaggcggaggtgggactagattttactctcactattagcagcctgcagcctagaagatatcganaacatatctgtacaacaagtatcgatagactcgcctccgaactagtttaccggaccgtaaaggggacccgtaagggggtcggggtaacggtacgaacggtaaccggtaaacggttcggtacggggccgttaagacccgtaaccctagtttccgtacgggtttaccttacgaccttttaacccgttccccccggtacttaactcccgttaagggtaaacgttaccctttaacgtaaccgtttctaccgggtaacggggacccggtgtaccggggtaccgaaaggggtcccagtactaagcgantgacnnnnnnncnnn

SEQ ID NO: 95100 - DNA, 687 bp, Homo sapiens
  misc_feature: GYAE6OF02JVQ59.29.74.G08.1.454.CMB.1.raw
  modified_base (668)..(668): a, c, t, g, unknown or other
  misc_feature (668)..(668): n is a, c, g, or t
  modified_base (679)..(680): a, c, t, g, unknown or other
  misc_feature (679)..(680): n is a, c, g, or t
  modified_base (683)..(687): a, c, t, g, unknown or other
  misc_feature (683)..(687): n is a, c, g, or t
tcagatagagtactcacgaccggtgctcgatttagtagctctatcagggtgcctgctgaggctgtaggtgctgtccttgctgtcctgctctgtgacactctcctgggagtcaccctcacttgtcgaggctaatacaaaacattaagagtataattttaaagttaggtatcacgacaacgaaaccgaagggtaaaacgtaccccttaaaccttcctactaacgtaccgttaaccggattacgtacttaccgtaaagtttaccgggtaaccgttaccggggtacccctaagtaccgtaacggttacgaggttacgggacgggacgggtaggggtacggaccgtaaggttacgttttacctaccgttaccgtaacttacgttaacgccgtaccgtccgttcggacctaccgtaccgtagtaacggtattacgtacgaactaacgtacttaacttacgttacgtacaaactaacgtatacggatacgtaccgtacgtcctaccgaatacggtacggaccgaacgggacggtaggtacggtagtacaaggtacgacgtggcgatcgacctacgacttgtccgtactcgtacgttccctaccgtcgttacctacgtactaccgttactcgatacgagtacggtcggagttacgggacacgtcgatacgggcagngtcagtcagcnngannnnn

SEQ ID NO: 95101 - DNA, 715 bp, Homo sapiens
  misc_feature: GYAE6OF02I7YFU.29.74.G08.1.454.CMB.1.raw
  modified_base (692)..(692): a, c, t, g, unknown or other
  misc_feature (692)..(692): n is a, c, g, or t
  modified_base (695)..(695): a, c, t, g, unknown or other
  misc_feature (695)..(695): n is a, c, g, or t
  modified_base (697)..(697): a, c, t, g, unknown or other
  misc_feature (697)..(697): n is a, c, g, or t
  modified_base (700)..(700): a, c, t, g, unknown or other
  misc_feature (700)..(700): n is a, c, g, or t
  modified_base (704)..(704): a, c, t, g, unknown or other
  misc_feature (704)..(704): n is a, c, g, or t
  modified_base (707)..(707): a, c, t, g, unknown or other
  misc_feature (707)..(707): n is a, c, g, or t
  modified_base (709)..(710): a, c, t, g, unknown or other
  misc_feature (709)..(710): n is a, c, g, or t
  modified_base (712)..(715): a, c, t, g, unknown or other
  misc_feature (712)..(715): n is a, c, g, or t
tcagatagagtactcacgaccggtgctcgatttagtagctctatcagggtgctgctgaggctgtaggtgctgtccttgctgtcctgctctgtgacactctccgtgggagtccaccctctacttgtcaggactaatacaaaactattaagagattaatttaaattggtatacagacaagaaacaaggtaaacgacccctaaactcctacatacgtacgatagtactacttaagttacggaaccgtcgggtacccagtaccgtaaggttcgtaggtcggggagggtacggggtagggtacgggtacgtaaggttactttttaccgcttaaccgtaacgttaagttaccgtcgtacggcccgttcggacctaccgtaccgtaaggtaagtaacgtattaacggactaaactacttaatttactacgtaactaactaagtagttacgaacgttacgtaactccggtaccctaccgtaacgttacggtaaccggaccggtaacggggaccgttaacgggggtacgggacggttacgaacggaaccgtacggttaggtacggccgttacaccgtactacttacgttacgttaccttactacgttcccgttccgaccttacgttaccgaagttaccgttacgttactaccgttacgtcggacggttccggagtccgtaccggaacggacgtctaagtcncgnancgntagngancnncnnnn

SEQ ID NO: 95102 - DNA, 709 bp, Homo sapiens
  misc_feature: GYAE6OF02H0WO2.29.74.G08.1.454.CMB.1.raw
  modified_base (297)..(297): a, c, t, g, unknown or other
  misc_feature (297)..(297): n is a, c, g, or t
  modified_base (674)..(674): a, c, t, g, unknown or other
  misc_feature (674)..(674): n is a, c, g, or t
  modified_base (684)..(684): a, c, t, g, unknown or other
  misc_feature (684)..(684): n is a, c, g, or t
  modified_base (690)..(690): a, c, t, g, unknown or other
  misc_feature (690)..(690): n is a, c, g, or t
tcagatagagtactcacgaccggtgctcgatttagtagctctatcagggtgctgctgaggctgtaggtgctgtccttgctgtcctgctctgtgacactctcctgggagtcaccctcacttgtcaggctaatacaaaaacattaagagattaattttaaagttggtatcagcaagaaaccaggaaaacgcccctaaactcctcattctacgatgtactcctaagtttacggaaccgtcgggtacccatacgtaaggttcaggtggagggtcgggagggtagggactagtacttttacncctactactattagcacgcctgactacgcctagaaacgtagttacgttacgactaacgtaatttaacttacgttcgtaactaaactaaattagtagtacttagaaccttcgtacccctaccgtactacgttaccggaaccggaacgggtacggaggggtacgggtacggtacgaacgggtaaccgtaacgttcgggtcgggtaccttcggaacccctactacgtttccgtacggtttacccttacgttaccctttccccggttccccgtaacttaccgttaacggttaccgtaaaacggttccctttacgtacgttccgggtagggaaccggggttcccgggtacgtacgggtaaacggaggtccgtactagtacgngctagtacgnttaccngtcacgtgactgtcagtgg

SEQ ID NO: 95103 - DNA, 553 bp, Homo sapiens
  misc_feature: GYAE6OF02FIN7U.29.74.G08.1.454.CMB.1.raw
  modified_base (211)..(211): a, c, t, g, unknown or other
  misc_feature (211)..(211): n is a, c, g, or t
  modified_base (269)..(269): a, c, t, g, unknown or other
  misc_feature (269)..(269): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (413)..(413): a, c, t, g, unknown or other
  misc_feature (413)..(413): n is a, c, g, or t
  modified_base (531)..(531): a, c, t, g, unknown or other
  misc_feature (531)..(531): n is a, c, g, or t
  modified_base (540)..(542): a, c, t, g, unknown or other
  misc_feature (540)..(542): n is a, c, g, or t
  modified_base (544)..(546): a, c, t, g, unknown or other
  misc_feature (544)..(546): n is a, c, g, or t
  modified_base (548)..(548): a, c, t, g, unknown or other
  misc_feature (548)..(548): n is a, c, g, or t
  modified_base (550)..(552): a, c, t, g, unknown or other
  misc_feature (550)..(552): n is a, c, g, or t
tcagatagagtactcacgaccggtgctcgatttagtagctctatcagggtgctgctgaggctgtaggtgctgtccttgctgtcctgctctgtgacactctcctggggagtcaccctcacttgtcaggctaatcaaacaaaaattacgagatattaaatggtatcagcagaaaccaggaaacgccccctaaactcctcatctacgatgtacnccaatttggaacctgggtccccatccaggttcagtgaggcgaggtggactgatttacnctcactatagcagcctgcagcctgaagnttattgctaanattacgtactgactaacgatangactcggaacncggccttccggactacgttccgggccgaaacggggcccgtagggggtcaacggtcaacgtaccggaatcggnggcctcgacccgactattcccgttgtaccctttcgaccttcccttcccgacctagtcctaagtaccgttaacctcgttaactcgaggtaccgcgggtctacgacgaggcctacatcgnactgacctnnncnnncncnnnc

SEQ ID NO: 95104 - DNA, 786 bp, Homo sapiens
  misc_feature: GYAE6OF02IW2K0.29.74.G08.1.454.CMB.1.raw
  modified_base (96)..(96): a, c, t, g, unknown or other
  misc_feature (96)..(96): n is a, c, g, or t
  modified_base (116)..(116): a, c, t, g, unknown or other
  misc_feature (116)..(116): n is a, c, g, or t
  modified_base (144)..(144): a, c, t, g, unknown or other
  misc_feature (144)..(144): n is a, c, g, or t
  modified_base (747)..(747): a, c, t, g, unknown or other
  misc_feature (747)..(747): n is a, c, g, or t
  modified_base (769)..(769): a, c, t, g, unknown or other
  misc_feature (769)..(769): n is a, c, g, or t
tcagatagagtactcacgaccggtgctcgatttagtagctctatcagggtgctgctgaggctgtaggtgctgtccttgctgtcctgctctgtgacnctctcgtgggatccaccctnacttgcagctaatacaaatagttaaganattaattttaaacgttggtatacgagacgtaacgaaaccgaacggaaaaccaccccgtaaacttcctactaacttaccgtagtacgttacgttacctaccgttaaagtttaccgggtaaccggtccggggtaccctaaggtaccgttaaacggttccgtagggtacggaacgggtcgggtaaggtgggtaacctagtttaacgttttaccgccgtaacgtaacgttaacggtttacgacgtaccggtccgttacggacctaaccgtaccggttaagaaggttacgtacttaacgactaaacgtactttatttacggactaaacaacgttataacgttcgtaaagtaccgaccgtaccgtaccgtaacccggatttacccggtaccggaaaccgttaaccggtaacggtagggtaccggaacggtacaccgaagttacgtcgtacggtctacgtaccgaaccgttacgtccgttaccgttacttaccgttaccgttacccgtacccgtacgttacgtacgttaaggtaccttaccttacgttactggtaccgtacggtacggtaccggttaacggcgaacccggtgtaaccgtacggataccgngacgactagacgtcgacgtacnctacgtacgtcgatacg

SEQ ID NO: 95105 - DNA, 750 bp, Homo sapiens
  misc_feature: GYAE6OF02FM12Z.29.74.G08.1.454.CMB.1.raw
  modified_base (376)..(376): a, c, t, g, unknown or other
  misc_feature (376)..(376): n is a, c, g, or t
  modified_base (720)..(720): a, c, t, g, unknown or other
  misc_feature (720)..(720): n is a, c, g, or t
  modified_base (726)..(726): a, c, t, g, unknown or other
  misc_feature (726)..(726): n is a, c, g, or t
  modified_base (734)..(734): a, c, t, g, unknown or other
  misc_feature (734)..(734): n is a, c, g, or t
  modified_base (741)..(741): a, c, t, g, unknown or other
  misc_feature (741)..(741): n is a, c, g, or t
  modified_base (748)..(749): a, c, t, g, unknown or other
  misc_feature (748)..(749): n is a, c, g, or t
tcagatagagtactcacgaccggtgctcgatttagtagctctatcagggtgctgctgaggctgtaggtgctgtccttgctgtcctgctctgtgacactctccgtgggatccaccctctacttgtcgaggctaatacaaactattaagagtattaatttaagttgtatacagacaaacggaaaccgaaggtaaacccgtaaccccttaaacctccgtactacttacgtaacgtagttacgtaacttaccgttaaggttttaccggaacccggttaccgggtaccctaacggtacgttaacggttacggtagggtaggggacggggtacgggtagggtacgggaactagttactttacgtctactactagtacgaccngccgtacgactacgtacgtaagtaacgtattacgtagactaacttaagtttaccgttacgtaactaaccgtaacttaagtagtagtacgtaacgtaaccgtccgacccttaaccggattaccgggtaccggtaacgggaacggtaacgggtggggtacgggtacggtaacggaaccggtaacggtacggtacggtcggtaccgtacgtacctacgtcgttacgttacttcctacgttaccttcccgtacccggtcttaacttaccggtataacccgttcgttacttacggtcggtaccgtcggggttccggtacgggtaccggaggtcgtaccgtagtacggtncggtancgtatcgngtatagnctgagannc

SEQ ID NO: 95106 - DNA, 605 bp, Homo sapiens
  misc_feature: GYAE6OF02JTI44.29.74.G08.1.454.CMB.1.raw
  modified_base (512)..(512): a, c, t, g, unknown or other
  misc_feature (512)..(512): n is a, c, g, or t
  modified_base (543)..(543): a, c, t, g, unknown or other
  misc_feature (543)..(543): n is a, c, g, or t
  modified_base (553)..(553): a, c, t, g, unknown or other
  misc_feature (553)..(553): n is a, c, g, or t
  modified_base (584)..(584): a, c, t, g, unknown or other
  misc_feature (584)..(584): n is a, c, g, or t
  modified_base (587)..(587): a, c, t, g, unknown or other
  misc_feature (587)..(587): n is a, c, g, or t
  modified_base (591)..(591): a, c, t, g, unknown or other
  misc_feature (591)..(591): n is a, c, g, or t
  modified_base (595)..(605): a, c, t, g, unknown or other
  misc_feature (595)..(605): n is a, c, g, or t
tcagatagagtactcacgaccggtgctcgatttagtagctctatcagggtgctgctgaggctgtaggtgctgtccttgctgtcctgctctgtgacactctcctgggagtccaccctcacttgtcaggtctaatacaaaacaattaagagtaattaatttaaagttgtatcagacaacgaaacaaggaaaaccgtaccctaaacctcctctatcctacgatagtactacctaattacggtaaccgtccgggtacctatacgtaagttcgaggtagggagggcgggtagggtcggaacgtagtactttacgtcttacacgttatacgcgacgtctagctacgcgtacgaagttactagtacgtacgaactaacttactttacgtacggtacaaacctaataacgtagtaacgtagtaaccgtaccgtacccgtaccgtaacgttacggtccggaaccggaaacgggaccggtagggggtcggaacgtacgaacgtacgacggagtggcacgacnccgatcgtcttctctcttccgtcctactcgntagtatactntactgtcgcggacgtcgacgacggagtcganggntcgntcgnnnnnnnnnnn

SEQ ID NO: 95107 - DNA, 751 bp, Homo sapiens
  misc_feature: GYAE6OF02ISPKT.29.74.G08.1.454.CMB.1.raw
  modified_base (728)..(728): a, c, t, g, unknown or other
  misc_feature (728)..(728): n is a, c, g, or t
  modified_base (733)..(733): a, c, t, g, unknown or other
  misc_feature (733)..(733): n is a, c, g, or t
  modified_base (739)..(739): a, c, t, g, unknown or other
  misc_feature (739)..(739): n is a, c, g, or t
  modified_base (744)..(744): a, c, t, g, unknown or other
  misc_feature (744)..(744): n is a, c, g, or t
  modified_base (748)..(748): a, c, t, g, unknown or other
  misc_feature (748)..(748): n is a, c, g, or t
  modified_base (750)..(750): a, c, t, g, unknown or other
  misc_feature (750)..(750): n is a, c, g, or t
tcagatagagtactcacgaccggtgctcgatttagtagctctatcagggtgctgctgaggctgtaggtgctgtccttgctgtcctgctctgtgacactctccgtgggagtcaccctcacttgtacaggctaaatacaaaaactattaaagaagtattaattttaaaagttggtaactacagaccgaaacgaaaaaccgaaacggtaaaaccggacccccttaaaaacttcctactaacttacgtaacggtataggtaacttaccttaaagtttcggaaaccgtcgggtaccctaagtacgtaacggttcgaggtacgggacggcggtagggtacgacgtaagttaacgtttactcgtaccaagtaagtacgacgtacggcctacgcgtacgtcctaaggaacgtaacttagttagaccctaaagtacgttaaacgtttaactacggtaaactaaaccgtaattagttaacattaacggtaaccctccgtaccgtaccgtaaccgtaacgttacgggaaccgtaaacggggtaccgtaggggtacggtacccgaaggtaacggaaacgtaacggtaggtaacgcgtaacgtaccgaactcgtacgttcttaccggtaacctaacgttcccgtaccgtactacttacgtaaacgtaccgttactacttacgtacgtacggacgtcggggtacctaaggtacgacgggcgtaactacgtagacctgacganagtangtacanagtanacgnana

SEQ ID NO: 95108 - DNA, 149 bp, Homo sapiens
  misc_feature: GYAE6OF01A3KMI.48.55.E11.1.454.CMB.1.raw
  modified_base (149)..(149): a, c, t, g, unknown or other
  misc_feature (149)..(149): n is a, c, g, or t
tcagagtatacatacacgaccggtgctcgatttagcactcgcacgttggttggaccaaggtggaagtcaacgaactgtggctgcaccatctgtcttcatcttcccgccatctgatatgtatactctgagcggctggcaaggcgcatagn

SEQ ID NO: 95109 - DNA, 154 bp, Homo sapiens
  misc_feature: GYAE6OF01ENQD7.48.55.E11.1.454.CMB.1.raw
  modified_base (154)..(154): a, c, t, g, unknown or other
  misc_feature (154)..(154): n is a, c, g, or t
tcagagtatacatacacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagn

SEQ ID NO: 95110 - DNA, 154 bp, Homo sapiens
  misc_feature: GYAE6OF01CKAK0.48.55.E11.1.454.CMB.1.raw
  modified_base (154)..(154): a, c, t, g, unknown or other
  misc_feature (154)..(154): n is a, c, g, or t
tcagagtatacatacacgaccggtgctcgatttagcactcgcacgttgggtttgggaccaaggtggaagtcaaacgaactgtggctgcaccatctgtcttcatctttcccgccatctgatatgtatactctgagcggctggcaaggcgcatagn

SEQ ID NO: 95111 - DNA, 192 bp, Homo sapiens
  misc_feature: GYAE6OF01BBQQP.48.55.E11.1.454.CMB.1.raw
  modified_base (158)..(192): a, c, t, g, unknown or other
  misc_feature (158)..(192): n is a, c, g, or t
tcagagtatacatacacgaccggtgctcgatttagcactcgcacgttgggtttcgggaccaaggtggaagtccaaacgaactgtggcctgcaccatctcgtcttcatcttcccgccatctgatattgtatactctgagcggctggcaaggcgcatagnnnnnnnnnnnnnnnnnnnnnnnnnnnnnnnnnnn

SEQ ID NO: 95112 - DNA, 157 bp, Homo sapiens
  misc_feature: GYAE6OF01BETHH.48.55.E11.1.454.CMB.1.raw
  modified_base (154)..(157): a, c, t, g, unknown or other
  misc_feature (154)..(157): n is a, c, g, or t
tcagagtatacatacacgaccggtgctcgatttagcactcgcacgttgggtttgggaccaaggtggaagtcaaacgaactgtggctgcaccatctgtcttcatcttcccgccatctgatatttatactctgagcgggctggcaaggcgcatagnnnn

SEQ ID NO: 95113 - DNA, 154 bp, Homo sapiens; identical to SEQ ID NO: 95109
  misc_feature: GYAE6OF01C2AWI.48.55.E11.1.454.CMB.1.raw
  modified_base (154)..(154): a, c, t, g, unknown or other
  misc_feature (154)..(154): n is a, c, g, or t

SEQ ID NO: 95114 - DNA, 154 bp, Homo sapiens; identical to SEQ ID NO: 95109
  misc_feature: GYAE6OF01BH62Q.48.55.E11.1.454.CMB.1.raw
  modified_base (154)..(154): a, c, t, g, unknown or other
  misc_feature (154)..(154): n is a, c, g, or t

SEQ ID NO: 95115 - DNA, 155 bp, Homo sapiens
  misc_feature: GYAE6OF01CEYBC.48.55.E11.1.454.CMB.1.raw
  modified_base (154)..(155): a, c, t, g, unknown or other
  misc_feature (154)..(155): n is a, c, g, or t
tcagagtatacatacacgaccggtgctcgatttagcactcgcacgttgggtttgggaccaagttggaagtcaaacgaactgtggctgcaccatctgtcttcatcttcccgccatctgatatgtatactctgagcgggctggcaaggcgcatagnn

SEQ ID NO: 95116 - DNA, 156 bp, Homo sapiens
  misc_feature: GYAE6OF01EK8V4.48.55.E11.1.454.CMB.1.raw
  modified_base (154)..(156): a, c, t, g, unknown or other
  misc_feature (154)..(156): n is a, c, g, or t
tcagagtatacatacacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagnnn

SEQ ID NO: 95117 - DNA, 154 bp, Homo sapiens; identical to SEQ ID NO: 95109
  misc_feature: GYAE6OF01CHDP9.48.55.E11.1.454.CMB.1.raw
  modified_base (154)..(154): a, c, t, g, unknown or other
  misc_feature (154)..(154): n is a, c, g, or t

SEQ ID NO: 95118 - DNA, 154 bp, Homo sapiens
  misc_feature: GYAE6OF01B3CDO.48.55.E11.1.454.CMB.1.raw
  modified_base (153)..(154): a, c, t, g, unknown or other
  misc_feature (153)..(154): n is a, c, g, or t
tcagagtatacatacacgaccggtgctcgatttagcactcgcacgttgggtttgggaccaaggtggaagtcaaacgaactgtggctgcaccatctgtcttcatcttcccgccatctgatatgtatactctgagcggctggcaaggcgcatagnn

SEQ ID NO: 95119 - DNA, 183 bp, Homo sapiens
  misc_feature: GYAE6OF01CSGRP.48.55.E11.1.454.CMB.1.raw
  modified_base (158)..(183): a, c, t, g, unknown or other
  misc_feature (158)..(183): n is a, c, g, or t
tcagagtatacatacacgaccggtgctcgatttagcactcgcacgttgggtttggggaccaaggtggaagtcaaacgaactgtggctgcaccatctgtcttccatcttcccgccatcgtgatatgtatactctgagccggctggcaaggcgcatagcnnnnnnnnnnnnnnnnnnnnnnnnnn

SEQ ID NO: 95120 - DNA, 154 bp, Homo sapiens; identical to SEQ ID NO: 95109
  misc_feature: GYAE6OF01BI3NU.48.55.E11.1.454.CMB.1.raw
  modified_base (154)..(154): a, c, t, g, unknown or other
  misc_feature (154)..(154): n is a, c, g, or t

SEQ ID NO: 95121 - DNA, 154 bp, Homo sapiens; identical to SEQ ID NO: 95109
  misc_feature: GYAE6OF01A0FRY.48.55.E11.1.454.CMB.1.raw
  modified_base (154)..(154): a, c, t, g, unknown or other
  misc_feature (154)..(154): n is a, c, g, or t

SEQ ID NO: 95122 - DNA, 153 bp, Homo sapiens
  misc_feature: GYAE6OF01EPPGD.48.55.E11.1.454.CMB.1.raw
  modified_base (153)..(153): a, c, t, g, unknown or other
  misc_feature (153)..(153): n is a, c, g, or t
tcagagtatacatacacgaccggtgctcgatttagcactcgcacgttgggtttgggaccaaggtggaagtcaaacgaactgtggctgcaccatctgcttcatcttcccgccatctgatatgtatactctgagcgggctggcaaggcgcatagn

SEQ ID NO: 95123 - DNA, 189 bp, Homo sapiens
  misc_feature: GYAE6OF01CQ0HW.48.55.E11.1.454.CMB.1.raw
  modified_base (156)..(189): a, c, t, g, unknown or other
  misc_feature (156)..(189): n is a, c, g, or t
tcagagtatacatacacgaccggtgctcgatttagcactcgcacgttgggtttgggaccgaaggtggaagtcaaacgaactgtggctgcaccatcctgtcttcatcttccgccatctgatatggtatactctgagcgggctggcaaggcgcatagnnnnnnnnnnnnnnnnnnnnnnnnnnnnnnnnnn

SEQ ID NO: 95124 - DNA, 154 bp, Homo sapiens; identical to SEQ ID NO: 95109
  misc_feature: GYAE6OF01BWQD4.48.55.E11.1.454.CMB.1.raw
  modified_base (154)..(154): a, c, t, g, unknown or other
  misc_feature (154)..(154): n is a, c, g, or t

SEQ ID NO: 95125 - DNA, 155 bp, Homo sapiens
  misc_feature: GYAE6OF01E03DJ.48.55.E11.1.454.CMB.1.raw
  modified_base (154)..(155): a, c, t, g, unknown or other
  misc_feature (154)..(155): n is a, c, g, or t
tcagagtatacatacacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagnn

SEQ ID NO: 95126 - DNA, 154 bp, Homo sapiens; identical to SEQ ID NO: 95109
  misc_feature: GYAE6OF01AT0AK.48.55.E11.1.454.CMB.1.raw
  modified_base (154)..(154): a, c, t, g, unknown or other
  misc_feature (154)..(154): n is a, c, g, or t

SEQ ID NO: 95127 - DNA, 154 bp, Homo sapiens; identical to SEQ ID NO: 95109
  misc_feature: GYAE6OF01DRIA7.48.55.E11.1.454.CMB.1.raw
  modified_base (154)..(154): a, c, t, g, unknown or other
  misc_feature (154)..(154): n is a, c, g, or t

SEQ ID NO: 95128 - DNA, 154 bp, Homo sapiens; identical to SEQ ID NO: 95109
  misc_feature: GYAE6OF01C6ZSP.48.55.E11.1.454.CMB.1.raw
  modified_base (154)..(154): a, c, t, g, unknown or other
  misc_feature (154)..(154): n is a, c, g, or t

SEQ ID NO: 95129 - DNA, 601 bp, Homo sapiens
  misc_feature: GYAE6OF01CJW49.48.55.E11.1.454.CMB.1.raw
  modified_base (172)..(172): a, c, t, g, unknown or other
  misc_feature (172)..(172): n is a, c, g, or t
  modified_base (174)..(177): a, c, t, g, unknown or other
  misc_feature (174)..(177): n is a, c, g, or t
  modified_base (179)..(180): a, c, t, g, unknown or other
  misc_feature (179)..(180): n is a, c, g, or t
  modified_base (182)..(182): a, c, t, g, unknown or other
  misc_feature (182)..(182): n is a, c, g, or t
  modified_base (184)..(185): a, c, t, g, unknown or other
  misc_feature (184)..(185): n is a, c, g, or t
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
tcagagtatacatacacgaccggtgctcgatttagcactcgcacgtttggggtttgggggaccaaggtggaaggtcaaacgaactgtggctggcaccatcctgtctttcgactcgttcccgccatctgatactgtactacctctgagcggggctggcgaaggcggccatagncnnnngnncncnnctgctcagcngtcatcacatcnctgncngacagcngtgngtggtagtgactntntctcgtcgacanacatctcgacgacacaccaccactactactactattagtagtacgtacgtacgtaacgtccggtaccgtacgttacggttacgtacgtcgtcgttcgtcgtcgtctaccgtacgtcgtacgacgaccgtaccgtacccgtaccgtaccgtaccgtacgtccgtcgtcggtccgtacgtacgcgtacggacggacggtacggtcgtacgttacgttacgttacgtcgcgtacgtactacttacgttacgtactacgtacgtacgtacgtacgttacgttacgttcgttcggtacggtacggtacggtacgtacgtacgtacgttccgtacgtacgtacgtccgaccgaccg

SEQ ID NO: 95130 - DNA, 169 bp, Homo sapiens
  misc_feature: GYAE6OF01DKJ7Y.48.55.E11.1.454.CMB.1.raw
  modified_base (156)..(169): a, c, t, g, unknown or other
  misc_feature (156)..(169): n is a, c, g, or t
tcagagtatacatacacgaccggtgctcgatttagcactcgcacgttgggtttggggaccaaggtggaagtcaaacgaactgtggctgcaccatctgtcttcatcttcccgccatctgattatgtatactctgagcgggctgggcaaggcgcatgnnnnnnnnnnnnnn

SEQ ID NO: 95131 - DNA, 169 bp, Homo sapiens
  misc_feature: GYAE6OF01COVOT.48.55.E11.1.454.CMB.1.raw
  modified_base (154)..(169): a, c, t, g, unknown or other
  misc_feature (154)..(169): n is a, c, g, or t
tcagagtatacatacacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagnnnnnnnnnnnnnnnn

SEQ ID NO: 95132 - DNA, 154 bp, Homo sapiens; identical to SEQ ID NO: 95109
  misc_feature: GYAE6OF01DH1K5.48.55.E11.1.454.CMB.1.raw
  modified_base (154)..(154): a, c, t, g, unknown or other
  misc_feature (154)..(154): n is a, c, g, or t

SEQ ID NO: 95133 - DNA, 171 bp, Homo sapiens
  misc_feature: GYAE6OF01CATBN.48.55.E11.1.454.CMB.1.raw
  modified_base (122)..(122): a, c, t, g, unknown or other
  misc_feature (122)..(122): n is a, c, g, or t
  modified_base (140)..(140): a, c, t, g, unknown or other
  misc_feature (140)..(140): n is a, c, g, or t
  modified_base (146)..(171): a, c, t, g, unknown or other
  misc_feature (146)..(171): n is a, c, g, or t
tcagagtatacatacacgaccggtgctcgatttagcactcgcacgttggtttggaccaaggtgaagtcaacgactgtggctgcaccatctgtcttcatcttccgcatctgatatgtatactntgagcggctggcaaggcncatagnnnnnnnnnnnnnnnnnnnnnnnnnn

SEQ ID NO: 95134 - DNA, 159 bp, Homo sapiens
  misc_feature: GYAE6OF01EIQX9.48.55.E11.1.454.CMB.1.raw
  modified_base (154)..(159): a, c, t, g, unknown or other
  misc_feature (154)..(159): n is a, c, g, or t
tcagagtatacatacacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagnnnnnn

SEQ ID NO: 95135 - DNA, 158 bp, Homo sapiens
  misc_feature: GYAE6OF01DRXN3.48.55.E11.1.454.CMB.1.raw
  modified_base (155)..(158): a, c, t, g, unknown or other
  misc_feature (155)..(158): n is a, c, g, or t
tcagagtatacatacacgaccggtgctcgatttagcactcgcacgttgggtttgggaccaaggtggaagtcaaacgaactgtggctgcaccatctgtcttcatccttcccgccatctgatatgtatactctgagcgggctggcaaggcgcatagnnnn

SEQ ID NO: 95136 - DNA, 188 bp, Homo sapiens
  misc_feature: GYAE6OF01AX0LO.48.55.E11.1.454.CMB.1.raw
  modified_base (150)..(150): a, c, t, g, unknown or other
  misc_feature (150)..(150): n is a, c, g, or t
  modified_base (157)..(188): a, c, t, g, unknown or other
  misc_feature (157)..(188): n is a, c, g, or t
tcagagtatacatacacgaccggtgctcgatttagcactcgcacggttaggggtttggaccaaggtggaagtcaaacgaactgtggctgcaccgatctgtcttcatcttcccgcatctgatatgtatactctgagcgggctggcaaggcncataggnnnnnnnnnnnnnnnnnnnnnnnnnnnnnnnn

SEQ ID NO: 95137 - DNA, 156 bp, Homo sapiens; identical to SEQ ID NO: 95116
  misc_feature: GYAE6OF01B6XW5.48.55.E11.1.454.CMB.1.raw
  modified_base (154)..(156): a, c, t, g, unknown or other
  misc_feature (154)..(156): n is a, c, g, or t

SEQ ID NO: 95138 - DNA, 154 bp, Homo sapiens
  misc_feature: GYAE6OF01E5BP6.48.55.E11.1.454.CMB.1.raw
  modified_base (148)..(148): a, c, t, g, unknown or other
  misc_feature (148)..(148): n is a, c, g, or t
  modified_base (154)..(154): a, c, t, g, unknown or other
  misc_feature (154)..(154): n is a, c, g, or t
tcagagtatacatacacgaccggtgctcgatttagcactcgcacgttgggtttgggaccaaggtggaagtcaaacgactgtggctgcaccatctgtcttcatcttcccgcatctgatatgtatactctggagcgggctaggcaaggcncatagn

SEQ ID NO: 95139 - DNA, 155 bp, Homo sapiens; identical to SEQ ID NO: 95125
  misc_feature: GYAE6OF01DYIC0.48.55.E11.1.454.CMB.1.raw
  modified_base (154)..(155): a, c, t, g, unknown or other
  misc_feature (154)..(155): n is a, c, g, or t

SEQ ID NO: 95140 - DNA, 157 bp, Homo sapiens
  misc_feature: GYAE6OF01EII3N.48.55.E11.1.454.CMB.1.raw
  modified_base (154)..(157): a, c, t, g, unknown or other
  misc_feature (154)..(157): n is a, c, g, or t
tcagagtatacatacacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagnnnn

SEQ ID NO: 95141 - DNA, 155 bp, Homo sapiens; identical to SEQ ID NO: 95125
  misc_feature: GYAE6OF01ES8VQ.48.55.E11.1.454.CMB.1.raw
  modified_base (154)..(155): a, c, t, g, unknown or other
  misc_feature (154)..(155): n is a, c, g, or t

SEQ ID NO: 95142 - DNA, 154 bp, Homo sapiens; identical to SEQ ID NO: 95109
  misc_feature: GYAE6OF01ELPN3.48.55.E11.1.454.CMB.1.raw
  modified_base (154)..(154): a, c, t, g, unknown or other
  misc_feature (154)..(154): n is a, c, g, or t

SEQ ID NO: 95143 - DNA, 155 bp, Homo sapiens; identical to SEQ ID NO: 95125
  misc_feature: GYAE6OF01AL0K6.48.55.E11.1.454.CMB.1.raw
  modified_base (154)..(155): a, c, t, g, unknown or other
  misc_feature (154)..(155): n is a, c, g, or t

SEQ ID NO: 95144 - DNA, 158 bp, Homo sapiens
  misc_feature: GYAE6OF01EAHJX.48.55.E11.1.454.CMB.1.raw
  modified_base (154)..(158): a, c, t, g, unknown or other
  misc_feature (154)..(158): n is a, c, g, or t
tcagagtatacatacacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagnnnnn

SEQ ID NO: 95145 - DNA, 203 bp, Homo sapiens
  misc_feature: GYAE6OF01DLD1G.48.55.E11.1.454.CMB.1.raw
  modified_base (118)..(118): a, c, t, g, unknown or other
  misc_feature (118)..(118): n is a, c, g, or t
  modified_base (152)..(203): a, c, t, g, unknown or other
  misc_feature (152)..(203): n is a, c, g, or t
tcagagtatacatacacgaccggtgctcgatttagcactcgcacgttgggtttggggaccaaggtggaagtcaaacgactgtggctgcacatctgtcttcatcttcccgcatctgatntgtatactctgagcgggctggcaaggcgcatagnnnnnnnnnnnnnnnnnnnnnnnnnnnnnnnnnnnnnnnnnnnnnnnnnnnn

SEQ ID NO: 95146 - DNA, 152 bp, Homo sapiens
  misc_feature: GYAE6OF02GXZ0P.48.55.E11.1.454.CMB.1.raw
  modified_base (152)..(152): a, c, t, g, unknown or other
  misc_feature (152)..(152): n is a, c, g, or t
tcagagtatacatacacgaccggtgctcgatttagcactcgcacgttgggttgggaccaaggtggaagtcaacgaactgtggctgcaccatctgtcttcatcttcccgccatctgatatgtatactctgagcgggctggcaaggcgcatagn

SEQ ID NO: 95147 - DNA, 155 bp, Homo sapiens; identical to SEQ ID NO: 95125
  misc_feature: GYAE6OF02IHG0A.48.55.E11.1.454.CMB.1.raw
  modified_base (154)..(155): a, c, t, g, unknown or other
  misc_feature (154)..(155): n is a, c, g, or t

SEQ ID NO: 95148 - DNA, 221 bp, Homo sapiens
  misc_feature: GYAE6OF02HF99P.48.55.E11.1.454.CMB.1.raw
  modified_base (220)..(221): a, c, t, g, unknown or other
  misc_feature (220)..(221): n is a, c, g, or t
tcagagtatacatacacgaccggtgctcgatttagcactcgcacgttgggtttggggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnn

SEQ ID NO: 95149 - DNA, 181 bp, Homo sapiens
  misc_feature: GYAE6OF02HM3ZP.48.55.E11.1.454.CMB.1.raw
  modified_base (156)..(181): a, c, t, g, unknown or other
  misc_feature (156)..(181): n is a, c, g, or t
tcagagtatacatacacgaccggtgctcgatttagcactcgcacggttgggtttgggaccaaggtcggaagtcaaacgaactgtggctgcaccatctgtcttcatcttcccgccatctgatatgtatactctgagcgggctggcaaggcgcatagnnnnnnnnnnnnnnnnnnnnnnnnnn

SEQ ID NO: 95150 - DNA, 155 bp, Homo sapiens; identical to SEQ ID NO: 95125
  misc_feature: GYAE6OF02FZTMO.48.55.E11.1.454.CMB.1.raw
  modified_base (154)..(155): a, c, t, g, unknown or other
  misc_feature (154)..(155): n is a, c, g, or t

SEQ ID NO: 95151 - DNA, 163 bp, Homo sapiens
  misc_feature: GYAE6OF02IF3BR.48.55.E11.1.454.CMB.1.raw
  modified_base (155)..(163): a, c, t, g, unknown or other
  misc_feature (155)..(163): n is a, c, g, or t
tcagagtatacatacacgaccggtgctcgatttagcactcgcacgttgggtttgggaccgaaggtggaagtcaaacgaactggtggctgcaccatctgtcttcatcttccgccatctgatatgtatactctgagcgggctggcaaggcgcatagnnnnnnnnn

SEQ ID NO: 95152 - DNA, 176 bp, Homo sapiens
  misc_feature: GYAE6OF02IB0XZ.48.55.E11.1.454.CMB.1.raw
  modified_base (149)..(149): a, c, t, g, unknown or other
  misc_feature (149)..(149): n is a, c, g, or t
  modified_base (155)..(176): a, c, t, g, unknown or other
  misc_feature (155)..(176): n is a, c, g, or t
tcagagtatacatacacgaccggtgctcgatttagcactcgcacgttgggtttgggaccaaggtggaagtcaaacgaactgtggctgcaccatctgtcttcatcttcccgccatctgatatgtatactctgagcgggctggccaaggcncatagnnnnnnnnnnnnnnnnnnnnnn

SEQ ID NO: 95153 - DNA, 165 bp, Homo sapiens
  misc_feature: GYAE6OF02GQX2L.48.55.E11.1.454.CMB.1.raw
  modified_base (153)..(165): a, c, t, g, unknown or other
  misc_feature (153)..(165): n is a, c, g, or t
tcagagtatacatacacgaccggtgctcgatttagcactcgcacgttgggtttgggaccaaggtggaagtcaaacgaactgtggctgcaccatctgtcttcatcttccgccatctgatatgtatactctgagcgggctggcaaggcgcatagnnnnnnnnnnnnn

SEQ ID NO: 95154 - DNA, 196 bp, Homo sapiens
  misc_feature: GYAE6OF02HG510.48.55.E11.1.454.CMB.1.raw
  modified_base (155)..(196): a, c, t, g, unknown or other
  misc_feature (155)..(196): n is a, c, g, or t
tcagagtatacatacacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcattagnnnnnnnnnnnnnnnnnnnnnnnnnnnnnnnnnnnnnnnnnn

SEQ ID NO: 95155 - DNA, 154 bp, Homo sapiens; identical to SEQ ID NO: 95109
  misc_feature: GYAE6OF02FULX5.48.55.E11.1.454.CMB.1.raw
  modified_base (154)..(154): a, c, t, g, unknown or other
  misc_feature (154)..(154): n is a, c, g, or t

SEQ ID NO: 95156 - DNA, 153 bp, Homo sapiens
  misc_feature: GYAE6OF02H00P1.48.55.E11.1.454.CMB.1.raw
tcagagtatacatacacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatag

SEQ ID NO: 95157 - DNA, 164 bp, Homo sapiens
  misc_feature: GYAE6OF02GM21R.48.55.E11.1.454.CMB.1.raw
  modified_base (154)..(164): a, c, t, g, unknown or other
  misc_feature (154)..(164): n is a, c, g, or t
tcagagtatacatacacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagnnnnnnnnnnn

SEQ ID NO: 95158 - DNA, 202 bp, Homo sapiens
  misc_feature: GYAE6OF02HIITJ.48.55.E11.1.454.CMB.1.raw
  modified_base (163)..(202): a, c, t, g, unknown or other
  misc_feature (163)..(202): n is a, c, g, or t
tcagagtatacatacacgaccggtgctcgatttagcactcgcacggttgggtttggggaccaaggtggaacgtcaaacgaacgtgtggctgcaccatctggtccttcatcttcccgccagtctgatatgtatactctgacgcggggctggcaaggcgcatagnnnnnnnnnnnnnnnnnnnnnnnnnnnnnnnnnnnnnnnn

SEQ ID NO: 95159 - DNA, 162 bp, Homo sapiens
  misc_feature: GYAE6OF02IWPGI.48.55.E11.1.454.CMB.1.raw
  modified_base (154)..(162): a, c, t, g, unknown or other
  misc_feature (154)..(162): n is a, c, g, or t
tcagagtatacatacacgaccggtgctcgatttagcactcgcacgttgggtttgggaccaaggtggaagtcaaacgaactgtggctgcaccatctgtcttcatcttcccgccatctgatatgtatactctgagcgggctggcaaggcgcatagnnnnnnnnn

SEQ ID NO: 95160 - DNA, 155 bp, Homo sapiens; identical to SEQ ID NO: 95125
  misc_feature: GYAE6OF02F6XNV.48.55.E11.1.454.CMB.1.raw
  modified_base (154)..(155): a, c, t, g, unknown or other
  misc_feature (154)..(155): n is a, c, g, or t

SEQ ID NO: 95161 - DNA, 154 bp, Homo sapiens; identical to SEQ ID NO: 95109
  misc_feature: GYAE6OF02GJV9Q.48.55.E11.1.454.CMB.1.raw
  modified_base (154)..(154): a, c, t, g, unknown or other
  misc_feature (154)..(154): n is a, c, g, or t

SEQ ID NO: 95162 - DNA, 218 bp, Homo sapiens
  misc_feature: GYAE6OF02GFATT.48.55.E11.1.454.CMB.1.raw
  modified_base (157)..(157): a, c, t, g, unknown or other
  misc_feature (157)..(157): n is a, c, g, or t
  modified_base (159)..(218): a, c, t, g, unknown or other
  misc_feature (159)..(218): n is a, c, g, or t
tcagagtatacatacacgaccggtgctcgatttagcactcgcacgttgggtttggaccaaggtggaagtcaaacggaactgtggctgcaccatctgtccttcatcttcccgccatctgatatgtatactctgagccgggctgggcaaggcgcatagncnnnnnnnnnnnnnnnnnnnnnnnnnnnnnnnnnnnnnnnnnnnnnnnnnnnnnnnnnnnn

SEQ ID NO: 95163 - DNA, 154 bp, Homo sapiens; identical to SEQ ID NO: 95109
  misc_feature: GYAE6OF02GLNGD.48.55.E11.1.454.CMB.1.raw
  modified_base (154)..(154): a, c, t, g, unknown or other
  misc_feature (154)..(154): n is a, c, g, or t

SEQ ID NO: 95164 - DNA, 155 bp, Homo sapiens; identical to SEQ ID NO: 95125
  misc_feature: GYAE6OF02FG0SP.48.55.E11.1.454.CMB.1.raw
  modified_base (154)..(155): a, c, t, g, unknown or other
  misc_feature (154)..(155): n is a, c, g, or t

SEQ ID NO: 95165 - DNA, 154 bp, Homo sapiens; identical to SEQ ID NO: 95109
  misc_feature: GYAE6OF02GJ1XJ.48.55.E11.1.454.CMB.1.raw
  modified_base (154)..(154): a, c, t, g, unknown or other
  misc_feature (154)..(154): n is a, c, g, or t

SEQ ID NO: 95166 - DNA, 154 bp, Homo sapiens; identical to SEQ ID NO: 95109
  misc_feature: GYAE6OF02H87GN.48.55.E11.1.454.CMB.1.raw
  modified_base (154)..(154): a, c, t, g, unknown or other
  misc_feature (154)..(154): n is a, c, g, or t

SEQ ID NO: 95167 - DNA, 154 bp, Homo sapiens; identical to SEQ ID NO: 95109
  misc_feature: GYAE6OF02G7BHT.48.55.E11.1.454.CMB.1.raw
  modified_base (154)..(154): a, c, t, g, unknown or other
  misc_feature (154)..(154): n is a, c, g, or t

SEQ ID NO: 95168 - DNA, 154 bp, Homo sapiens; identical to SEQ ID NO: 95109
  misc_feature: GYAE6OF02G11K2.48.55.E11.1.454.CMB.1.raw
  modified_base (154)..(154): a, c, t, g, unknown or other
  misc_feature (154)..(154): n is a, c, g, or t

SEQ ID NO: 95169 - DNA, 222 bp, Homo sapiens
  misc_feature: GYAE6OF02H0DMM.48.55.E11.1.454.CMB.1.raw
  modified_base (220)..(222): a, c, t, g, unknown or other
  misc_feature (220)..(222): n is a, c, g, or t
tcagagtatacatacacgaccggtgctcgatttagcactcgcacgttgggtttggggccaagggacaacggtcaccgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnn

SEQ ID NO: 95170 - DNA, 153 bp, Homo sapiens; identical to SEQ ID NO: 95156
  misc_feature: GYAE6OF02JACL6.48.55.E11.1.454.CMB.1.raw

SEQ ID NO: 95171 - DNA, 154 bp, Homo sapiens; identical to SEQ ID NO: 95109
  misc_feature: GYAE6OF02G1WIQ.48.55.E11.1.454.CMB.1.raw
  modified_base (154)..(154): a, c, t, g, unknown or other
  misc_feature (154)..(154): n is a, c, g, or t

SEQ ID NO: 95172 - DNA, 214 bp, Homo sapiens
  misc_feature: GYAE6OF02FV4LY.48.55.E11.1.454.CMB.1.raw
  modified_base (164)..(214): a, c, t, g, unknown or other
  misc_feature (164)..(214): n is a, c, g, or t
tcagagtatacatacacgaccggtgctcgatttagcactcgcacgttgggtttgggaccaaggtggaagtacaaacgaacctggtggctgcaccatctgtcttcatcttcccgccatcttgattatggtatactcgtgagcgggctgggcaacggcgcagtagnnnnnnnnnnnnnnnnnnnnnnnnnnnnnnnnnnnnnnnnnnnnnnnnnnn

SEQ ID NO: 95173 - DNA, 257 bp, Homo sapiens
  misc_feature: GYAE6OF01EHYR7.36.55.E11.1.454.CMB.1.raw
  modified_base (253)..(257): a, c, t, g, unknown or other
  misc_feature (253)..(257): n is a, c, g, or t
tcagtacgctgtctcacgaccggtgctcgatttagcactcgcacgttgggtctgggacagacttcactctcaccatcagcagactggagcctgaagattttgcagtgtattactgtcagcagtatggtagctcaccattcactttcggccctgggaccaaagtggatatcaaacgaactgtggctgcaccatctgtcttcatcttcccgccatctgaagacagcgtactgagcgggctggcaaggcgcatagnnnnn

SEQ ID NO: 95174 - DNA, 257 bp, Homo sapiens
  misc_feature: GYAE6OF01B26Z1.36.55.E11.1.454.CMB.1.raw
  modified_base (251)..(257): a, c, t, g, unknown or other
  misc_feature (251)..(257): n is a, c, g, or t
tcagtacgctgtctcacgaccggtgctcgatttagcactcgcacgttgggtctgggacagacttcactctcaccatcagcagactggagcctgaagattttgcagtgtattactgtcagcagtatggtagctcaccattcactttcggccctgggaccaaagtggatatcaaacgactgtggctgcaccatctgtcttcatcttcccgcatctgaagacagcgtactgagcgggctggcaaggcgcatagnnnnnnn

SEQ ID NO: 95175 - DNA, 172 bp, Homo sapiens
  misc_feature: GYAE6OF01DEXK4.36.55.E11.1.454.CMB.1.raw
  modified_base (170)..(172): a, c, t, g, unknown or other
  misc_feature (170)..(172): n is a, c, g, or t
tcagtacgctgtctcacgaccggtgctcgatttagcactcgcacgttgggtttgggaagaggaagactgacggtccccaggagttcaggtgctgggcacagcggccctgggctgcctggtcaaggactacttccagacagcgtactgagcgggctggcaaggcgcatagnnn

SEQ ID NO: 95176 - DNA, 174 bp, Homo sapiens
  misc_feature: GYAE6OF01CQRH8.36.55.E11.1.454.CMB.1.raw
  modified_base (173)..(174): a, c, t, g, unknown or other
  misc_feature (173)..(174): n is a, c, g, or t
tcagtacgctgtctcacgaccggtgctcgatttagcactcgcacgttgggtttgggggaagaggaagactgacggtcccccaggagttcaggtgctgggcacagcggccctgggctgcctggtcaaggactacttccagacagcgtactgagcgggctggcaaggcgcatagnn

SEQ ID NO: 95177 - DNA, 185 bp, Homo sapiens
  misc_feature: GYAE6OF01EXMMJ.36.55.E11.1.454.CMB.1.raw
  modified_base (174)..(185): a, c, t, g, unknown or other
  misc_feature (174)..(185): n is a, c, g, or t
tcagtacgctgtctcacgaccggtgctcgatttagcactcgcacgttgggtttgggggaagaggaagactgaccggtcccccaggagttcaggtgctgggcacagcggccctgggctgcctggtcaaggactacttccagacagcgtactgagcgggctggcaaggcgcatagnnnnnnnnnnnn

SEQ ID NO: 95178 - DNA, 255 bp, Homo sapiens
  misc_feature: GYAE6OF01C1USM.36.55.E11.1.454.CMB.1.raw
  modified_base (251)..(255): a, c, t, g, unknown or other
  misc_feature (251)..(255): n is a, c, g, or t
tcagtacgctgtctcacgaccggtgctcgatttagcactcgcacgttgggtctgggacagacttcactctcaccatcagcagactggagcctgaagattttgcagtgtattactgtcagcagtatggtagctcaccattcactttcggccctgggaccaaagtgatatcaaacgaactgtggctgcaccatctgtcttcatcttcccgcatctgaagacagcgtactgagcgggctggcaaggcgcatagnnnnn

SEQ ID NO: 95179 - DNA, 181 bp, Homo sapiens
  misc_feature: GYAE6OF01EO5M9.36.55.E11.1.454.CMB.1.raw
  modified_base (173)..(181): a, c, t, g, unknown or other
  misc_feature (173)..(181): n is a, c, g, or t
tcagtacgctgtctcacgaccggtgctcgatttagcactcgcacgttgggtttgggggaagaggaagactgacggtcccccaggagttcaggtgctgggcacagcggccctgggctgcctggtcaaggactacttccagacagcgtactgagcgggctggcaaggcgcatagnnnnnnnnn

SEQ ID NO: 95180 - DNA, 195 bp, Homo sapiens
  misc_feature: GYAE6OF01EVPXP.36.55.E11.1.454.CMB.1.raw
  modified_base (176)..(195): a, c, t, g, unknown or other
  misc_feature (176)..(195): n is a, c, g, or t
tcagtacgctgtctcacgaccggtgctcgatttagcactcgcacgttgggtttggggggaagaggaagactgacggtcccccaggagttcaggtgctgggccacacgcggccctgggctgcctggtcaaggctacttccagacagcgtactggagcgggctggcaaggcgcatagnnnnnnnnnnnnnnnnnnnn

SEQ ID NO: 95181 - DNA, 174 bp, Homo sapiens; identical to SEQ ID NO: 95176
  misc_feature: GYAE6OF01DR610.36.55.E11.1.454.CMB.1.raw
  modified_base (173)..(174): a, c, t, g, unknown or other
  misc_feature (173)..(174): n is a, c, g, or t

SEQ ID NO: 95182 - DNA, 181 bp, Homo sapiens
  misc_feature: GYAE6OF01A3R3H.36.55.E11.1.454.CMB.1.raw
  modified_base (174)..(181): a, c, t, g, unknown or other
  misc_feature (174)..(181): n is a, c, g, or t
tcagtacgctgtctcacgaccggtgctcgatttagcactcgcacgttgggtttgggggaagaggaagactgaccggtcccccaggagttcaggtgctgggcacagcggcctgggctgcctggtcaaggactactccagacagcgtactgagcgggctggacaaggcgacatagnnnnnnnn

SEQ ID NO: 95183 - DNA, 190 bp, Homo sapiens
  misc_feature: GYAE6OF01C98TT.36.55.E11.1.454.CMB.1.raw
  modified_base (175)..(190): a, c, t, g, unknown or other
  misc_feature (175)..(190): n is a, c, g, or t
tcagtacgctgtctcacgaccggtgctcgatttagcactcgcacgttgggtttggggggaagaggaagactgacggtccccccaggagttcaggtgctgggcacagcgccctgggctgcctggtcaaggctacttccagacagcgtactgagcgggctggcaaggcgacataagnnnnnnnnnnnnnnnn

SEQ ID NO: 95184 - DNA, 172 bp, Homo sapiens
  misc_feature: GYAE6OF02IPKHT.36.55.E11.1.454.CMB.1.raw
  modified_base (170)..(172): a, c, t, g, unknown or other
  misc_feature (170)..(172): n is a, c, g, or t
tcagtacgctgtctcacgaccggtgctcgatttagcactcgcacgttgggttggggaagaggaagactgacggtccccaggagttcaggtgctgggcacagcggccctgggctgcctggtcaaggactacttccagacagcgtactgagcgggctggcaaggcgcatagnnn

SEQ ID NO: 95185 - DNA, 195 bp, Homo sapiens
  misc_feature: GYAE6OF02FJKQM.36.55.E11.1.454.CMB.1.raw
  modified_base (173)..(195): a, c, t, g, unknown or other
  misc_feature (173)..(195): n is a, c, g, or t
tcagtacgctgtctcacgaccggtgctcgatttagcactcgcacgttgggtttgggggaagaggaagactgacggtcccccaggagttcaggtgctgggcacagcggcctggctgcctggtcaaggactacttccagacgagcgtactgagcgggctggcaaggcgcatagannnnnnnnnnnnnnnnnnnnnnn

SEQ ID NO: 95186 - DNA, 172 bp, Homo sapiens
  misc_feature: GYAE6OF02GH7HN.36.55.E11.1.454.CMB.1.raw
  modified_base (171)..(172): a, c, t, g, unknown or other
  misc_feature (171)..(172): n is a, c, g, or t
tcagtacgctgtctcacgaccggtgctcgatttagcactcgcacgttgggtttggggaagaggaagactgacggtccccaggagttcaggtgctgggcacagcggccctgggctgcctggtcaaggactacttccagacagcgtactgagcgggctggcaaggcgcatagnn

SEQ ID NO: 95187 - DNA, 255 bp, Homo sapiens
  misc_feature: GYAE6OF02FL7GV.36.55.E11.1.454.CMB.1.raw
  modified_base (251)..(255): a, c, t, g, unknown or other
  misc_feature (251)..(255): n is a, c, g, or t
tcagtacgctgtctcacgaccggtgctcgatttagcactcgcacgttgggtctgggacagacttcactctcaccatcagcagactggagcctgaagatttgcagtgtattactgtcagcagtatggtagctcaccattcactttcggccctgggaccaagtggatatcaaacgaactgtggctgcaccatctgtcttcatcttcccgccatctgaagacagcgtactgagcgggctggcaaggcgcatagnnnnn

SEQ ID NO: 95188 - DNA, 209 bp, Homo sapiens
  misc_feature: GYAE6OF02G93HP.36.55.E11.1.454.CMB.1.raw
  modified_base (177)..(180): a, c, t, g, unknown or other
  misc_feature (177)..(180): n is a, c, g, or t
  modified_base (182)..(209): a, c, t, g, unknown or other
  misc_feature (182)..(209): n is a, c, g, or t
tcagtacgctgtctcacgaccggtgctcgatttagcactcgcacgttagggtttagggggaagaggaagactgacggtcccccaggagttcaggtgctgggtcacagcggccctgggctgcctggtcaaggactacttccagacagcgtactgagcgggcctggcaaggcgcatagnnnngnnnnnnnnnnnnnnnnnnnnnnnnnnnn

SEQ ID NO: 95189 - DNA, 282 bp, Homo sapiens
  misc_feature: GYAE6OF02IE10U.36.55.E11.1.454.CMB.1.raw
  modified_base (257)..(282): a, c, t, g, unknown or other
  misc_feature (257)..(282): n is a, c, g, or t
tcagtacgctgtctcacgaccggtgctcgatttagcactcgcacgttggggtcgtgggactagacttcactctcaccatcagcagactggagcctgaagatttgcagtgtattactgtcagcagtatggtagctcaccattcaactttcggcccctagggaccaaagtggatatcaaacgaactgtggctgcaccatctgtcttcatcttcccgcatctgaagacagcgtactgagcgggctggcaaggcgcatagnnnnnnnnnnnnnnnnnnnnnnnnnn

SEQ ID NO: 95190 - DNA, 256 bp, Homo sapiens
  misc_feature: GYAE6OF02IY0Z4.36.55.E11.1.454.CMB.1.raw
  modified_base (254)..(256): a, c, t, g, unknown or other
  misc_feature (254)..(256): n is a, c, g, or t
tcagtacgctgtctcacgaccggtgctcgatttagcactcgcacgttgggtctgggacagacttcactctcaccatcagcagactggagcctgaagattttgcagtgtattactgtcagcagtatggtagctcaccattcactttcggccctgggaccaaagtggatatcaaacgaactgtggctgcaccatctgtcttcatccttcccgccatctgaagacagcgtactgagcgggctggcaaggcgcatagnnn

SEQ ID NO: 95191 - DNA, 176 bp, Homo sapiens
  misc_feature: GYAE6OF02JO54R.36.55.E11.1.454.CMB.1.raw
  modified_base (167)..(176): a, c, t, g, unknown or other
  misc_feature (167)..(176): n is a, c, g, or t
tcagtacgctgtctcacgaccggtgctcgatttagcactcgcacgttgggtttggggaagaggaagactgacggtccccaggagttcaggtgctgggcacagcggcctggctgcctggtcaaggctacttccagacagcgtactgagcggctggcaaggcgcatagnnnnnnnnnn

SEQ ID NO: 95192 - DNA, 257 bp, Homo sapiens
  misc_feature: GYAE6OF02GNW9G.36.55.E11.1.454.CMB.1.raw
  modified_base (252)..(257): a, c, t, g, unknown or other
  misc_feature (252)..(257): n is a, c, g, or t
tcagtacgctgtctcacgaccggtgctcgatttagcactcgcacgttgggtctgggacagacttcactctcaccatcagcagactggagcctgaagattttgcagtgtattactgtcagcagtatggtagctcaccattcactttcggccctgggaccaaagtggatatcaaacgaactgtggctgcaccatctgtcttcatcttcccgcatctgaagacagcgtactgagcgggctggcaaggcgcatagnnnnnn

SEQ ID NO: 95193 - DNA, 278 bp, Homo sapiens
  misc_feature: GYAE6OF02JJXMI.36.55.E11.1.454.CMB.1.raw
  modified_base (255)..(258): a, c, t, g, unknown or other
  misc_feature (255)..(258): n is a, c, g, or t
  modified_base (260)..(262): a, c, t, g, unknown or other
  misc_feature (260)..(262): n is a, c, g, or t
  modified_base (264)..(278): a, c, t, g, unknown or other
  misc_feature (264)..(278): n is a, c, g, or t
tcagtacgctgtctcacgaccggtgctcgatttagcactcgcacgttgggtctgggacagacttcactctcaccatcagcagactggagcctgaagattttgcagtgtattactgtcagcagtatggtagctcaccattcactttcggccctgggaccaaagtggatatcaaacgactgtggctgcaccatctgtcttcagtcttcccgcatctagaagcagtcgtactgacgcgggtctggcaaggcgcatagnnnngnnnannnnnnnnnnnnnnn

SEQ ID NO: 95194 - DNA, 187 bp, Homo sapiens
  misc_feature: GYAE6OF02JI556.36.55.E11.1.454.CMB.1.raw
  modified_base (175)..(187): a, c, t, g, unknown or other
  misc_feature (175)..(187): n is a, c, g, or t
tcagtacgctgtctcacgaccggtgctcgatttagcactcgcacgttgggtttggggggaagaggaagactgacggtccccccaggagttcaggtgctgggcacagcggccctgggctgcctggtcaaggactacttccagacagcgtactgagcgggctggcaaggcgcatagnnnnnnnnnnnnn

SEQ ID NO: 95195 - DNA, 261 bp, Homo sapiens
  misc_feature: GYAE6OF01CH7LX.29.83.H06.1.454.CMB.1.raw
  modified_base (250)..(250): a, c, t, g, unknown or other
  misc_feature (250)..(250): n is a, c, g, or t
  modified_base (256)..(261): a, c, t, g, unknown or other
  misc_feature (256)..(261): n is a, c, g, or t
tcagatagagtactcacgaccggtgctcgatttagatcacgtgcgtcgcgggaagatgaagacagatttcgccctcaccatcaacagtctgcaacctgaagattttgcagtttattactgtcaacacagttacagtacccctcggacgttcggccaagggaccaaggtagaaatcaagcgaactgtggctgcaccatctgtcttcatcttccgcatctgaagtactctatctgagcgggctggcaaggcncatagnnnnnn

SEQ ID NO: 95196 - DNA, 151 bp, Homo sapiens
  misc_feature: GYAE6OF01EKPWZ.29.83.H06.1.454.CMB.1.raw
  modified_base (149)..(151): a, c, t, g, unknown or other
  misc_feature (149)..(151): n is a, c, g, or t
tcagatagagtactcacgaccggtgctcgatttagatcacgtgcgtcgcgggacacgactggagattaaacgaactgtggctgcaccatctgtcttcatcttcccgcatctgatatgtatactctgagcgggctggcaaggcgcatagnnn

SEQ ID NO: 95197 - DNA, 165 bp, Homo sapiens
  misc_feature: GYAE6OF01CBRK5.29.83.H06.1.454.CMB.1.raw
  modified_base (151)..(165): a, c, t, g, unknown or other
  misc_feature (151)..(165): n is a, c, g, or t
tcagatagagtactcacgaccggtgctcgatttagatcacgtgcgtcgcgggacacgactggagattaaacgaactgtggctgcaccatctgtcttcatcttcccgccatctgactatgtatactctgagcgggctggcaaggcgcatagnnnnnnnnnnnnnnn

SEQ ID NO: 95198 - DNA, 159 bp, Homo sapiens
  misc_feature: GYAE6OF01ATLEZ.29.83.H06.1.454.CMB.1.raw
  modified_base (150)..(159): a, c, t, g, unknown or other
  misc_feature (150)..(159): n is a, c, g, or t
tcagatagagtactcacgaccggtgctcgatttagatcacgtgcgtcgcgggacacgactggagattaaacgaactgtggctgcaccatctgtcttcatcttcccgccatctgatatgtatactctgagcgggctggcaaggcgcatagnnnnnnnnnn

SEQ ID NO: 95199 - DNA, 164 bp, Homo sapiens
  misc_feature: GYAE6OF01E26WD.29.83.H06.1.454.CMB.1.raw
  modified_base (150)..(164): a, c, t, g, unknown or other
  misc_feature (150)..(164): n is a, c, g, or t
tcagatagagtactcacgaccggtgctcgatttagatcacgtgcgtcgcgggacacgactggagattaaacgaactgtggctgcaccatctgtcttcatcttcccgccatctgatatgtatactctgagcgggctggcaaggcgcatagnnnnnnnnnnnnnnn

SEQ ID NO: 95200 - DNA, 151 bp, Homo sapiens
  misc_feature: GYAE6OF01CEQAC.29.83.H06.1.454.CMB.1.raw
  modified_base (151)..(151): a, c, t, g, unknown or other
  misc_feature (151)..(151): n is a, c, g, or t
tcagatagagtactcacgaccggtgctcgatttagatcacgtgcgtccgcgggacacgactggagattaaacgaactgtggctgcaccatctgtcttcatcttcccgccatctgaagtactctatctgagcgggctggcaaggcgcatagn

SEQ ID NO: 95201 - DNA, 257 bp, Homo sapiens
  misc_feature: GYAE6OF01CFE67.29.83.H06.1.454.CMB.1.raw
  modified_base (257)..(257): a, c, t, g, unknown or other
  misc_feature (257)..(257): n is a, c, g, or t
tcagatagagtactcacgaccggtgctcgatttagatcacgtgcgtcgcgggaagatgaagacagatttcgccctcaccatcaacagtctgcaacctgaagattttgcagtttattactgtcaacacagttacagtacccctcggacgttcggccaagggaccaaggtagaaatcaagcgaactgtggctgcaccatctgtcttcatcttcccgcatctgaagtactctatctgagcgggctggcaaggcgcatagn

SEQ ID NO: 95202 - DNA, 153 bp, Homo sapiens
  misc_feature: GYAE6OF01BDFIW.29.83.H06.1.454.CMB.1.raw
  modified_base (151)..(153): a, c, t, g, unknown or other
  misc_feature (151)..(153): n is a, c, g, or t
tcagatagagtactcacgaccggtgctcgatttagatcacgtgcgtccgcgggacacgactggagattaaacgaactgtggctgcaccatctgtcttcatcttcccgccatctgaagtactctatctgagcgggctggcaaggcgcatagnnn

SEQ ID NO: 95203 - DNA, 149 bp, Homo sapiens
  misc_feature: GYAE6OF01CVQYS.29.83.H06.1.454.CMB.1.raw
  modified_base (149)..(149): a, c, t, g, unknown or other
  misc_feature (149)..(149): n is a, c, g, or t
tcagatagagtactcacgaccggtgctcgatttagatcacgtgcgtcgcgggacacgactggagattaaacgaactgtggctgcaccatctgtcttcatcttcccgccatctgatatgtatactctgagcggctggcaaggcgcatagn

SEQ ID NO: 95204 - DNA, 160 bp, Homo sapiens
  misc_feature: GYAE6OF01EG6A9.29.83.H06.1.454.CMB.1.raw
  modified_base (151)..(160): a, c, t, g, unknown or other
  misc_feature (151)..(160): n is a, c, g, or t
tcagatagagtactcacgaccggtgctcgatttagatcacgtgcgtccgcgggacacgactggagattaaacgaactgtggctgcaccatctgtcttcatcttcccgccatctgaagtactctatctgagcgggctggcaaggcgcatagnnnnnnnnnn

SEQ ID NO: 95205 - DNA, 355 bp, Homo sapiens
  misc_feature: GYAE6OF01BY3GW.29.83.H06.1.454.CMB.1.raw
  modified_base (228)..(228): a, c, t, g, unknown or other
  misc_feature (228)..(228): n is a, c, g, or t
  modified_base (265)..(265): a, c, t, g, unknown or other
  misc_feature (265)..(265): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (287)..(291): a, c, t, g, unknown or other
  misc_feature (287)..(291): n is a, c, g, or t
  modified_base (293)..(293): a, c, t, g, unknown or other
  misc_feature (293)..(293): n is a, c, g, or t
  modified_base (296)..(355): a, c, t, g, unknown or other
  misc_feature (296)..(355): n is a, c, g, or t
tcagatagagtactcacgaccggtgctcgatttagatcacgtgcggtcgcgggggaagatggaaggacagatttcgccctcgaccatcaacagtctgcgaacctgaagatttttgccagttttacttacctgtcaacacgagttacaggtaccccctgggaccgttcggccaaggggacccaagggtagaaatcaaagcgaacctgtggctggcaccagtctgtcttnatccttcccgccatctgaagtctctatctgagcgggntggcaaggcncatacggnacannnnnancannnnnnnnnnnnnnnnnnnnnnnnnnnnnnnnnnnnnnnnnnnnnnnnnnnnnnnnnnnn

SEQ ID NO: 95206 - DNA, 258 bp, Homo sapiens
  misc_feature: GYAE6OF01BD4PR.29.83.H06.1.454.CMB.1.raw
  modified_base (257)..(258): a, c, t, g, unknown or other
  misc_feature (257)..(258): n is a, c, g, or t
tcagatagagtactcacgaccggtgctcgatttagatcacgtgcgtcgcgggaagatgaagacagatttcgccctcaccatcaacagtctgcaacctgaagattttgcagtttattactgtcaacacagttacagtacccctcggacgttcggccaagggaccaaggtagaaatcaagcgaactgtggctgcaccatctgtcttcatcttcccgcatctgaagtactctatctgagcgggctggcaaggcgcatagnn

SEQ ID NO: 95207 - DNA, 150 bp, Homo sapiens
  misc_feature: GYAE6OF01BIRZB.29.83.H06.1.454.CMB.1.raw
  modified_base (150)..(150): a, c, t, g, unknown or other
  misc_feature (150)..(150): n is a, c, g, or t
tcagatagagtactcacgaccggtgctcgatttagatcacgtgcgtcgcgggacacgactggagattaaacgaactgtggctgcaccatctgtcttcatcttcccgccatctgatatgtatactctgagcgggctggcaaggcgcatagn

SEQ ID NO: 95208 - DNA, 256 bp, Homo sapiens
  misc_feature: GYAE6OF01CEHVI.29.83.H06.1.454.CMB.1.raw
  modified_base (248)..(248): a, c, t, g, unknown or other
  misc_feature (248)..(248): n is a, c, g, or t
  modified_base (254)..(256): a, c, t, g, unknown or other
  misc_feature (254)..(256): n is a, c, g, or t
tcagatagagtactcacgaccggtgctcgatttagatcacgtgcgtcgcgggaagatgaagacagatttcgccctcaccatcaacagtctgcaacctgaagattttgcagtttattactgtcaacacagttacagtacccctcggacgttcggccaagggaccaaggtagaaatcaagcgaactgtggctgcaccatctgtctcatcttccgcatctgaagtactctatctgagcggctggcaaggcncatagnnn

SEQ ID NO: 95209 - DNA, 118 bp, Homo sapiens
  misc_feature: GYAE6OF01C4RMP.29.83.H06.1.454.CMB.1.raw
  modified_base (118)..(118): a, c, t, g, unknown or other
  misc_feature (118)..(118): n is a, c, g, or t
tcagatagagtactcacgaccggtgctcgatttagatcacgtgcgtcgcgggaagatgaagacagatttcgccctcaccatcaacagtctgcaacctgaagattttgcagttattacn

SEQ ID NO: 95210 - DNA, 153 bp, Homo sapiens; identical to SEQ ID NO: 95202
  misc_feature: GYAE6OF01AQOT5.29.83.H06.1.454.CMB.1.raw
  modified_base (151)..(153): a, c, t, g, unknown or other
  misc_feature (151)..(153): n is a, c, g, or t

SEQ ID NO: 95211 - DNA, 330 bp, Homo sapiens
  misc_feature: GYAE6OF01EEXVO.29.83.H06.1.454.CMB.1.raw
  modified_base (238)..(238): a, c, t, g, unknown or other
  misc_feature (238)..(238): n is a, c, g, or t
  modified_base (299)..(299): a, c, t, g, unknown or other
  misc_feature (299)..(299): n is a, c, g, or t
  modified_base (301)..(330): a, c, t, g, unknown or other
  misc_feature (301)..(330): n is a, c, g, or t
tcagatagagtactcacgaccggtgctcgatttagatcacgtgcgtcgcgggaagatgaagacagtatttccgccctcaccatcaacagtctgcaacctgaagtattttgctagttttattactgtcaaacactagttacacgtaccccgtcggaccgttcggaccgaacgggaccaaggtaagaaatacaagacgaacgtgtggctcgcacctatctgtccttcacttcccgtcccnctactcgtagaactacttactatccgtggacggcgggtcgtaggaccgaaggccgagtagngnnnnnnnnnnnnnnnnnnnnnnnnnnnnnn

SEQ ID NO: 95212 - DNA, 152 bp, Homo sapiens
  misc_feature: GYAE6OF02IB7J3.29.83.H06.1.454.CMB.1.raw
  modified_base (128)..(128): a, c, t, g, unknown or other
  misc_feature (128)..(128): n is a, c, g, or t
  modified_base (149)..(152): a, c, t, g, unknown or other
  misc_feature (149)..(152): n is a, c, g, or t
tcagatagagtactcacgaccggtgctcgatttagatcacgtgcgtcgcgggacacgactggagattaaacgaactgtggctgcaccatctgtcttcatcttccgccatctgatatgtatactctgancgggctggcaaggcgcatagnnnn

SEQ ID NO: 95213 - DNA, 150 bp, Homo sapiens; identical to SEQ ID NO: 95207
  misc_feature: GYAE6OF02GU6RL.29.83.H06.1.454.CMB.1.raw
  modified_base (150)..(150): a, c, t, g, unknown or other
  misc_feature (150)..(150): n is a, c, g, or t

SEQ ID NO: 95214 - DNA, 150 bp, Homo sapiens
  misc_feature: GYAE6OF02GUPYM.29.83.H06.1.454.CMB.1.raw
  modified_base (149)..(150): a, c, t, g, unknown or other
  misc_feature (149)..(150): n is a, c, g, or t
tcagatagagtactcacgaccggtgctcgatttagatcacgtgcgtcgcgggacacgactggagattaacgaactgtggctgcaccatctgtcttcatcttcccgccatctgatatgtatactctgagcgggctggcaaggcgcatagnn

SEQ ID NO: 95215 - DNA, 156 bp, Homo sapiens
  misc_feature: GYAE6OF02GOFTH.29.83.H06.1.454.CMB.1.raw
  modified_base (152)..(156): a, c, t, g, unknown or other
  misc_feature (152)..(156): n is a, c, g, or t
tcagatagagtactcacgaccggtgctcgatttagatcacgtgcggtccgcgggacacgactggagattaaacgaactgtggctgcaccatctgtcttcatcttcccgccatctgaagtactctatctgagcgggctggcaaggcgcatagnnnnn

SEQ ID NO: 95216 - DNA, 151 bp, Homo sapiens; identical to SEQ ID NO: 95200
  misc_feature: GYAE6OF02FW8YI.29.83.H06.1.454.CMB.1.raw
  modified_base (151)..(151): a, c, t, g, unknown or other
  misc_feature (151)..(151): n is a, c, g, or t

SEQ ID NO: 95217 - DNA, 151 bp, Homo sapiens
  misc_feature: GYAE6OF02ILQJV.29.83.H06.1.454.CMB.1.raw
  modified_base (150)..(151): a, c, t, g, unknown or other
  misc_feature (150)..(151): n is a, c, g, or t
tcagatagagtactcacgaccggtgctcgatttagatcacgtgcgtcgcgggacacgactggagattaaacgaactgtggctgcaccatctgtcttcatcttcccgccatctgatatgtatactctgagcgggctggcaaggcgcatagnn

SEQ ID NO: 95218 - DNA, 184 bp, Homo sapiens
  misc_feature: GYAE6OF02G1HE1.29.83.H06.1.454.CMB.1.raw
  modified_base (161)..(184): a, c, t, g, unknown or other
  misc_feature (161)..(184): n is a, c, g, or t
tcagatagagtactcacgaccggtgctcgatttagatcacgtgcggtccgcgggacacgacctggacgagttaaacgtaactgtggtctgtcaccatctgtcttcatcttcccgccatctgaagtactctatctgagcgggctggtcaaggcgcattaagnnnnnnnnnnnnnnnnnnnnnnnn

SEQ ID NO: 95219 - DNA, 150 bp, Homo sapiens; identical to SEQ ID NO: 95207
  misc_feature: GYAE6OF02HUZOX.29.83.H06.1.454.CMB.1.raw
  modified_base (150)..(150): a, c, t, g, unknown or other
  misc_feature (150)..(150): n is a, c, g, or t

SEQ ID NO: 95220 - DNA, 152 bp, Homo sapiens
  misc_feature: GYAE6OF02HZJK6.29.83.H06.1.454.CMB.1.raw
  modified_base (149)..(152): a, c, t, g, unknown or other
  misc_feature (149)..(152): n is a, c, g, or t
tcagatagagtactcacgaccggtgctcgatttagatcacgtgcgtcgcgggacacgactggagattaaacgaactgtggctgcaccatctgtcttcatcttcccgcatctgatatgtatactctgagcgggctggcaaggcgcatagnnnn

SEQ ID NO: 95221 - DNA, 152 bp, Homo sapiens
  misc_feature: GYAE6OF02H7V3F.29.83.H06.1.454.CMB.1.raw
  modified_base (150)..(152): a, c, t, g, unknown or other
  misc_feature (150)..(152): n is a, c, g, or t
tcagatagagtactcacgaccggtgctcgatttagatcacgtgcgtctcgggacacgactggagattaaacgaactgtggctgcaccatctgtcttcatcttcccgccatctgatatgtatactctgagcgggctggcaaggcgcatagnnn

SEQ ID NO: 95222 - DNA, 154 bp, Homo sapiens
  misc_feature: GYAE6OF02F8380.29.83.H06.1.454.CMB.1.raw
  modified_base (149)..(154): a, c, t, g, unknown or other
  misc_feature (149)..(154): n is a, c, g, or t
tcagatagagtactcacgaccggtgctcgatttagatcacgtgcgtcgcgggacacgactggagattaaacgaactgtggctgcaccatctgtcttcatcttcccgcatctgatatgtatactctgagcgggctggcaaggcgcatagnnnnnn

SEQ ID NO: 95223 - DNA, 149 bp, Homo sapiens
  misc_feature: GYAE6OF02ILYF9.29.83.H06.1.454.CMB.1.raw
tcagatagagtactcacgaccggtgctcgatttagatcacgtgcgtcgcgggacacgactggagattaaacgaactgtggctgcaccatctgtcttcatcttcccgccatctgatatgtatactctgagcgggctggcaaggcgcatag

SEQ ID NO: 95224 - DNA, 150 bp, Homo sapiens; identical to SEQ ID NO: 95207
  misc_feature: GYAE6OF02G1MQ8.29.83.H06.1.454.CMB.1.raw
  modified_base (150)..(150): a, c, t, g, unknown or other
  misc_feature (150)..(150): n is a, c, g, or t

SEQ ID NO: 95225 - DNA, 260 bp, Homo sapiens
  misc_feature: GYAE6OF02HMUND.29.83.H06.1.454.CMB.1.raw
  modified_base (257)..(260): a, c, t, g, unknown or other
  misc_feature (257)..(260): n is a, c, g, or t
tcagatagagtactcacgaccggtgctcgatttagatcacgtgcgtcgcgggaagatgaagacagatttcgccctcaccatcaacagtctgcaacctgaagattttgcagtttattactgtcaacacagttacagtacccctcggacgttcggccaagggaccaaggtagaaatcaagcgaactgtggctgcaccatctgtcttcatcttcccgcatctgaagtactctatctgagcgggctggcaaggcgcatagnnnn

SEQ ID NO: 95226 - DNA, 258 bp, Homo sapiens
  misc_feature: GYAE6OF02GXF0J.29.83.H06.1.454.CMB.1.raw
  modified_base (250)..(250): a, c, t, g, unknown or other
  misc_feature (250)..(250): n is a, c, g, or t
  modified_base (256)..(258): a, c, t, g, unknown or other
  misc_feature (256)..(258): n is a, c, g, or t
tcagatagagtactcacgaccggtgctcgatttagatcacgtgcgtcgcgggaagatgaagacagatttcgccctcaccatcaacagtctgcaacctgaagattttgcagtttattactgtcaacacagttacagtacccctcggacgttcggccaagggaccaaggtagaaatcaagcgaactgtggctgcacatctgtcttcatcttcccgcatctgaagtactctatctgagcgggctggcaaggcncatagnnn

SEQ ID NO: 95227 - DNA, 149 bp, Homo sapiens; identical to SEQ ID NO: 95223
  misc_feature: GYAE6OF02JBBUD.29.83.H06.1.454.CMB.1.raw

SEQ ID NO: 95228 - DNA, 154 bp, Homo sapiens
  misc_feature: GYAE6OF02I5MA0.29.83.H06.1.454.CMB.1.raw
  modified_base (150)..(154): a, c, t, g, unknown or other
  misc_feature (150)..(154): n is a, c, g, or t
tcagatagagtactcacgaccggtgctcgatttagatcacgtgcgtcgcgggacacgactggagattaaacgaactgtggctgcaccatctgtcttcatcttcccgccatctgatatgtatactctgagcgggctggcaaggcgcatagnnnnn

SEQ ID NO: 95229 - DNA, 153 bp, Homo sapiens
  misc_feature: GYAE6OF02F4T25.29.83.H06.1.454.CMB.1.raw
  modified_base (150)..(153): a, c, t, g, unknown or other
  misc_feature (150)..(153): n is a, c, g, or t
tcagatagagtactcacgaccggtgctcgatttagatcacgtgcgtcgcgggacacgactggagattaaacgaactgtggctgcaccatctgtcttcatcttcccgccatctgatatgtatactctgagcgggctggcaaggcgcatagnnnn

SEQ ID NO: 95230 - DNA, 149 bp, Homo sapiens; identical to SEQ ID NO: 95223
  misc_feature: GYAE6OF02IN40O.29.83.H06.1.454.CMB.1.raw

SEQ ID NO: 95231 - DNA, 272 bp, Homo sapiens
  misc_feature: GYAE6OF02JZMJE.29.83.H06.1.454.CMB.1.raw
  modified_base (230)..(230): a, c, t, g, unknown or other
  misc_feature (230)..(230): n is a, c, g, or t
  modified_base (258)..(258): a, c, t, g, unknown or other
  misc_feature (258)..(258): n is a, c, g, or t
  modified_base (260)..(272): a, c, t, g, unknown or other
  misc_feature (260)..(272): n is a, c, g, or t
tcagatagagtactcacgaccggtgctcgatttagatcacgtgcgtcgcgggaagatgaagacagatttcgccctcaccatcaacagtctgcaacctgaagattttgcagtttattactgtcaacacagttacagtacccctcggacgttcggccaagggaccaaggtagaaatcaagcgaactgtggctgcaccatctgtcttcatcttcccgccatctagaagtactntatctgagcggctggcaaggcgcatagntnnnnnnnnnnnnn

SEQ ID NO: 95232 - DNA, 296 bp, Homo sapiens
  misc_feature: GYAE6OF01B54A7.1.62.F07.1.454.CMB.1.raw
  modified_base (289)..(296): a, c, t, g, unknown or other
  misc_feature (289)..(296): n is a, c, g, or t
tcagacgagtgcgtcacgaccggtgctcgatttagtagtcgcatatcgcgggaatccggggtccctgaccgattcagtggcagcgggtctgggacagatttcactctcaccataaccagcctgcaggctgaagatgtggcagtttattactgtcagcagtattatagcactcccccaacgttcggccaagggaccaaggtggaaatcaaacgaactgtggctgcaccatctgtcttcatcttcccaccctctcacgcactcgtctgagcgggctggcaaggcgcatagnnnnnnnn

SEQ ID NO: 95233 - DNA, 200 bp, Homo sapiens
  misc_feature: GYAE6OF01BNLHH.1.62.F07.1.454.CMB.1.raw
  modified_base (165)..(200): a, c, t, g, unknown or other
  misc_feature (165)..(200): n is a, c, g, or t
tcagacgagtgcgtcacgaccggtgctcgatttagtagtcgcatagtcgcgggaagatgaagacagagtcaccatcacttcccgggaactgtggctgcaccatctgtcttcatccttcccgcatctgaacgcactcgtctgagcgggctggcaaggcgacatagnnnnnnnnnnnnnnnnnnnnnnnnnnnnnnnnnnnn

SEQ ID NO: 95234 - DNA, 169 bp, Homo sapiens
  misc_feature: GYAE6OF01C4IML.1.62.F07.1.454.CMB.1.raw
  modified_base (161)..(169): a, c, t, g, unknown or other
  misc_feature (161)..(169): n is a, c, g, or t
tcagacgagtgcgtcacgaccggtgctcgatttagtagtcgcatatcgctggaagatgaagacagagtcaccatcacttccgggaactgtggctgcaccatctgtcttcatcttcccgcatctgaacgcactcgtctgagcgggctggcaaggcgcatagnnnnnnnnn

SEQ ID NO: 95235 - DNA, 224 bp, Homo sapiens
  misc_feature: GYAE6OF01BQVS9.1.62.F07.1.454.CMB.1.raw
  modified_base (215)..(224): a, c, t, g, unknown or other
  misc_feature (215)..(224): n is a, c, g, or t
tcagacgagtgcgtcacgaccggtgctcgatttagtagtcgcatatcgcggggacgattttgcaatttattactgtcagcagcgtaacgagtggcctccggtcactttcggccctgggaccaaagtggatttcaaacgaactgtggctgcaccatctgtcttcatcttcccgcatctgaacgcactcgtctgagcgggctggcaaggcgcatagnnnnnnnnnn

SEQ ID NO: 95236 - DNA, 304 bp, Homo sapiens
  misc_feature: GYAE6OF01EMPBB.25.56.F01.1.454.CMB.1.raw
  modified_base (301)..(304): a, c, t, g, unknown or other
  misc_feature (301)..(304): n is a, c, g, or t
tcagactgtacagtcacgaccggtgctcgatttagcagacgtctgaacacacaaagggggacgggatccctgatcgcttctcaggctccagctgtgggactgagcgctacctcaccatctccagcctccagtctgaggatgaaactgactattactgtcagacctggggcactggcattcagggtgttcggcggagggaccaagctgaccgtcctaggtcagcccaaggctcgccccctcggtcactctcgttcccaccctcctcactgtacagtctgagcgggctggcaaggcgcatagnnnn

SEQ ID NO: 95237 - DNA, 337 bp, Homo sapiens
  misc_feature: GYAE6OF01CEW4C.25.56.F01.1.454.CMB.1.raw
  modified_base (306)..(337): a, c, t, g, unknown or other
  misc_feature (306)..(337): n is a, c, g, or t
tcagactgtacagtcacgaccggtgctcgatttagcagacgtctgaacacacaaagggggacgggatccctgatcgcttctcaggctccagctgtgggactgagcgctacctcaccatctccagcctccagttctgaggatgaaactgactattactgtcagacctggggcacgtggcattcagggtgttcgggcggagggaccaagctgaccgtcctaggtcacgcccaagcctcgccccctcgtcactctcgttcccaccctcctctactgtacagtctgacgccggctggcaggcgacagtgnnnnnnnnnnnnnnnnnnnnnnnnnnnnnnnn

SEQ ID NO: 95238 - DNA, 442 bp, Homo sapiens
  misc_feature: GYAE6OF01A45M0.25.56.F01.1.454.CMB.1.raw
  modified_base (401)..(442): a, c, t, g, unknown or other
  misc_feature (401)..(442): n is a, c, g, or t
tcagactgtacagtcacgaccggtgctcgatttagcagacgtctgaacacaacgaaaaggggggacgggatccctgatcgcttctcaggctccagctgtggactgagcgctacctcaccatctccagcctccagtctgagatgaaactgactattactgtacaggaccgtggggcacgtggctaagttcgtagggggttggttccgggcggggtaacgggaacccgaagtccgtacggtacccgtaccgttacggccaaccggtacccgaacgggccttcccgccccccgttcggttcctacctttccgtaccggtttccccctccctcccttctaccgttagtaccacggttcttagggaggccgggtgtcggtacgaaggcccgataagtgcagttgannnnnnnnnnnnnnnnnnnnnnnnnnnnnnnnnnnnnnnnnn

SEQ ID NO: 95239 - DNA, 297 bp, Homo sapiens
  misc_feature: GYAE6OF02IREAT.25.56.F01.1.454.CMB.1.raw
  modified_base (295)..(297): a, c, t, g, unknown or other
  misc_feature (295)..(297): n is a, c, g, or t
tcagactgtacagtcacgaccggtgctcgatttagcagacgtctgaacacacaaaggggacggatccctgatcgcttctcaggctccagctgtgggactgagcgctacctcaccatctccagcctccagtctgaggatgaaactgactattactgtcagacctgggcactggcattcagggtgttcggcggagggaccaagctgaccgtcctaggtcagcccaaggctgccccctggtcactctgttcccaccctcctcactgtacagtctgagcgggctggcaaggcgcatagnnn

SEQ ID NO: 95240 - DNA, 301 bp, Homo sapiens
  misc_feature: GYAE6OF02G6I1E.25.56.F01.1.454.CMB.1.raw
  modified_base (298)..(301): a, c, t, g, unknown or other
  misc_feature (298)..(301): n is a, c, g, or t
tcagactgtacagtcacgaccggtgctcgatttagcagacgtctgaacacacaaaggggacgggatccctgatcgcttctcaggctccagctgtgggactgagcgctacctcaccatctccagcctccagtctgaggatgaaactgactattactgtcagacctggggcactggcattcagggtgttcggcggagggaccaagctgaccgtcctaggtcagcccaaggctgccccctcggtcactctgttcccaccctcctcactgtacagtctgagcgggctggcaaggcgcatagnnnn

SEQ ID NO: 95241 - DNA, 301 bp, Homo sapiens
  misc_feature: GYAE6OF02HJNVM.25.56.F01.1.454.CMB.1.raw
  modified_base (298)..(301): a, c, t, g, unknown or other
  misc_feature (298)..(301): n is a, c, g, or t
tcagactgtacagtcacgaccggtgctcgatttagcagacgtctgaacacacaaagggggacgggatccctgatcgcttctcaggctccagctgtgggactgagcgctacctcaccatctccagcctccagtctgaggatgaaactgactattactgtcagacctggggcactggcattcagggtgttcggcggagggaccaagctgaccgtcctaggtcagcccaaggctgccccctggtcactctgttcccaccctcctcactgtacagtctgagcgggctggcaaggcgcatagnnnn

SEQ ID NO: 95242 - DNA, 300 bp, Homo sapiens
  misc_feature: GYAE6OF02FT1XS.25.56.F01.1.454.CMB.1.raw
  modified_base (295)..(300): a, c, t, g, unknown or other
  misc_feature (295)..(300): n is a, c, g, or t
tcagactgtacagtcacgaccggtgctcgatttagcagacgtctgaacacacaaaggggacggatccctgatcgcttctcaggctccagctgtgggactgagcgctacctcaccatctccagcctccagtctgaggatgaaactgactattactgtcagacctggggcactggcattcagggtgttcggcggagggaccaagctgaccgtcctaggtcagcccaaggctgcccctggtcactctgttcccaccctcctcactgtacagtctgagcgggctggcaaggcgcatagnnnnnn

SEQ ID NO: 95243 - DNA, 303 bp, Homo sapiens
  misc_feature: GYAE6OF02G463L.25.56.F01.1.454.CMB.1.raw
  modified_base (300)..(303): a, c, t, g, unknown or other
  misc_feature (300)..(303): n is a, c, g, or t
tcagactgtacagtcacgaccggtgctcgatttagcagacgtctgaacacacaaagggggacgggatccctgatcgcttctcaggctccagctgtgggactgagcgctacctcaccatctccagcctccagtctgaggatgaaactgactattactgtcagacctggggcactggcattcagggtgttcggcggagggaccaagctgaccgtcctaggtcagcccaaggctgccccctcggtcactctcgttcccgccctcctcactgtacagtctgagcgggctggcaaggcgcatagnnnn

SEQ ID NO: 95244 - DNA, 303 bp, Homo sapiens
  misc_feature: GYAE6OF02HKEFU.25.56.F01.1.454.CMB.1.raw
  modified_base (299)..(303): a, c, t, g, unknown or other
  misc_feature (299)..(303): n is a, c, g, or t
tcagactgtacagtcacgaccggtgctcgatttagcagacgtctgaacacacaaagggggacgggatccctgatcgcttctcaggctccagctgtgggactgagcgctacctcaccatctccagcctccagtctgaggatgaaactgactattactgtcagacctggggcactggcattcagggtgttcggcggagggaccaagctgaccgtcctaggtcagcccaaggctgccccctggtcactctcgttcccgccctcctcactgtacagtctgagcgggctggcaaggcgcatagnnnnn

SEQ ID NO: 95245 - DNA, 333 bp, Homo sapiens
  misc_feature: GYAE6OF02IPT1I.25.56.F01.1.454.CMB.1.raw
  modified_base (310)..(333): a, c, t, g, unknown or other
  misc_feature (310)..(333): n is a, c, g, or t
tcagactgtacagtcacgaccggtgctcgatttagcagacgtctgaacgacacaaagggggaccgggatccctgatcgcttctcaggctccagctgtgggactgagcgctaccgtcaccatctccagcctcctagtctgaggatgaaactgactattactgtcagacctggggcactggcattcagggtgttcggcggagggaccaagcgtgaccgtctaggtcacgcccaaggctcgcccccgtcggtcactctcgttcccgcctcctcactgtacagtctgacgcgggactcggcaaggcgacatagnnnnnnnnnnnnnnnnnnnnnnnn

SEQ ID NO: 95246 - DNA, 303 bp, Homo sapiens
  misc_feature: GYAE6OF02H8J8F.25.56.F01.1.454.CMB.1.raw
  modified_base (300)..(303): a, c, t, g, unknown or other
  misc_feature (300)..(303): n is a, c, g, or t
tcagactgtacagtcacgaccggtgctcgatttagcagacgtctgaacacacaaagggggacgggatccctgatcgcttctcaggctccagctgtgggactgagcgctacctcaccatctccagcctccagtctgaggatgaaactgactattactgtcagacctggggcactggcattcagggtgttcggcggaggaccaagctgaccgtcctaggtcagcccaaggctcgccccctggtccactctcgttccccgaccctcctcactgtacagtctgagcggctggcaggcgcatagnnnn

SEQ ID NO: 95247 - DNA, 547 bp, Homo sapiens
  misc_feature: GYAE6OF02I7H9X.25.56.F01.1.454.CMB.1.raw
  modified_base (501)..(501): a, c, t, g, unknown or other
  misc_feature (501)..(501): n is a, c, g, or t
  modified_base (505)..(547): a, c, t, g, unknown or other
  misc_feature (505)..(547): n is a, c, g, or t
tcagactgtacagtcacgaccggtgctcgatttagcagacgtctgaacacacaaggggacggagtccctgatcgcttctcaggctccagctgtgggactgagcgctacctcaccatcctccagcctccagtctgacggatgaaactgactattactgtcagacctggggccacgtcggcatttcgagggttcgttccgggcgggtagggacccgaaggccgttacggaacccgttcccgtaagggttccaacggacccccaaagggcccgttaccgccccccccgtacgggttcctaacccgttccgttccgggttttacccccccaaccccccttcccgtttaccccaaacccgttttccgggttaaacccccgtaccggttttaccccttggggtaaaccccggccgggggttccccttaccggggggtaccccgaaaaccgggggttccccgggaaccctaaggtttaacggccgttcaccggacctgtacaccttgngcgnnnnnnnnnnnnnnnnnnnnnnnnnnnnnnnnnnnnnnnnnnn

SEQ ID NO: 95248 - DNA, 310 bp, Homo sapiens
  misc_feature: GYAE6OF02GGLPI.25.56.F01.1.454.CMB.1.raw
  modified_base (293)..(293): a, c, t, g, unknown or other
  misc_feature (293)..(293): n is a, c, g, or t
  modified_base (299)..(300): a, c, t, g, unknown or other
  misc_feature (299)..(300): n is a, c, g, or t
  modified_base (302)..(310): a, c, t, g, unknown or other
  misc_feature (302)..(310): n is a, c, g, or t
tcagactgtacagtcacgaccggtgctcgatttagcagacgtctgaacgacacaaaggggacgggatccctgatcgcttctcaggctccagctgtgggactgagcgctacctcaccatctccagcctccagtctgaggatgaaactgactattaactgtcagacctggggcactggcattcagggtgttcggcggagggaccaagctgaccgtcctaggtcagcccaaggctgcccctggtcactctcgttcccaccctcctcactgtacagtctgagcgggctggcaaggcncatagnngnnnnnnnnn

SEQ ID NO: 95249 - DNA, 370 bp, Homo sapiens
  misc_feature: GYAE6OF02IY94N.25.56.F01.1.454.CMB.1.raw
  modified_base (267)..(267): a, c, t, g, unknown or other
  misc_feature (267)..(267): n is a, c, g, or t
  modified_base (301)..(303): a, c, t, g, unknown or other
  misc_feature (301)..(303): n is a, c, g, or t
  modified_base (306)..(307): a, c, t, g, unknown or other
  misc_feature (306)..(307): n is a, c, g, or t
  modified_base (312)..(313): a, c, t, g, unknown or other
  misc_feature (312)..(313): n is a, c, g, or t
  modified_base (315)..(370): a, c, t, g, unknown or other
  misc_feature (315)..(370): n is a, c, g, or t
tcagactgtacagtcacgaccggtgctcgatttagcagacgtctgaacgacacaaagggggacgggatccctgatcgcttctcaggctccagctgtgggactgagcgctacctcaccatctccagcctccagtctgaggatgaaactgactattactgtcagacctggggcactggcattcagggtgttcggcggagggaccaagctgaccgtctaggtcagccaaggctcgccccctggtcactctcgttcccaccctcctcactntacagtctgacgcgggctggcaaggcgcataggnnngtnntgctnngnnnnnnnnnnnnnnnnnnnnnnnnnnnnnnnnnnnnnnnnnnnnnnnnnnnnnnnn

SEQ ID NO: 95250 - DNA, 307 bp, Homo sapiens
  misc_feature: GYAE6OF02IR54T.25.56.F01.1.454.CMB.1.raw
  modified_base (305)..(307): a, c, t, g, unknown or other
  misc_feature (305)..(307): n is a, c, g, or t
tcagactgtacagtcacgaccggtgctcgatttagcagacgtctgaacacacaaagggggacgggatccctgatcgcttctcaggctccagctgtgggactgagcgctacctcaccatctccagcctccagtctgaggatgaaactgactattactgtcagaccgtggggcactggctattcgaggggtgttcgggcggagggaccaagctgaccgtctaggtcacgccaaggctcgccccctcggtcactctcgttcccgccctcctcactgtacagtctgagcgggctggcaaggcgcatagnnn

SEQ ID NO: 95251 - DNA, 519 bp, Homo sapiens
  misc_feature: GYAE6OF01ADUQ1.51.36.D03.1.454.CMB.1.raw
  modified_base (460)..(460): a, c, t, g, unknown or other
  misc_feature (460)..(460): n is a, c, g, or t
  modified_base (480)..(480): a, c, t, g, unknown or other
  misc_feature (480)..(480): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagccccccgggaagggctggattggattggcagtatcagttatactgggaccaccttcttcaagtcgtcgctcaagagtcgagtcaccatgaccgcggacacgtccaaggaccagttctccctgaacgctgacctctgtcgaccgccgcagacacggctttgtatttctgtgctagatataatgtggtnacagtggtgcctagtacggngtcttttgattagtttggggaccaagggcacggtaacgg

SEQ ID NO: 95252 - DNA, 525 bp, Homo sapiens
  misc_feature: GYAE6OF01A0XNF.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagcccccgggaagggctggattggattggcaggtatcagttatactgggacctaccttcttcaagtcgtcgctcaagagtcgagtcaccatcgaccgcggacacgtccaaggaccagttctccctgaagctgaccctctgtgacccgccgcagacacggtctttgtatttcgtgtgctagatataatgtgggtgacagtggtgcctatacggtgtcttttgattagtttgggggaccaagggcaacggtaacgg

SEQ ID NO: 95253 - DNA, 610 bp, Homo sapiens
  misc_feature: GYAE6OF01C96UP.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagagatattactacgtgggctggatccggcacggcccccgggaagggctggagttggattggcagtatctagttatacgtcgggacctaccgttcttacgaagtcgtcgtctacaagagtcgagtcacatcgaccggcgacacgtaccgaagacctagttccacccgtagaacgtcgtcgaccttcgtgtaccgaccgccgacgacgaccaacggttctttagtacgtttcgtgtcgtactaagtacttaattaagttcggttagggtactaacgtaggttgggtcgtaccgttaacggtaacgggtgttccgtttttaggaacgtttacggtttacggggacctaaacgggtccgtaacgggtaaaccgg

SEQ ID NO: 95254 - DNA, 531 bp, Homo sapiens
  misc_feature: GYAE6OF01DLAFV.51.36.D03.1.454.CMB.1.raw
  modified_base (468)..(468): a, c, t, g, unknown or other
  misc_feature (468)..(468): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacgcccccgggaagggctggattggattggcagtatcagttatactgggaccaccttcttcaagtcgtcgctcaagagtcgagtcaccatgaccgcggacacgtaccaaggaccagttcctccctgaacgctcgacctctgtcgacccgccgcacgaccacggtctttgtatttctgtgctagattataatgtgggtnacgagtggtgtcctagtacggtagtcttttgattagtttggggacctaaggcgacggtaacgg

SEQ ID NO: 95255 - DNA, 538 bp, Homo sapiens
  misc_feature: GYAE6OF01DHX91.51.36.D03.1.454.CMB.1.raw
  modified_base (471)..(471): a, c, t, g, unknown or other
  misc_feature (471)..(471): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcacggcccccgggaaggggctggagttggagttggcagtatcagttatactgggacctaccttcttcaagtcgtcgctcaagagtcgagtcaccatcgaccgcggacacgtccaaggacctagtcctccctgaacgctgacctctgtcgaccgccgcagaccacggtctttgtatttctgtgctagattataatggtggtnacgagtggtcgtcctacgtacggtgttctttgattagtttacggggaccaagggctaacggtaacgg

SEQ ID NO: 95256 - DNA, 653 bp, Homo sapiens
  misc_feature: GYAE6OF01EI5Z4.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtcgggcccaggacttgtgaagccttcggagacactcgtccctcacctgctctgtctctggcgctccatcagtagtagatattactacgtggggctggactccggcgacggccccccggggaagggcgtggattggattggctagtatcagttatacgtcgggacctacctttctacgaacgtccgtcgctacaaagacgtcgagtccaccagtcgaccggcggaactaccggtaccgaacggacctacgtttccctacccgtagaacgtcctcgtaacccttcgtcggtaccgaccccggcccgacgacggaaccgtaccggttcttttacgttattttccgtggttcgtaccgttaagtaattaagttaagtgggttggggtacgacgtaggtcgggttcgtaccttaacggtacggtacgtttcgttttagaacgtttacgggtttcggggaacccgtaagggccgtaacgggtaaaccggg

SEQ ID NO: 95257 - DNA, 527 bp, Homo sapiens
  misc_feature: GYAE6OF01E2C0N.51.36.D03.1.454.CMB.1.raw
  modified_base (211)..(211): a, c, t, g, unknown or other
  misc_feature (211)..(211): n is a, c, g, or t
  modified_base (465)..(465): a, c, t, g, unknown or other
  misc_feature (465)..(465): n is a, c, g, or t
  modified_base (487)..(487): a, c, t, g, unknown or other
  misc_feature (487)..(487): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtcccctnacctgctctgtctctggcgctccatcagtagtagatattactactggggctggatccggcacggccccccggggaaggggctggattggattggcagtatcagttatacgtggacctacttcttcaagtcgtcgctcaagagtcgagtcaccatgaccgcggacacgtccaaggccagttctccgtagaacgctgacctcgtgtcgaccgccgcagacacggtctttgtatttctgtgctagatatatgtggtnacgagtggtgcctagtacggtntcgttttagacgttagttcgggacaagggcaaggtaacgg

SEQ ID NO: 95258 - DNA, 518 bp, Homo sapiens
  misc_feature: GYAE6OF01BHSV4.51.36.D03.1.454.CMB.1.raw
  modified_base (349)..(349): a, c, t, g, unknown or other
  misc_feature (349)..(349): n is a, c, g, or t
  modified_base (467)..(467): a, c, t, g, unknown or other
  misc_feature (467)..(467): n is a, c, g, or t
  modified_base (485)..(485): a, c, t, g, unknown or other
  misc_feature (485)..(485): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcacgcccccgggaagggctggattggattggcagtatcagttatactgggacctaccttcttcaagtcgtcgctcaagngtcgagtcaccatgaccgcggacacgtccaaggaccagttcctccctgaacgctgacctctgtcgaccgccgcacgacacggtctttgtatttctgtgctagatataatgtggtgacnggtggtgcctagtacggngtctttgattagtttgggaccaggcaggtacgg

SEQ ID NO: 95259 - DNA, 531 bp, Homo sapiens
  misc_feature: GYAE6OF01E4UB7.51.36.D03.1.454.CMB.1.raw
  modified_base (466)..(466): a, c, t, g, unknown or other
  misc_feature (466)..(466): n is a, c, g, or t
  modified_base (489)..(489): a, c, t, g, unknown or other
  misc_feature (489)..(489): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcagccccccgggaagggctggattggattggcagtatcagttatactgggaccaccttctcaagtcgtcgctcaagagtcgagtcaccatcgaccgcggacacgtccaaggaccagttctccctgaacgctgaccctcgtgtcgaccgccgcgacgaccacggtctttgtatttctgtgctagatataatgtgggtnactaggtggtgtcctagtacggngtcttttgacttagtttcggggacctaaggcaacggtaacgg

SEQ ID NO: 95260 - DNA, 613 bp, Homo sapiens
  misc_feature: GYAE6OF01DMZ2Q.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtgggctggatccggcgacggcccccgggaagggctggtattggattggcagtatctagttatacgtcggacctaccgttcttacgaagtcgtcgactacgaacgagtcgacgtacaccagtacgaccgacggaacacgtaccgaaggtacccacgttcctcccgtagaacgtctacgaaccttcgtacggtacgacccgccgacgacgaccgtacggttctttagtacttttcgaggttacgtacttaaggattaagtaacgttgggtgggtagacgtaggtggtacgccgttagtacggtacgtttcgtttagtaacgttacggtttacggggacctaacgggtcgaacggtaacgg

SEQ ID NO: 95261 - DNA, 575 bp, Homo sapiens
  misc_feature: GYAE6OF01D7P4H.51.36.D03.1.454.CMB.1.raw
  modified_base (471)..(471): a, c, t, g, unknown or other
  misc_feature (471)..(471): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctcatcagtagtagatattactacgtgggctggactccggcacggcccccgggagggctggagtggattggctagtatctagttatacgtcgggacctaccttcttacgaacgtcgtcgctacgaagtagtacgacgtcacagtcgaccgacggacacgtaccaagacctagttcctccgtagaacgtctacgacctcgtcgtacgacccgccgcacgactacggtctttgtactttcgtgngtctagtatagtaagtggtaggtgtacgtagtcggtcgcccgttaagacggtgttcgttttagagtttacggttacgggaaccgtaaggccgtaacggtaacgg

SEQ ID NO: 95262 - DNA, 519 bp, Homo sapiens
  misc_feature: GYAE6OF01A4TWD.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcagcccccgggaagggctggattggattggcagtatcagttatactgggaccaccttcttcaagtcgtcgctcagagtcgagtcacatcgaccgcggacacgtccaaggaccagttctccctgaagctgacctctgtcgaccgccgcagacacggctttgtatttctgtgctagatataatgtgggtgactaggtggtgcctagtacggtgtcttttgattagtttggggacctaagggccaggtaacgg

SEQ ID NO: 95263 - DNA, 595 bp, Homo sapiens
  misc_feature: GYAE6OF01CU6LI.51.36.D03.1.454.CMB.1.raw
  modified_base (523)..(523): a, c, t, g, unknown or other
  misc_feature (523)..(523): n is a, c, g, or t
  modified_base (548)..(548): a, c, t, g, unknown or other
  misc_feature (548)..(548): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggacttgtgaagccttcggagacactcgtccctcacctgctctgtctcgtggcgctccatcagtagtagatattactacgtgggctggatccggcgacggcccccgggaagggctggagtggattggctagtatctagttactacgtcgggacctaccttctacaacgttcgtcgactacgaaaggcgtacgacgtaccacctagtacgacccgcggaaccacgtaccaacggtacctacgttcctccgtagaacgctcgaccttcgtcgtacgacccgccgacacgaccgtacggttctttagtactttcgtgtgtacttagattagtacgtggtggtcgtagnggttggtcgaccgttacgtacggtnttcgtttagaacgttaggttacgggaccgtaggtccgacggtaacgg

SEQ ID NO: 95264 - DNA, 691 bp, Homo sapiens
  misc_feature: GYAE6OF01BK2U6.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgcttctgtctctggcgctccatcagtagtagatattactacgtgggctggatccggcacggcccccgggaagggctggagttggattggcagtatcgtagttatacgtgggacctacttcttacaagtcgtcgctacgaagtagtcgagtcacatacgaccgcggacacgtcaacggacctagttcctccgtagaagtctacgtaccttacgtgtacgacccggtccgacgacggaccgtacgggttcttttggtaacttttccgttaggtcgtaccgttaaggtaatttaacgttaaaggttcgggttaggggttacgtaaaccggttagggttacggggttaccgtaccccggtttaaacggttaccgggggttaaacgttttcccggtttttttaaggaaacggtttttaacggggttttaccggggggaaacccgttaaaacggggtccggtaaaccgggttaaaacccgggg

SEQ ID NO: 95265 - DNA, 601 bp, Homo sapiens
  misc_feature: GYAE6OF01CSPBJ.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtgggctggatccggcacggcccccgggagggctggagttggattggcagtatcgtagttatacgtcgggacctaccttcttcaagtcgtcgcgtacaagacgtcgagtcacatcgaccgcggacacgtaccaaggacctagttcctcccgtagaacgctacgacctctgtcgaccgccgacgacgaccacggtctttgtacttttcgtgttcgacttagtattagttaagtggtagggtacgacgtaggttgggtcgtacccttaggtaccgggtagtttaccgtttttaggtaagtttacgggtttacgggggaccctaaacgggtccgtaacgggtaaaccggg

SEQ ID NO: 95266 - DNA, 550 bp, Homo sapiens
  misc_feature: GYAE6OF01CXRWE.51.36.D03.1.454.CMB.1.raw
  modified_base (453)..(453): a, c, t, g, unknown or other
  misc_feature (453)..(453): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagaccactcgtccctcacctgctctgtctctggcggctccatcagtagagatattactactgggctggatccggcacgcccccgggaagggctggattggattggcagtatcagttatactcgggacctacttcttcaagtcgtcgctcaagagtcgagtcaccatcgaccgcggacacgtaccaaggaccagttctccctgaagtctcgaacctctcgtacgaccgccgacacgacgacggtctttgtacttttcngtcgcttagattataagtggtagggtgacaggtggtagccttagacgggtatcgttttaggatttacggttcggggaccaagggctaacggtaacgg

SEQ ID NO: 95267 - DNA, 568 bp, Homo sapiens
  misc_feature: GYAE6OF01A30IJ.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactacgtggggctggatccggcacggccccccgggaaggggctggattggattggcagtatcagttatacgtgggacctaccttcttcaagttccgtcgctacgaagagtacgagtcaccatcgaccgcggacacgtaccaagggaccagttcctcctgaacgctgaccctctgtcgacccgccgcagaccacggctttgtatttcgtgtgtctagattaatagttcggtgggtgactaggttggtcgtccgttagtacgggtagttcgttttgacgttacgtttcgggggacctaacgggtcgtaacgggtaacggg

SEQ ID NO: 95268 - DNA, 558 bp, Homo sapiens
  misc_feature: GYAE6OF01BB6TE.51.36.D03.1.454.CMB.1.raw
  modified_base (353)..(353): a, c, t, g, unknown or other
  misc_feature (353)..(353): n is a, c, g, or t
  modified_base (436)..(436): a, c, t, g, unknown or other
  misc_feature (436)..(436): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggatccggcacggcccccggggaagggctggattggattggcagtatctagttatacgtgggacctacttcttcaacgtcgtcgctcaagngtcgagtcacatcgaccgcggacacgtaccaaggacctagttcctcccgtagacgtctcgacctcgtgtcgaccgcgcagacncggtctttgtatttctgtcgctagtattatagttggtgggtagacgaggttggtcgtacccgttagtacggtgttcgttttgacgtttaggttcggggaccaagggtcgtaacgggtaacgg

SEQ ID NO: 95269 - DNA, 637 bp, Homo sapiens
  misc_feature: GYAE6OF01EZDMV.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctctggtggcggctcccagatgggtcctgtcccagttgcacctgcaggagtcgggcccaggacttgtgaagccttcggagacactgtccctcacctgctctgtctctggcgctccatcagtagtagatattactacgtggggctggactccggcgacggccccccggggaaggggctgggtagttgggattggcaggtactcgtagttactacgtcgggtacctacctttcttacgtaacgtcgtcgctacgaagtacgtcgagtccacctagtacgacccggacggacctaccggtaccgaaacggaccctacgttccctacccgtagaacgtcctacgtacctcgtcggtaccgaccgcccgacacgtaccgacgttctttgttactttcgtacgtgacttaagtattaattaacgtggtacgggtagacgtaggtcggtcgtccgttaacgtacggtacgtttacgtttagaacgtttacgggtttacgggaccgtaacgggtcgaacggttaacgg

SEQ ID NO: 95270 - DNA, 568 bp, Homo sapiens
  misc_feature: GYAE6OF01BGKRX.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagcccccgggaagggctggattggattggcagtatcagttatactgggaccacttcttcaagtcgtcgctacaagagtcgagtcaccatcgaccgcggaccacgtaccgaacggacctacgttccctcccgtagaacgtcgtacgtaccctcgtcggtcgacccgccgcacgaccgacggtctttagtactttcgtgtcgtctagtattatagtgtgggtgacgtagtggtcgtccgttacgtacgggtgttacgttttgagtttacggttcgggactaacggtcgaacggtaacgg

SEQ ID NO: 95271 - DNA, 795 bp, Homo sapiens
  misc_feature: GYAE6OF01DWQ8T.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctctggtggcggctcccagatgggtcctgtcccagttgcacctgcaggagtcgggcccaggacttgtgaagccttcggagactactgtccctcacctgctctgtctctggcgtctccatcagtagtagattattactacgtgggctggacgtccggacgaccggacccccggggaagggtccgtagggtacgttggacgttggacgtaggttacgtacgtaaggttaacgtacgtaccgggtaacccttaccgtttacgttaccgtaacggtccgtaccgtaccgttaccgaaaggtacggttacggaaccgttaccgaacccgtaagtacccgggaaacccggaccggaaccgtaaccggtacccggaaacggtaccctaacgtttcctaccccgtaggtaacgtcctacgtaccttcggtacgtaccggacccgcccgtacgaacgtaccgtaccggttcgttttacgttacggtttacgtacggttacggaccgtttaaagtaactttaacgttaacgggttcgggttacgggttaacgtaacggttacgggttacgggttaccgttaccccgttaagggttaaccggttacgggttttacgttttaacgggttaacgtttaacggggtttccggggaacccgtaaacgggtacccggaaacgggttaacccggg

SEQ ID NO: 95272 - DNA, 581 bp, Homo sapiens
  misc_feature: GYAE6OF01D1FN3.51.36.D03.1.454.CMB.1.raw
tcagcgatcgtatacacgaccggtgctcgatttagctgcgtcacgatctctcttgggggctttctgagagtcgtggatctcatgtgcaagaaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggactccggcacggccccccggggaaggggctggattggagttggcagtatcagttatacgtgggacctaccttctacaagtcgtcgctcaagagtcgacgtcaccatcgaccgcggacacgtccgaacggacctagttcctcctagaacgtctagacctctgtcgaccgccgacagaccacggtctttagtatttcgtgtgtacgtagacttaagtaagtggtggtacgtacgtaggttggtcgtacccgtagttaacggtagttcgtttttagagtttacggtttacggggaacctaacgggcgaacggtaaccggg

SEQ ID NO: 95273 - DNA, 523 bp, Homo sapiens
  misc_feature: GYAE6OF01BF7XZ.51.36.D03.1.454.CMB.1.raw
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (481)..(481): a, c, t, g, unknown or other
  misc_feature (481)..(481): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcagccccccggaaggggctggattggattggcaggtatcagttatactgggaccaccttcttcaagtcgtcgctcaagagtcgagtcaccatgaccgcggacacgtcaaggaccagttcctccgtgaagctgaccctctcgtcgaccgccgcagaccacggtctttgtatttctgtgctagatatatgtgggtnangtggtgccttataggntcttttggattagtttggggacctaagggtctacggtaacgg

SEQ ID NO: 95274 - DNA, 644 bp, Homo sapiens
  misc_feature: GYAE6OF01EEO88.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggatccggcacggcccccgggaagggctggattgggattggcaggtatcagttatacgtcgggacctacctttcttcaagtcgtcgctacaagagtcgagtcaccgatcgacccgcggaaccacggtaccgaacgggacctacgttccctaccccgtagaacgtcgtacgacccttcgtcggtacgaccccggccgacgacgtaccgaccggttacttttagtacttttcgtggttgtacgttaagtattaagtaagttggttagggtagacgtagggttcggttacggtacccgttacggttaacgggtacgtttaccgtttttaggaacgtttagggtttccggggaaccgtaaacgggtccgtaaacgggttaaccggg

SEQ ID NO: 95275 - DNA, 590 bp, Homo sapiens
  misc_feature: GYAE6OF01BXI6Q.51.36.D03.1.454.CMB.1.raw
  modified_base (354)..(354): a, c, t, g, unknown or other
  misc_feature (354)..(354): n is a, c, g, or t
  modified_base (416)..(416): a, c, t, g, unknown or other
  misc_feature (416)..(416): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcagccccccggggaagggctggattgggattgggcaggtatcgagtttatactgggacccaccttcttcaagtcgtcgctcaagngtcgagtcaccatcgaccgcgacacgtaccaaggaccagttcctcctgaacgctgacccttntgtacgacccgccgcagacacggtctttgtatttcgtgtcgcttagattataattggtagggtcgacgaggttcgggtacgtcccgttaacgttaccgggtagttacgtttttaggacgttttaacggtttcggggggaacccgtaaagggtcccgtaaacgggtaaacccggg

SEQ ID NO: 95276 - DNA, 615 bp, Homo sapiens
  misc_feature: GYAE6OF01BLAOZ.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagattattactacgtggggctggactccggcgacggccccccggggaagggctgggattggagttggctagtatcagttatacgtcgggacctaccttctacaacgtcgtcgctacaagagtcgagtaccacatacgacccgcggaccacgtaccaaggaccctagttcctacccgtagaacgctcgtaccctctcggtacgacccgccgaccgacgaccgtaccgggttcttttagtacttttcgtgttgtactaagtaattagtaacgttggtgggtgacgtagggttggtcgtaccgttacgtacgggtcgttcttttagggacgtttacggtttcggggaaccctaagggtccgtaaacggtaaccgg

SEQ ID NO: 95277 - DNA, 556 bp, Homo sapiens
  misc_feature: GYAE6OF01BC43M.51.36.D03.1.454.CMB.1.raw
  modified_base (393)..(393): a, c, t, g, unknown or other
  misc_feature (393)..(393): n is a, c, g, or t
  modified_base (427)..(427): a, c, t, g, unknown or other
  misc_feature (427)..(427): n is a, c, g, or t
  modified_base (445)..(445): a, c, t, g, unknown or other
  misc_feature (445)..(445): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacgcccccgggaagggctggattggattggcagtatcagttatacgtgggacctaccttcttcaagtcgtcgctcgaagacgtcgagtccacatcgaccgcgacacgtccaaggccagttccncctgaacgctgacctctgtcgaccgccgcagacncggtctttgtactttcgngttcgctagacttataatggtggtgacgtaggtcgggtcgtccttaacgtacgggtacgttcgttttagacgtttacgtttgggggacccaagggtccgtaacggtaacgg

SEQ ID NO: 95278 - DNA, 636 bp, Homo sapiens
  misc_feature: GYAE6OF01A9UXR.51.36.D03.1.454.CMB.1.raw
  modified_base (353)..(353): a, c, t, g, unknown or other
  misc_feature (353)..(353): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagattattactacgtggggctggatccggcacgccccccggggaagggctggattggattggcagtatcagttatacgtgggacctaccttcttcaagtcgtcgctcaagngtcgagtcaccagtcgaccgcggaccacgtccgaacggacctagttcctccctggaaacgtctacggaaccttcgtggtcgacccgccgacacgaccacggtctttagttactttcgtagtcgtactaagtattaacgttaagtggttaggggtacgtaaccgttagggttcgggttaccgtacccgttaacggttaccgggtacggttacccgttttttaggacgttttaacgggttttacggggaacccgtaaaggggtcccgtaaacgggtaaaccgggg

SEQ ID NO: 95279 - DNA, 682 bp, Homo sapiens
  misc_feature: GYAE6OF01CH82Z.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtgggctggactccggcgaccggccccccggggaaggggctggagttggagttggcagtatcgtagttactacgtcgggtacctacctttcttacgaagtcgtcgctacaagacgtcgagtcacatcgaccgcggaccacgtaccgaacggacctagttcctcccgtagaacgtctcgtacctcgtcgtacgacccgtccgcaacgaccgtacggttcttttacgtacttttcgtcggttacgtaccgttagtaattaacgttaaggttggttacggggtacgtaacggtacgggttacgggttaccggtaccccgtttaagggttaaccggggttacgttttccggttttttaaggaacggtttttacgggttttaccggggggaaccctaaacgggggtaccgtaaaccggggttaaacccgggg

SEQ ID NO: 95280 - DNA, 744 bp, Homo sapiens
  misc_feature: GYAE6OF01B8J4W.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctcgtggcgctcatcagtagtagatattactacgtgggctggactccggcgaccggccccccggggaagggccgtggacgtttggagttggactaggtatcgagttaactacgtcgggtaaccctaccgtttcttacgtaacggttccggtcgaccgttacgaaacggtacgtacggtaacggttacccaacctacgtaccggtaaccccgggacggtaacccgtaacccggttaccccgaaacggggtaaccccgtacggtttacccctacccgtaaggaaccggtccgttaccgaacccgttcggttacggttaccggaacccggcccggaccgtaaccggaaccgttaccgggtttaccttttagtttaacgttttccgttacggttcggttacgttaagtaactttaagttaaacggtgggttgggtacgtacggtaggtacggtcgtaccgttaacggtacggtagtttcgttttaggacgtttagggttcgggaaccaagggtcctaaggtaaccgg

SEQ ID NO: 95281 - DNA, 727 bp, Homo sapiens
  misc_feature: GYAE6OF01BTLS1.51.36.D03.1.454.CMB.1.raw
tcagcgatcgtatacacgaccggtgctcgatttagctgcgtcacgatctctcttggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgcttctgtctcgtggcgctccatcagtagtagtattattactacgtgggctggtacgtccggaccgaccggcccccggggaaggggtcgtaggagttcggtagttggctagtatcgtagttactacgtacgggaccctacgttcttacgaagttccgtacgaatacgaaaggtacgtacgacgtacaccgacgtcgaccgacggaccacgggtaccaacgggtacctacgttcctaccgtagaacgtccgtacgtacccgtcgtacggtaccgacccggacccgactaaccggtaccgtacggttctttttacgtacgtttccggttattcggtaccgttaagttaactttaaagttaacggttcgggttagggttacgtacggtagggtttacgggtccggtaacccgtttaaccggtaacggttacggttacggttttttaacgaacggttttaaccgggtttacggggaaacccgtttaaacgggtaccggttaaacccgggtaaaccggg

SEQ ID NO: 95282 - DNA, 594 bp, Homo sapiens
  misc_feature: GYAE6OF01BTZC1.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggccaggacttgtgaagccttcggagacactgtccctcacctgctctgtctctggcgctccatcagtagtagatattactacgtgggctggatccggcacggccccccgggaaggggtcgtggtagttggtagttggactagtatctagttatacgtgggacctacttctcaagtcgtcgctcgaagagtcgagtcaccatcgacgcggacacgtaccgaaggacctagttcctcccgtagaacgtctacgtaccctcgtcgtcgacccggtccgacgtacgaccgtacggtcttttagtacttttcgtgttacgtctagtattattaagtggtcgggtacacgtaggtcggtacgtccttaagtacggtgtacgttttgaagtttacggtttacggggacctaagggtccgtaaggtaacgg

SEQ ID NO: 95283 - DNA, 576 bp, Homo sapiens
  misc_feature: GYAE6OF01CEHP0.51.36.D03.1.454.CMB.1.raw
  modified_base (187)..(187): a, c, t, g, unknown or other
  misc_feature (187)..(187): n is a, c, g, or t
  modified_base (248)..(248): a, c, t, g, unknown or other
  misc_feature (248)..(248): n is a, c, g, or t
  modified_base (403)..(403): a, c, t, g, unknown or other
  misc_feature (403)..(403): n is a, c, g, or t
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggactttgngaagccttcggagacactgtccctcaccttgcttctgtctctggcgctccatcagtagtanatattactacgtgggctggactccggcgacggcccccgggaagggcgtggagttggattggcagtatcagttatacgtcggacctacttcgtacaagtccgtcgctcgaagagtcgagtcacagtcgaccgcgacacgtcaacgacctagttccnctagaatctgactcngtcgacgccgnacgacacggtntttagtacttgtagtgtacttagtatacgttaagttcggaggtagtaccgaagggtttcgtacgtacccttagggtacggtcgttcgttttagacgtttacggttacgggaacctaacggtcgaaggttaacccgg

SEQ ID NO: 95284 - DNA, 654 bp, Homo sapiens
  misc_feature: GYAE6OF01CC6EG.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctcgtggcgctccatcagtagtagatattactacgtgggcgtggacgtccggcgaccgggacccccggggaagggcgtaggtagtggtatggacagtatacgtagttatacgtcggtaccctacttctactaagtccgtcgtactacaaggtacgtacgacgtaccacacgtcgaccggcggaacaccgtacgaacgtacccgtacgttccctacctacggtaacgccgtacgtacccgtcgtcggtacccggacccgcccgtaccaacggtacccgtaacggttctttacggttactttcgtgtacgtactagtaacttagtagtggtgggtagtaccgtaggtcggtcgtacccgttaaggtacgggtctttacgtttggtaacgtttacgggtttacgggaaccggtacggaacggtaccggtaaccggg

SEQ ID NO: 95285 - DNA, 814 bp, Homo sapiens
  misc_feature: GYAE6OF01DXOE3.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggacttgtgaagccttcggagacactcgtccctcacctgctctgtctctggcgctccatcagtagtagatattactacgtggggctggactccggacaccggccccccggggaagggggccgtaggggtagtttcggggaagtttcgggaccgtaaggttacttaccgtaaggttttaactaccgttacgggtaacccctaccccgttttacgttaccgtaaacggttccggttccgtaccgttaccgtaaaggtaacggtaccggtaacggtaccaacccgtagtaccgggaaccccggaccgggaacccgtaaacccggttacccggaaaccgggtacccttaaccggtttcccccgttaccccgttaggaaccggtccgttaccggtacccgttccgttcgggaccgtaccccggcccgaccgtaacggtaccccgtaacggttcgtttttacgttacgtttttcccgtaggttaccgtacgttaagtatttaacgttaagttgggttagggttacacggttagggttcgggtacgtacccgttaaggttaacccgggtagtttaccgtttttacgaacgttttacgggtttacggggaacccggtaacggtccggtaacgggtaaacccggg

SEQ ID NO: 95286 - DNA, 635 bp, Homo sapiens
  misc_feature: GYAE6OF01C6WTR.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtccccagttgcacctgcaggagtcgggcccaggacttgtgaagccttcggagacactcgtccctcacctgctctgtctctggcgctccatcagtagtagattattactacgtgggctggacgtccggcaccggacccccggggagggctggtagttggagttcggcagtatcgtaagttactacgtcgggaccctaccttcttacaacggtcgtcgctacgaaagtgtcgagtccactagtcgaccgcggactacgtaccgaaggacctacgttccctacctagaacgtcctacgaccttcgtcgtcgacccggccgacgaacgaccgtacggttcttttacgttactttcgtcgttgtaccgttagtaacttaagttaacggttggtagggtagtaacgtaggttcggtcgtaccgttacggttaacggtgtttcgttttagacgtttacggtttacgggacgttaaacggccgtaacggtaacgg

SEQ ID NO: 95287 - DNA, 681 bp, Homo sapiens
  misc_feature: GYAE6OF01A6LWS.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtcgggcccaggacttgtgaagccttcggagacactcgtccctcacctgctctgtctcgtggcgctccatcagtagtagattattacgtacgtggggctggacgtccggcgaccggaccccccggggaagggcgtagggtagttggtagttggactagttatcgtagtttacgtacgtacgggacctacctttcgttacgaacgtcgtcgtctacgaacgtacgtcgtacgtaccgactacgtacggacccggacggaccgtaccgtaccgaaccggtacctacgttccctaccgtagaacgtcgtacgtacccttacgtcggtaccgacccgtccgacgaacgaccgtacggttcttttacgttactttcgtcggttacgtacgttagtacttaagttaacggttggttagggtacgtacgtaggttcggtacgtacccgtaacggttacggttacgttacgttttaggtagtttacgggttacggaacggtacggtacgacgggtaaccgg

SEQ ID NO: 95288 - DNA, 564 bp, Homo sapiens
  misc_feature: GYAE6OF01BBQY7.51.36.D03.1.454.CMB.1.raw
  modified_base (520)..(520): a, c, t, g, unknown or other
  misc_feature (520)..(520): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtatagatattactacgtggggctggactccggcacggccccccggggaagggctggagttggattggcagtatcagttatacgtcggacctaccttcttcgaagtcgtcgctacgaagagtcgagtcacatcgaccgcggacacgtaccaacggacctagttccacccgtgaacgctgaccctcgtcgtccgaccgccgacgacgacacggtctttcgtactttcgtgtgctaggtattataagtggtggtagacgtaggtcggtcgccgttagtacggtntcgttttagattacggtttacgggacctaaggtcgaggtaacgg

SEQ ID NO: 95289 - DNA, 561 bp, Homo sapiens
  misc_feature: GYAE6OF01E3AXJ.51.36.D03.1.454.CMB.1.raw
  modified_base (480)..(480): a, c, t, g, unknown or other
  misc_feature (480)..(480): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacggccccccggggaaggggctgggattggattggcagtatcagttatacgtgggacctaccttcttcaagtcgtcgctcaagagtcgagtcaccatcgaccgcggacacgtaccaaggacccagttcctccctagaacgcctgaccctctgtcgacccgccgcacgaccacggtctttgtatttcgtgtgctagatataagtgtgggtnacgtagtggtcgcccttaagtacgggtgttcgttttaggattacggtttacgggggaccaacgggtccgaacggtaacggg

SEQ ID NO: 95290 - DNA, 892 bp, Homo sapiens
  misc_feature: GYAE6OF01C9K3B.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtgttcttcctcctcctggtggcggctcccagatgggtcctgtcccagttgcacctgcaggagtccgggcccaggacttgtgaacgccttggagacactcgtccctcacctgcttctgtctcgtggcgcctccatcgaagtagtagtattattaactacgtggggctggactcccggaccgaccggccccccggggaagggccgtagggtagttggtagttcgggctaggtactcgtaagtttacgtacgtacgggtaccctaccgtttactttaccgtaacggttccgttaccgtaccgttaccgtaaaaggtacggttaccggtaacgtaaccctaaccgtaacgttaccggaacccccgggtaaccggtaacccgtaaaccgggttacccgaaaaccggggtaacccgttaaccggttttacccgtaccccgtaaggaaaccggtcccgttaccgtaaccccgttaccgttacgggtacccggaaccccgggcccgtaaccggaaccggttaacccggaccggttttacttttacggtttacctttttccgttcggttccggttaacccgttaagttaaaccgttaaagtttaacggttacggggtttaggggttaaccgtaacggttacggggttaccgggttaacccggtcccgtttaaacccgggttaacggggttccggtttttaacggttttttacccgggtaaaggtttttaacggggttttacccgggggaaaccgtttaaaacgggggtccccgtaaaaccggggttaaaccccggg

SEQ ID NO: 95291 - DNA, 557 bp, Homo sapiens
  misc_feature: GYAE6OF01DV60Y.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtcgggccaggacttgtgaagccttcggagacactgtccctcacctgctctgtctctggcgctcatcagtagtagatattactacgtgggctggactccggcacggcccccgggaagggctggattggattggcagtatcgtagttatacgtggacctaccttctcgaagtcgtcgctcaagacgtcgagtcactatcgacgcggacacgtaccaaggaccagttccacctagaacgctgacctctgtcgaccgccgcagacgtcggtctttgtatttcgtgtgtactagtatattaagtggtagggtgagtaggtggtcgccttaagtacgggtagttcgttttagagtttacggtttacggggacctaagggcgaacgggtaaccgg

SEQ ID NO: 95292 - DNA, 617 bp, Homo sapiens
  misc_feature: GYAE6OF01EQMCH.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctcgtggcgctccatcagtagtagatattactacgtgggctggactccggcgaccggcccccgggaagggctggagttggagttggcagtatctagttatacgtcgggacctacttctacaacgtcgtcgctacgaagacgtcgagtccacagtcgaccgcgaaccaccgtaccgaacggacctacgttcctacccgtagaacgtctacgacctcgtcgtacgacccgccgacaacgaccgtacggttctttgtactttccgtgtacgtacgtaagtaattaagttaagtggttgggtagacgtggtaggtcgtaccgttaacgttacgggtagttaccgttttagtaacgtttaggtttacggggaaccttaagggtccgtaagggttaaccggg

SEQ ID NO: 95293 - DNA, 641 bp, Homo sapiens
  misc_feature: GYAE6OF01BU8RS.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctcgtggcggctccatcagtagtagattattactacgtgggctggatccggcacgcccccggggaagggctggattggattggcagtatcagttatacgtcgggacctaccttcttacgaacgttcgtcgcttacaaggacgtacgagttccaacagtcgacccgacggaccaacggtccgaacggaccctacggttcctaccccgtagaacgtcgtacgacccttcgtggtccgacccggccgacacggacctacgggttcttttcgtactttccgtgttacgtacttaagtattacttaagttggtagggtagtacgtaggttcggttcgtacccgttaacggtacgggtcgttacgtttttaggaacgttttacggggtttacggggacccaaagggttccgaaccggttaaccggg

SEQ ID NO: 95294 - DNA, 635 bp, Homo sapiens
  misc_feature: GYAE6OF01CNIYW.51.36.D03.1.454.CMB.1.raw
  modified_base (325)..(325): a, c, t, g, unknown or other
  misc_feature (325)..(325): n is a, c, g, or t
  modified_base (426)..(426): a, c, t, g, unknown or other
  misc_feature (426)..(426): n is a, c, g, or t
tcagcgatcgtatacacgaccggtgctcgatttagctgcgtcacgatctctcttgggggctttctgagagtcgtggatctcatgtgcaaagaaaaatgaagcacctgtggttcttcctcctcctggtggcggctcccagatgggtcctgtcccagttgcacctgcaggagtcgggcccaggacttgtgaagccttcggagacactcgtcccctcacctgctctgtctcgtggcgctccatcagtagtagattattactacgtggggctggactccggcgaccggccccccggggaaggggccgtaggagttggagttggctagtntctagttatacgtcggacctaccttcttacagtccgtcgctacgaagagtcgacgtcaccagtcgaccgccggacaccgtaccaaggtaccctacgttccncccgtagaacgtcctcgaccctcgcggtcgaccccggccgacgacgaccgtacggttcttttacgttacttttctagggttcgtacgtaggttaacttaagttaagttcgggtagggttcacggtaggttgggtacgtcccgtaacggttaaggtgtttccttttagacgtttcggtttacggggacctaagggccgtaagggtaacgg

SEQ ID NO: 95295 - DNA, 666 bp, Homo sapiens
  misc_feature: GYAE6OF01D0FRN.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactcgtccctcacctgctctgtctctggcgctccatcagtagtagattattactacgtgggctggacgtccggcgaccggcccccggggaagggcgtggatggtattggctagtatcgtagttactacgtcggtacctacttctacgtaacgtcgtacgtctacgaagtacgtcgtagtcacagtcgaccgacggacacgtaccgaacgtcctacgttcctacccgtagaacgtcctacgacccgttcgtacggtaccgacccgccgacgaacggaccgtacggttccttttagttaactttccgtaggtacgtacgttaagtaactttagttaacggtgggttacgggtacgaccgttaggttcgggtaccgtacccgttaacggttacgggtacgtttaccgttttaggaacggttttcgggtttccgggaaaccgtacgggtaccgtaacgggttaacccggg

SEQ ID NO: 95296 - DNA, 580 bp, Homo sapiens
  misc_feature: GYAE6OF01DDTMS.51.36.D03.1.454.CMB.1.raw
  modified_base (361)..(361): a, c, t, g, unknown or other
  misc_feature (361)..(361): n is a, c, g, or t
  modified_base (469)..(469): a, c, t, g, unknown or other
  misc_feature (469)..(469): n is a, c, g, or t
  modified_base (510)..(510): a, c, t, g, unknown or other
  misc_feature (510)..(510): n is a, c, g, or t
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtcgggcccagggacttgtgaagccttggagacactcgtccctcacctgcttctgtctcgtggcgctccatcagtagtaagattattacgtacgtgggctggactccggacaccggcccccgggaaggggctggtagttggagttggactagtatcgtagttatacgtcggacctacttctacgtagtcgtcnctacaagtcgtcgacgtcacagtcgacgacggacacgtacgaaggacctagttccctaccgtagacgtctcgtacctcgtcgcgaccgccgtacacgacgtacggttntttagttagtttctgtcacgttagataagtagtggtaggtntagtaggtggtcgtacctagtaggtgttcgtttagacgttggttacgggactaaggccgtaaggtaccgg

SEQ ID NO: 95297 - DNA, 723 bp, Homo sapiens
  misc_feature: GYAE6OF01C2HB0.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcgaggagtccgggcccaggtacttgtagaacgtccgttcggagaccacgtcgtcccctacacctgtcctctgtctcgtcggcgctccatcagtagtagtattacgttactacgtgggctggactccggacgaccggcccccggggaaggcgtgggtagtggtagttcggctaggtactcgtaagtacgtacgtcgggtaccttaccgttacgtacgtaacgttccgtcgtaccgtacgtaaacgtacgtacgtaacgtcctaaccgtagtaccggacccggacggaaccgtacccggtaccgaaacggtccctaacggttacccgtacccgtacggaactcgtaccgtaccgtcgttaccggccgtacccgccggacgtacgtaccgtacgggttcttttacgtcgtttcgtcgttgtaccgttaagagttaacgttaggtgggttaggtcgtaacggtgggttacggtaccgttacccgtacgggttacggttacggttttacgttaggttacgtttacgggttcgggaaccgtaacggtaccggaacggttaacccgg

SEQ ID NO: 95298 - DNA, 661 bp, Homo sapiens
  misc_feature: GYAE6OF01C3DLJ.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggacgtcgggcccaggacttgtgaagccttcggagacactcgtccctcacctgctctgtctcgtggcgctccatcagtagtagtattattactacgtgggctaggacgtccggacgaccggcccccggggaaggggctaggtagttggtagttggactagtatcgtaagttatacgtacggacctaccgttctacgagtccgtcgtactacgaaagcgtacgactaccaacctacgtacgacccggcggaaccgtaccgtaccgaacggtaccctacgttccctaccgtagaacgtctacgtacctcgtagtccgacccgccgacacggtaccgtacggttctttagttacttttcgtgttacgtacgtagtaattagtaagttggtagggttacgacgtagggttcggtaccgtacccgttacgttacgggtagttttacgtttagttaacgttacgggtttacggggaacctaagggccgtaacgggttaacgg

SEQ ID NO: 95299 - DNA, 672 bp, Homo sapiens
  misc_feature: GYAE6OF01B3LIJ.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcggcccaggacttgtgaagccttcggagacactgtccctcacctgctctgtctctggcggctccatcagtagtagattattactacgtgggctggactccggcacggccccccggggaaggggctggagttggagttggctagtatctagttatacgtgggacctaccttctcaagtcgtcgctacaagacgtcgagtccaccagtcgaccgcggacaccgtaccaaggacctagttcctaccctagaacgcgtacgacccgttcgtacgtacgacccgccgacgacgacgtaccggttctttagttactttcgtggttcgaccgttaaggtaacttaagttaacggttggttacggggtagtaacggtaacgggttcgggttaccggtaccccgtttaaccggttaaccgggtacgttttccgtttttaacgggtaaagttttaacgggttttacggggggaacccctaaacggggtaccgtaaaccggggttaaaccgggg

SEQ ID NO: 95300 - DNA, 651 bp, Homo sapiens
  misc_feature: GYAE6OF01C23WH.51.36.D03.1.454.CMB.1.raw
  modified_base (456)..(456): a, c, t, g, unknown or other
  misc_feature (456)..(456): n is a, c, g, or t
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtccgggcccaggacttgtgaacgccttcggagacactcgtccctcacctgctctgtctcgtggcgctccatcagtagtagattacttactacgtggggctggacgtccggcgaccggaccccccggggaaggggcgtaggtagttggtagttggacgtagtatccgtaagttacgtacgtcggaacctaccttcgttacgaagtccgtcgactacgaagtacgtcgagtacacctagtacgaccgacggacacgtaccgaacgaccgtacgttcctaccgtagaacncgtacgtaccttcgtacgtccgaccgtcccgacacgtaccgtacgttctttagtactttcgtgttcgtacttaagtagttaagttaagtggtacgggtagtaccgtaggtcggtacgtaccgttacggttacggtacgtttacgtttaggttaagttacgggtttacgggacctaacgggctaacgggtaaccgg

SEQ ID NO: 95301 - DNA, 559 bp, Homo sapiens
  misc_feature: GYAE6OF01EOZ4R.51.36.D03.1.454.CMB.1.raw
  modified_base (331)..(331): a, c, t, g, unknown or other
  misc_feature (331)..(331): n is a, c, g, or t
  modified_base (514)..(514): a, c, t, g, unknown or other
  misc_feature (514)..(514): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcacgccccccggggaaggggctggattggattggcagtatcagttatactgggacctaccncttcgaagtcgtcgctacaagagtcgagtcaccatcgaccgcggacacgtccaacggaccagttcctccctgaacgctacgtacctctgcgacccgccgacacgacgacggttctttgttactttcgtgtgtactagtattaataattggtgggtgacgtaggtaggtcgccttacgtacggngttctttagattacggttcgggaaccaacggtcgaacggtaacgg

SEQ ID NO: 95302 - DNA, 608 bp, Homo sapiens
  misc_feature: GYAE6OF01D76MV.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtcgggcccaggacttgtgaagccttggagacactgtccctcacctgcttctgtctcgtggcgctcatcagtagtagatattactacgtgggctggacgtccggcgaccggacccccggggaagggctggagttggagttggctagtatcgtagtatacgtcggacctacttctacgaacgtcgtcgactacgaagtacgtcgacgtacaccagtacgaccgacggtactacgtaccgaacggtacctacgttccctaccgtagaacgtcgtacgtaccgttcgtacggtaccgacccgccgacgaacggtaccgtacggttcttttcgtactttcgtagtctacgtaagtattagtagtggtaggtcagtgtgtcgtaccgtagtacggtgttcgtttagagttacggttacgggaaccgtaggtcgtaacggtaacgg

SEQ ID NO: 95303 - DNA, 718 bp, Homo sapiens
  misc_feature: GYAE6OF01D71Z7.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtccgggcccaggacttgtgaacgcccttcggagaccacctgcccctcacctgctctgtcctcgtggccgctccatcagtagtagattattaactacgtggggctggacgtccggcgaccggaccccccggggaagggccgttggaagttggtagttggactaggttactcgtaaggttactacgtacgggtacccctacctttaccgttacgaagttccgtccgtactacgaaacggtacgttaccggtagtaccacccgtagtaccgggacccggaccggaacccgtaccggtaacccgaaccgggtaaccttacggttccctacccgtaggtaaacgtccgttacgaccctacgttccgtacgacccgcccgacgaacgtacccggtacgttcgttttagttactttcgtgtacgtacgtaagtattaagttaacgttgggtacgggtactacgtagggttcggtaccgtaccgttaggtacgggtatttcgttttagtaacggtttacggttacgggaacccgtaagggcctaacgggtaaaccgg

SEQ ID NO: 95304 - DNA, 609 bp, Homo sapiens
  misc_feature: GYAE6OF01A5NAX.51.36.D03.1.454.CMB.1.raw
  modified_base (483)..(483): a, c, t, g, unknown or other
  misc_feature (483)..(483): n is a, c, g, or t
  modified_base (499)..(499): a, c, t, g, unknown or other
  misc_feature (499)..(499): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccgagatgggtcctgtcccagttgcacctgcaggagtcgggcccaggacttgtgaagccttcgggagacactgtccctcacctgctctgtctctggcggctccatcagtagtagatattactactggggctggactccggcgacggcccccgggaaggggctggattgggattggcaggtatcgaggttatacgtgggaccctaccgttcttacgagttcgtcgctacaagtagtacgtagtacaccagtacgacccggcggaaccaccggtaccaacggaccctaaggtttccctaccccttacgaaacgtcctggaaccctccgtaggtcgacccgtccgcgagaccnggtctttgtactttcngtgctgtaatataagtgtgggcgtacgtagtcggtgtcccgttacggtaggtcgttcgttttagacgtttacgttgggggaaccctaagggtccgtaacggtaaaccggg

SEQ ID NO: 95305 - DNA, 610 bp, Homo sapiens
  misc_feature: GYAE6OF01CO189.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtcgggcccaggacttgtgaagccttcggagacactcgtccctcacctgctctgtctctggcgctccatcagtagtagatattactacgtgggctggagtccggcacggcccccgggagggctggagttggagttggctagtatcgtagttactacgtacgggacctaccttctacaagtccgtcgactacaagtacgtcgacgtcaaccagtacgaccgcggaacaccggtaccaacggtacctacgttcctacccgtagaacgtctcgacctctcggtcgacccgccgacgacgtaccgtacggtctttagttactttcgtgtgtacctagtaacttattaacgttggtacggtagaacgtggttggtcgtacctaaggttacggtacgtttcgtttagagtttacggttcgggaacctaaggccgtaacgggtaaccgg

SEQ ID NO: 95306 - DNA, 838 bp, Homo sapiens
  misc_feature: GYAE6OF01CLIUY.51.36.D03.1.454.CMB.1.raw
tcagcgatcgtatacacgaccggtgctcgatttagctgcgtcacgatctctcttggggctttctgagagtcgtggatctcatgtgacaaagaaaatgaagccaccgtgttcgttccttccctcctccgtggtcggccggcctacccgagtagtcgggtccctcgtcccgtagttcgccaccgtgacgagggacggtcccgggcccgaggtacttgtagaacgtccgttacggagacctacgtccgtccctaccgtaccgttgtccttcgtcgttccgtcggtcggcccgtcctacctagtacgtaaggttagtaagtattaacgttacgtaggtcggtacgtggtaccgtccggaccgacccgggacccccggggaaggtcgtaggtagttaggtacgttcggacgtagtacgtacgtagttaactacgtaccggtaccttaccgttacgtacgtacgtccgtacgtactaacgtagtacgtacgtaacgtccgaacgtacggtaccgaccggaccggtaacgtacccgtaaccgtaaccgtaccgttaccgtttacccgtaccgtacgaaccgtccgtaccgtaccgtcgtacggtacccggtacccgcgaaccgtaaccgtaccgttaccggtttgtttaccgtttacgtttccgtacggttacgttaaccgtagttaacgttaagtttaggtacgggttagggtaactaaccgggttggttaccggtaccggttaccggttaaaccggttacggttacgttttacgttaaggtttaacgggttaccgggttaaccgggaaccggttaaacggtaccggtaaaccggttacccggg

SEQ ID NO: 95307 - DNA, 632 bp, Homo sapiens
  misc_feature: GYAE6OF01BUP4E.51.36.D03.1.454.CMB.1.raw
  modified_base (546)..(546): a, c, t, g, unknown or other
  misc_feature (546)..(546): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcgggagacactcgtccctcacctgctctgtctcgtggccgctccatcgagtagtagatattactacgtgggctggactccggcacggcccccggggaagggctggagttggatttggctagtatcgtagttactacgtcgggtaccctacccgtttcttcgtaacgtccgtccgctacgaaagtacgtcgacgtcaaccgagtacggaccggacggaccacggtacccaacgggacctacgttccctacccgtgaacgtctacgaccctcgttcgcggacccgtccgactacggaccgtacggttctttacgttactttcgtgtgtacctagtacttaattagtggtagggtnacgtaggtcggtacgtccgttacggtacggtcgttacgttttagacgtttacggttcgggggaacctagggacgtaccggtaacgg

SEQ ID NO: 95308 - DNA, 646 bp, Homo sapiens
  misc_feature: GYAE6OF01DS3XT.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtccccagttcgcacctgcgaggagtccgggcccaggacttgtgaagccttcggagacactcgtccctcacctgctctgtctcgtggcgctccatcagtagtagtatattacgtacgtgggtcgtggacgtccggacgaccggccccccggggaaggggccgtgggtagttcggtagttcggctacgtatcgtaagttacgtacgtcggtacctaccttcttacaacgtcgtcgctacgaagtacgtcgagtcaccagtacgaccgacgacctacgtaccgaacggtacctacgttccctacccgtagaacgtcgtacgtaccgtcgtacgtccgacccgcccgacgtaacgaccgtacggttcttttagttctttcgtgtgtacttaagtattaagtagttggtgggtactagtaggttcgtcgtaccgttagttacgggtagtttcgtttagtacggtttacggttacggggtacctaaggcgtaacgggtaaccgg

SEQ ID NO: 95309 - DNA, 570 bp, Homo sapiens
  misc_feature: GYAE6OF01EZ61U.51.36.D03.1.454.CMB.1.raw
  modified_base (464)..(464): a, c, t, g, unknown or other
  misc_feature (464)..(464): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggatccggcacggccccccgggaaggggctggagttggattgggcaggttatactagttatacgtcgggacctacctttcttacaagtcgtcgctacgaagagtcgagtccacatacgaccgcgacaccgacaacggaccacgttcctccgagtaacgctgacctctgtcgaccgcgcacgacacgtctttgtatttctgtntactagtattataagtggttgggtagtactaggtcggtcgtaccgttaagtacgggtagttcgtttagtagttacggttacggggactacgggcgaacggtaacgg

SEQ ID NO: 95310 - DNA, 643 bp, Homo sapiens
  misc_feature: GYAE6OF01EROSX.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcagggagtcgggcccaggacttgtgaagccttcgggagacactgtcccctcacctgctctgtctctggccgctccatcagtagtagatattactactggggctggactccggcacggcccccgggaagggctgggattggattggcagtatcgtagttatacgtcgggacctaccttcttacgaagtcgtcgctacaagtacgtcgagtcaaccagtcggaccgacggacaccggtaccgaacggaccctagttccctacccgtaggaacgtcgtacgaccttcgtacgtcgacccggccgacgaacggaccgtacggttccttttagtacgtttcgtacggttacgaccgttaagtacgttaattaagttgggttaggtcggtacgtaggtcggtcgtaccgtttacggtacgggtacgttcgttttaggaacgtttcgggtttacggggaccctaaaggggtccgtaacggtaaccggg

SEQ ID NO: 95311 - DNA, 655 bp, Homo sapiens
  misc_feature: GYAE6OF01DM8VD.51.36.D03.1.454.CMB.1.raw
  modified_base (199)..(199): a, c, t, g, unknown or other
  misc_feature (199)..(199): n is a, c, g, or t
tcagcgatcgtatacacgaccggtgctcgatttagctgcgtcacgatctctcttgggggctttctgagagtcgtggatctcatgtgcaaagaaaatgaagcacctgtgttcttcctcctcctggtggcggctcccagatgggtcctgtcccagttgcacctgcaggagtcgggcccaggacttgtgaacgccttcgganacactcgtcccctcacctgctctgtctcgtggccgctccatcagtagtagtattattactacgtgggctggactccggcaccggcccccggggaagggctggattggagttggctagtactcgtagtttactacgtgggacctaccttctcgaacgtcgtcgcctacgaaagtcgtacgagtaccacccgtagtccggacccgacggacctaccggtaccgaacggtacctacgttcctcccgtagaacgtctgacccttcgtcggtcgacccgcccgacgacgtaaccgtacggttccttttaggttactttcgtaggtacgtacttaagtattaacgttaagttgggtggggttaacacggtaggttcggtccgtaccgttaaccggtaggtacgtttcgttttaaggacgtttacggtttaccggggaacctaagggccgtaagggtaaaccg

SEQ ID NO: 95312 - DNA, 594 bp, Homo sapiens
  misc_feature: GYAE6OF01BFII3.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcagggagtcgggcccaggacttgtgaagccttcggagacactgtccctcacctgctctgtctctggcgctcatcagtagtagatattactacgtggggctggatccggcgacggaccccccggggaaggggccgtggtagttgggattggcagtatcagttatacgtcgggacctaccttcttacgaacgtcgtcgtctacgaagagtcacgtcacatcggacccgcggacaccgtaccgaacggacctacgttcctcccgtagaacgtctacgaccttcgtcgtccgacccggtccgacgacgaacgcggttactttgttactttgtcgtgcttaagtattaatattggtggtgacgtggtcggtcgtacctacggtaggtcgttcgtttaggagtttaacggttcgggaaccagggctaacgggtaaccg

SEQ ID NO: 95313 - DNA, 681 bp, Homo sapiens
  misc_feature: GYAE6OF01E24TW.51.36.D03.1.454.CMB.1.raw
  modified_base (451)..(451): a, c, t, g, unknown or other
  misc_feature (451)..(451): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaacgccttacggagaccactcgtccctcacctgctctgtctcgtggcgcctccatcaagttagtagatattactacgtggggctggacgtccggcgaccggcccccgggaagggctggagtggtatcggacagtatacgtagttactacggtacgaccttacttcgtactaggtccgtacgctacgaagtcgacgtacgccaacgtgtaccgaccggtacgaccgtaccgacgaaccgaccgtacgttccctccgtaagaccgtntaccgtaccttcgtacgtcccgacccgccgacgacgtaccgtacgtttctttacgttactttcgtagtcgtacgtaagttaattaacggttaggtgggttacgggtaacgtacggttagggttacggtacccgttaccgttaacgggtaacggttacgtttttcggttaaggttaacgtttacgggggtaccggaaaccggtacggtaaccgaaacggggttaaccccgg

SEQ ID NO: 95314 - DNA, 603 bp, Homo sapiens
  misc_feature: GYAE6OF01A9FYF.51.36.D03.1.454.CMB.1.raw
  modified_base (365)..(365): a, c, t, g, unknown or other
  misc_feature (365)..(365): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctcgtggcgctccatcagtagtagatattactacgtggggctggatccggcacggccccccggggaaggggctgggtagttggagttggctagtatcgtagttatacgtgggacctaccttcttcgaagtcgtcgctacgaagngtcgagtccaccagtcgaccgacggaccaccggtaccgaacggacctacgttccctacccgtaggaacgtcctacggacccttcgtacggtaccgacccgcccggacaacggtaccgtacggttcttttgtactttcgtgtcgacttagattaagtagtggtaggtgacgtaggtcggtagtccgttagacggtgttcgtttagagtttaggttcgggacaacggtcgaacggtacgg

SEQ ID NO: 95315 - DNA, 650 bp, Homo sapiens
  misc_feature: GYAE6OF01B7BUI.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctcgtggcgctccatcaatagtagatattactacgtggggctggactccggcgacggccccccgggaaggggcgtggagttggagttggactagtatctagttatacgtggacctacttctacaagtcgtcgctacaagagtcgagtcacatacgaccgacggacaccgtaccgaacggaccctacgttcctacccgtagaacgtccttacgaccttcgtcgtaccgacccgccgacaacgacgtaccggttctttagttactttcgtgtacgtacgttaagtattaagttaaggttggttagggtacgtaacgtaggttcgggtaccgttacccgttaacggttaacggggttactttccggtttttaggtaacgttttacgggtttacggggaacccgtaaacggggccgtaaacgggttaaccggg

SEQ ID NO: 95316 - DNA, 695 bp, Homo sapiens
  misc_feature: GYAE6OF01BF03A.51.36.D03.1.454.CMB.1.raw
  modified_base (305)..(305): a, c, t, g, unknown or other
  misc_feature (305)..(305): n is a, c, g, or t
tcagcgatcgtatacacgaccggtgctcgatttagctgcgtcacgatctctcgttgggggctttctgaggagtcgtggatctcatgtcgctaagaaatgaagcacctgtgttcttcctcctcctggtggcgctcccagatgggtcctgtcccagttgcacctgcaggagtcggcccaggacttgtgacgccttcggagacactcgtcccttcacctgctactgtctctggcgctcatcgagtacgtatatattactacgtgggctcggactccggcacggcccccgggaagggctggtagtcggngttggcgtagtagtacgtaggttactacgtcgggtacctacctttctacgtaacgtccgtcgctacgaagtacgtcgtacgtccaccagtcggacccgcggaacctaccgtaccgaacggccctaacgtttccctaccctaggaacgtccgtacgacccgttcgtacggttccggaaccccggccgacgtaacggaccgtacccggttcttttacggttacttttccgtggttacgtacgtttaagtaacgtttaagttaacggttgggttacggggtagtaccggttaggttacggggttacctacccgttacgggtacggttacgtttacgttttagaacgttttcgggttacggggaacccgtaagggtccgtaacgggtaacccgg

SEQ ID NO: 95317 - DNA, 620 bp, Homo sapiens
  misc_feature: GYAE6OF01DVFGL.51.36.D03.1.454.CMB.1.raw
  modified_base (198)..(198): a, c, t, g, unknown or other
  misc_feature (198)..(198): n is a, c, g, or t
  modified_base (494)..(494): a, c, t, g, unknown or other
  misc_feature (494)..(494): n is a, c, g, or t
tcagcgatcgtatacacgaccggtgctcgatttagctgcgtcacgatctctcttgggggctttctgagagtcgtggatctcatgtgacaaagaaaatgaagcacctgtgttcttcctcctctggtggcggctcccagatgggtcctgtccagttgcacctgcaggagtccggccaggacttggtgaacgccttcgganacactcgtccctcactgctctgtctcgtggcgctccatcgagtagtatattagttacacgtggggctaggacgtccggcaccgggcccccggggagggcgtaggtagtggagtggcagtactgtacgttatacgtacggtacctacttactacgtaacgtcgtcgtactacgaaggcgtcgacgtccacgtgtaccgaccgacgaccgtacgtaccgaacgtacctacgttcctaccgtagaactcgtaccgtacctcgtacgccggacccgtcgcgaacgtaccgtagttcgttnttacttcgtagtcgtacgttaagattacgtagtggtaggagacggtagtcggtcgtacccgtaagtacggttcgttcgtttaggacgtttacgggttcggaacccggtaaggcgtaacggtaacgg

SEQ ID NO: 95318 - DNA, 615 bp, Homo sapiens
  misc_feature: GYAE6OF01BDBGN.51.36.D03.1.454.CMB.1.raw
  modified_base (436)..(436): a, c, t, g, unknown or other
  misc_feature (436)..(436): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtcccctcacctgctctgtctctggcgctccatcgagtagtagatattactacgtgggctggagtccggcaccggaccccccgggaagggctggagttggagttggcgagtatcgtagttatacgtcggtacctacctttcttacgtacgtcgtcgtacctacgaaggtacgtccggacgtcaacctagtacggaccgtcggaccaccgtaccgaacggtaccctcgttcccncccgtagaacgtcctacgacctctcgtccgaccgccgacgacgacctcggttctttgtactttctgtcagttagtattatagtggtgggtagtacgtaggtcggtacgtaccgttacgtacgggtctttcgttttagtaagtttcggttacggggaacctaaggtccgaaggtaaccgg

SEQ ID NO: 95319 - DNA, 802 bp, Homo sapiens
  misc_feature: GYAE6OF01BDP10.51.36.D03.1.454.CMB.1.raw
tcagcgatcgtatacacgaccggtgctcgatttagctgcgtcacgatctctcgttgggggctttctgagagtcgtggatctcatgtgcaaagaaatgaagcacctgtgttcttcctcctctggtggcgctccagatggtcctgtccagttgcacctgcaggacgtccggccaggtacttgtagacgtccttcggagactactcgtccctcacctgcctctcgtctcgtcggcgctcatctagtagtagtattacgttacgtacggtcggacgtggtacgtccggacgacccgggaccccggggaagggtcgtaggtacgttggtacgttcggacgtacgttacgtacgttaacgtttaacgtaccggttacggtaccctttaccgtttaccgttacgtaacgggttccgtacgtacgttaacgaacgtacggtacgtacgtacctaaccgtacggtaccggaacccggtaccggtaaccgtaacccggtacccggtaaaccggtaccctttaccggtttacccgtacccggtaacggtaaccgttccctaaccggttaccgttaccggttacgggtaccccggtaacccggtccggtaaccgtaacgtcccgttacggttttacttttacgtttaacgtttcggttacggtacgtacgttaacggtaagtttacgttaaggttcgggtaacggtacgtaccggttgggttaccggttccgtacggttaccggttaggttacttacggttttaggtacgtttacgggtaccgggaacgtacgggttacgtaacgggttaacgg

SEQ ID NO: 95320 - DNA, 601 bp, Homo sapiens
  misc_feature: GYAE6OF01DWVY8.51.36.D03.1.454.CMB.1.raw
  modified_base (492)..(492): a, c, t, g, unknown or other
  misc_feature (492)..(492): n is a, c, g, or t
  modified_base (505)..(505): a, c, t, g, unknown or other
  misc_feature (505)..(505): n is a, c, g, or t
  modified_base (557)..(557): a, c, t, g, unknown or other
  misc_feature (557)..(557): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccgttcggagaccactgtccctcacctgctctgtctcgtggcgctccatcagtagtaagattattactacgtggggctggactccggacgaccggaccccccggggaagggggcctgggtaactttggaagtttcggactagtatcgtaagtttactacgtacgggtaccctacctttcttcaacggttccgtcggtacttcgaaagagtcgagtaccaccgagtcgacccggcggacacgtaccgaacgtacctacgttcctccctagaacgctgacctgtcgcgccgcgcagaccgacgtntttagtctttcgngtagctagacttaatagtggtggtagagtggtggtcgtaccttagtacggtnttacgttttgaacttggttacgggactaaggccgaaggtaacgg

SEQ ID NO: 95321 - DNA, 730 bp, Homo sapiens
  misc_feature: GYAE6OF01C8O9T.51.36.D03.1.454.CMB.1.raw
  modified_base (206)..(206): a, c, t, g, unknown or other
  misc_feature (206)..(206): n is a, c, g, or t
tcagcgatcgtatacacgaccggtgctcgatttagctgcgtcacgatctctcttgggggctttctgagagtcgtggatctcatgtgcaagaaatgaagcactgtgttcttcctctctggtgcgctccagatggtcctgtcccagttgcacctgcaggagtcgggcccaggtacttgtagaacgccgttcggagacactcgtccctnacctgctctgtctcgtggcgctcatctagtagtagatattactacgtgggtctggacgtccggcgaccggcccccgggaaggggtctggtaagtttcggaagttggcctaagtatacgtaagttactacgtacggaacccttacttcgtacgtaacggttcgaccgtacttaaccggaaaggtaccggttaccgtaaggtacccgtaacccgtagttaaccggacccgggtaaccggtaaaccggtaccggttaacccgaaaacggtcccgttaacgtttacccgtacccggttagaaacgtccgtaacgtaccgttacgagtaccgaccgtccggacacgtaccgtacggtcttttacgtacgtttcgagtacgaacgtttaagacgttaacgttaacgttgggttacgggtaatacggtagggttacggtaccgttacccgtttaagacgggttctttaccggtttaaggacttttacgggttacgggaacccgtaaggggtacctaaccggggttacccgg

SEQ ID NO: 95322 - DNA, 730 bp, Homo sapiens
  misc_feature: GYAE6OF01C5TQ4.51.36.D03.1.454.CMB.1.raw
tcagcgatcgtatacacgaccggtgctcgatttagctgcgtcacgatctctcttgggggctttctgagagtcgtggatctcatgtgacaaagaaaatgaagcacctgtggttcttcctcctcctggtggcggctcccagagtgggtcctgtcccagttcgcacctgcagggaggtccgggcccaaggtacttggtaggaacgtccgttacgggaagacacctcgtcccctacacctgcttctcgtcctcgtcggcgtcctcctatcgagtagtagtattattacgtacgtgggcgtaggtacgtccggccgaccgggaccccggggaagggcgtgggtagttaggtagttcggactaagttacgtacgttaagttaaccgtacgttaccgggaacccttacccgttacgttacgtaacggttccgtacgtaccgtaacgtaaaggtacgtaccgtaacgttacgaaccgtacgtcggaacccggacggtaaaccaccggtaccgaaacgaccgttaacgtccttaccgacgtacgtaccgtacgtaccttcggtacgtacgacccgccgacgaacgaccgtacgttctttagtacttcgtagtacgtacttaagagttacttaaggtggtacggtagacgttgggtacgttccgaacgttacggttaaggtcgtttacgtttaggtaacgttacgggttacgggacctaacgggcgtaaacgggtaccgg

SEQ ID NO: 95323 - DNA, 593 bp, Homo sapiens
  misc_feature: GYAE6OF01CXETK.51.36.D03.1.454.CMB.1.raw
  modified_base (484)..(484): a, c, t, g, unknown or other
  misc_feature (484)..(484): n is a, c, g, or t
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggccgctccatcagtagtagtattattactacgtgggctggactccggcaccggcccccgggagggtctggagttggattggcagtatctagttactacgtcgggacctaccttctacgaagttcgtcgctacgagtacgtacgacgtcactagtcggaccgcggtaacacgaccgaagacctacgttcctcccgtagaacgtctcgtacctcgtgtccgacccgccgtagacgacgtcggttcttttgtactttcgngtcgtctagtattaagtagtggtagggtcagtggtggtcgtaccggttagtacgggtattcgttttagagtttacgggttcgggaacctaaggccgtaacgggtaacgg

SEQ ID NO: 95324 - DNA, 588 bp, Homo sapiens
  misc_feature: GYAE6OF01BCMSU.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggactccggcacggccccccggggaagggctgggattgggatttgggccaggtatcgtagttactacgtgggaccctaccttcttcaaggtcgtcgctcaagacgtcgacgtcaccatcgaccgcggaccacgtaccgaacgggtaccacgtttcctcccgtagaacgtctacgaccctcgtcgtcgacccgccgcacgccgacggtctttgtatttctgtcgctagacttatagtgtgggtgtacgtggtggtcgtccctaacgttacgggtagttcgttttagagtttacggtttacggggaccaagggtcctaagggtaacgg

SEQ ID NO: 95325 - DNA, 682 bp, Homo sapiens
  misc_feature: GYAE6OF01AK74Y.51.36.D03.1.454.CMB.1.raw
  modified_base (224)..(224): a, c, t, g, unknown or other
  misc_feature (224)..(224): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctctggtggcggctcccagatgggtcctgtcccagttgcacctgcaggagtcgggcccaggacttgtgaagccttcggagacactgtccctcacctgctctgtctcngggcgctccatcagtagtagatattactacgtgggctggactccggcgacggcccccggggaaggggctgggacgtttggagttggcgtaggtatcgtagtttactactacgggtacctacctttcttacgaacgtccgtcgactacgaagacgtcgactcgacagtcgaccgcggacacgtaccgaacggacctacgttccctaccgtagaacgtctacgacctcgtcgccgacccgtccgacgacgaccgtacggttctttacgttactttcggtacgttacgtacttaaggtaatttaacgttaagtagggttacgggtacgtacggttacggtttcgggtaccggtacccgttaacggttaacgggttggtttaccgtttttaacggtaacggttttacgggtttacgggggaacccgttaaaccgggggtccggttaaccgggtaaacccggg

SEQ ID NO: 95326 - DNA, 754 bp, Homo sapiens
  misc_feature: GYAE6OF01C6EDG.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttccttcctcctcctggtggcggctcccagatgggtcctgtcccagttgcacctgcagggagtccgggcccaggacttggtgaacgtcccttcggagacacctcgtcccctcaccgtgccttcttcgtctcgtcggccggctccatcgagtagtagtattattacgtacggtggggctcggacgtccggaccgacccgggacccccgggggaaggggtccgttagggtagtttagggtagtttcgggaccgtaaggttaactacgttaaggtttaacgtaccggttacgggtaacccctacccgttttcgtacgtaacggtccgttcgtacgtacgaaagtacggtacgtacgtaccaccagtccggaccggaccggaccgaccgtaccgaacggtacctaccgttccctaccgtaggaacgtccgtacgtacccgtcgtcggtaccgacccgacccgaccgtacgacccggtcggtttacgttttacgttactttcgtagtacgtacttaagtaagttacgttaacggtggtacggtacgtacgtgggttcgtaccgtacccgttaggtacgggttacgtttcgttttagtaacggtttacgggtttaccggggaccgttaacgggccgtaaacggttacccggg

SEQ ID NO: 95327 - DNA, 702 bp, Homo sapiens
  misc_feature: GYAE6OF01E1RV1.51.36.D03.1.454.CMB.1.raw
  modified_base (500)..(500): a, c, t, g, unknown or other
  misc_feature (500)..(500): n is a, c, g, or t
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtccgggcccagggtacttgtgaagccttcggagacactcgtccctcacctgctctgtctcgtgggccgctccatcagtagtagtatattactacgtggggctggacgtccggcgaccgggaccccccggggaaggggcgtaggtacgttggagtttcgggactaaggttactacgtaacggttacttaaccgtacgggtaaccccttacctttacgttaccgtaacggttccggtaccgtcctaagaaacggtacggtcgtaacgtaccaaccgtagttacggacccggacggaaccgaccggtacgaaaccgggtaccctacggtttccnccgtagaacgtctacgtacctcgtacgcgacccgcgacgacgtaccgtacgttgtttacgttatttccgtgtacacgttagtattaacgttagtgggtacggtgtaaggtcggttacggtacgtacccgttaagtaccgggttgtttacgtttagtacgtttcgggtttaacgggaccgaacggtacgtaacggggtaaccg

SEQ ID NO: 95328 - DNA, 852 bp, Homo sapiens
  misc_feature: GYAE6OF01BK3MY.51.36.D03.1.454.CMB.1.raw
tcagcgatcgtatacacgaccggtgctcgatttagctgcgtcacgatctctcttggggggctttctgagagtcgtggatctcatgtgcaaagaaaatgaagcacctgtggttcttcctcctctggtggcgctccagatgggtcctgtcccagttgcacctgcagggaggtccgggcccaggtacttgtagaacgtccgttcggagacactcgtccctcacctgctctgtctcgtggccgctccatcagtagtagtattattacgtacgtgggctggacgtccggcgaccgggacccccggggaggggtccgtagggtacgtttggtagttcgggacgtaggttactacgtaagtttacgtacggtaccgggttacccttaccgtttacttaccgtacggttccgtacgtaccttaacggtaaacggtacggtaccggtaacgtacccaaccgtacgtacccggaccgggacccggtaaccctaccgggtaacccgaaccgggtaacccttaaccgggtttcccctacccggtaacggtaacgtcccgttaaccggtacccgtttaccgtaccgggttacccggaacccccggtcccggaaccggtaacgtacccggttaccgggttttaccgtttttacggtttacgtttttccggtacggtttaccggtacgtttaaggttaatttaacggttaacgggttggggttaccgggttaacgtaaccgggttagggttaccgggttaccgtacccggtttaacgggtacgggtttcggtttacgttttacggtaacgttttacggggttaccggggtaacggtaaccgggtaccggtaacggggttaaacccgg

SEQ ID NO: 95329 - DNA, 758 bp, Homo sapiens
  misc_feature: GYAE6OF01A488T.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatcgggtcctgtcccagttgcacctgcaggagtcgggcccaggacttgtgaagccgttcggagaccactcgtccctcacctgtctctgtctcgtgggccgtcctccatctagtagtagtattacttactacgtggggtctaggtacgtccggaccgaccgggaccccccgggggaaggggtccgtagggtacgtttagggtacgtttcgggactaaggttactacgtaaggtttaacgttacggttaccgggtaaccccttaccttttaccgttaccgtaacggttccggttaccgtacgtacgtaaacggtacgtacggtaaccgttaccaaccgtaacgtaccggaacccgggaccggtaaccgtaacccggtacccgaaaccgggtacccgtaccggtttcccgttaccccgtaaggaacggtcctacggtacccttcgttacgaccggacccgtaccgacgtaacgtaccgtacggttactttacgttactttcgtacgtgtacgtagttattaagttaggtgggttcggtagacggtggttcggtacgtccgttaacggtcggtcgtttacgtttagtacgttacggttacgggaccgaggtccgtaacgggtacg

SEQ ID NO: 95330 - DNA, 646 bp, Homo sapiens
  misc_feature: GYAE6OF01E3C2M.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctcatcagtagtagatattactacgtggggctggactccggcgacggccccccggggagggctgggattggagttggcagtatcgtagtttatacgtcgggacctacctttcttcgaacgtcgtcgctacgaagagtcgacgtcaccatcgaccggcggacgaccgtaccgaacggtaccctacgtttccctcccgtagaacgtccgtacgacccttcgtcggtacgacccgcccgacacggaccgtacggttctttcgttacttttcgttggttacgtaccgttaagtaattaacgttaagttgggttagggtacggtacgtagggttcggttaccgtacccgttacggtacgggtgttcgttttaggtacgtttaggtttacggggaccgaacggggtacgtaacggttaaccgg

SEQ ID NO: 95331 - DNA, 696 bp, Homo sapiens
  misc_feature: GYAE6OF01DPQVU.51.36.D03.1.454.CMB.1.raw
  modified_base (556)..(556): a, c, t, g, unknown or other
  misc_feature (556)..(556): n is a, c, g, or t
tcagcgatcgtatacacgaccggtgctcgatttagctgcgtcacgatctctcttgggggctttctgagagtcgtggatctcatgtgcaagaaaatgaagcacctgtgttcttcctctctggtggcgctcccagatgggtcctgtcccagttgcacctgcgaggagtccgggcccaggtacttgtagaacgtccgttcggagaccactcgtccctcacctgctctgtctcgtggccgctcatcgtagtagtagtatattacgtacggtgggtctggactccgggacgacccgggaccccccggggaaggggtccgtgggtacggttggtagttcggactagttatacgttaagttacgtacgttcggaacccttaccgttcttacgtaacgtccggtacgcgtacgaagtacgtacgtacgtaccaccgtagtccgaaccggaccggaacctaacccgtaccgaaacggtacccttacgtttccgtaccccgtaaggaaccgtcgttaacgtacccttcgtacgtaccggacccgtccgacgaacgacgttacggtnttttacgtactttcgtagtcgtaacgttagtacgttaattaggtgttaggggactacggtacggttcggtacgtaccgttagtacggtagtttcgtttagtagttacggttgggaaccgtacggtaccgtacggtaaccg

SEQ ID NO: 95332 - DNA, 664 bp, Homo sapiens
  misc_feature: GYAE6OF01EWU8R.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggtacttgtgaagccgttcggagacactcgtccctcacctgctctgtctcgtggcgctcatcagtagtagatattactacgtggggctggacgtccggacgaccggaccccccggggaaggggcgtgggtagttcgggtagttgggctagttacgtacgtagttactacgtacgggtacctacttcttacgtaacgtccgtcgtctacgaagtacgtacgtacgtccaaccgtagtacggacccggcggaaccgaccggtaccgaacgggtaccctaacggtttccctacccgtagtaaccgtcgtacgtacccttcgtacgtaccgtaccccggccgacgtacgaccgtcggttacctttgttactttcgtagtcgtactagtattagtagtcggtagtagtacgtaggttcgcgtaccgttacgtacggtacgttcgtttagagtttacgggttacgggaaccgaaggtacgtaacggtaaccgg

SEQ ID NO: 95333 - DNA, 636 bp, Homo sapiens
  misc_feature: GYAE6OF01BJE73.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactcgtccctcacctgctctgtctctggcgctccatcagtagtagatattactacgtggggctggatccgggcacggcccccggggaaggggctggacttggattggctagtatcgagtttaatacgtagggaccctactttccttactaagtccgtacgtctacgaaaggtacggtcgaggtccaccgagtcgaacccggcggaacacgtaccgaaaggaccctagttccacccgtagaacgtctacgacctacgtgtaccgacccgccgacgacgacctacggtactttgtactttcgtgttgtacctaagtaacttagtaacgttggtagggttacgaacgtggttacgggtcgtaccgtacgtacgggtacgttaccgttttagacgtttaaggtttcgggggacctaaggggccgtaaacggttaaccggg

SEQ ID NO: 95334 - DNA, 780 bp, Homo sapiens
  misc_feature: GYAE6OF01ANV9P.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgccacctgcgaggagtccgggcccaggacttggtgaacgtccttcggagacacgtcgtccctcacctgccttcgtgtctcgtggccgtcctcagtcgagtagtagtattacttacgtacgtgggctggacgtccggcgaccggaccccgggagggtcgtaggtagttaggtagttcggacgtagtactacgtagttactacggtacggtacctacgtttctacgtacgtccgtacgtcgtacgtaaggtcgttacgacgtaccaccgtagtacgaccggtcgtaaccgtaccggtaccgaacggtacccttacgttacccgtccgtaagtaaccgtccgttaccgtacccgttcgtacggtacccgtacccgtaccgacgtaaccggtaaccggtccgtttaccgtttcgtttaacgtttccgtacggttacgtaccgttaagtaccgttttaaggtacggttcgggtaacgggttacgtacggttagggttaccggttacccgtaacccgtttagggttaacggttcgtttttaccgggttttaaaggttaacggttttaccgggggtttaacccgggtaaccggtaaacccgggttacccggtaaacgggttaacccccggg

SEQ ID NO: 95335 - DNA, 832 bp, Homo sapiens
  misc_feature: GYAE6OF01DCCY0.51.36.D03.1.454.CMB.1.raw
tcagcgatcgtatacacgaccggtgctcgatttagctgcgtcacgatctctcttgggggctttctgagagtcgtggatctcatgtgacaaagaaaaatgaagcacctgtggtttccttcctcctcctggtggcggctcccagatgggtcctgtcccagttgcacctgcaggagtcgggcccaggacttgtgaagccttcggagacactgtccctcacctgctctgtcctcgtggccgtctaccatcgagttagagtaattacttaaccttacgtggggtcctgggtacgtcccggccgaccgggacccccccgggggaaaggggtccgttagggtagtttacgggtaagttcggggtacgtagtaagttccttaaggtttaacgttaacggttacggggtacccctaacccgttttacgtttaccgtaaacggttccggttacgaccgttacgtaaaacggtacggttaccggtaaggtaccctaacctaacgttaccgggacccggaccggggtaaccacccggtaacccgaacgggtacccgtaacgtttccccttacccgttaacggaacgttacccgttaccggtaacccttcgtcggttacgacccggtacccgacgtaacgaccgttaccggttcgttttacgttaacgttttcgttacgttcggtaaccgttaagtaacgttaagttaacttggggttacgggtacgtaacggtacggttcgggtccggtaaccgttaccggtaacggttacggtttacgttttaggttacgtttacgggtttacgggtaacccggtaacggtcgtaaaccggttaaacccgggg

SEQ ID NO: 95336 - DNA, 632 bp, Homo sapiens
  misc_feature: GYAE6OF01CA4DF.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggacgtcgggcccaggacttgtgaagccttcggagacactcgtccctcacctgctctgtctcgtggcgctcatcgagtagtagattattactacgtgggctggacgtccggcaccggcccccggggaagggtctagggtagttggtagttcggactagttactcgtaagttatacgtcgggacctaccttacttactaagtccgtcgtctacgaagtacgtacgacgtaccactacgtcggacccgaccggacaccggtacaacggtacctacgttcccgtaccgtagaacgccttacgaccttcgtacggcgtacccgccgacacgaccgtcgtacttttgtactttcgtagttactacttagtaacgttattaaggtggttaggtcgaacgtggtcggtacgccgttagtacggttgttacgtttagacgtttgggttaccggactaacggccgtaaggtaaccgg

SEQ ID NO: 95337 - DNA, 702 bp, Homo sapiens
  misc_feature: GYAE6OF01DEBSU.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttggagacactcgtccctcacctgctctgtctcgtggcgctccatcagtagtagattattactagtgggactggactccggcgaccggacccccgggagggtctaggtacgtaggtagttggactagtatacgtagttacgtacgtacggtacctacgttctacgacgtcgtacgtactacgaaggtacgtcgtacgtccaccagtcgaccggacggaccgtaccgtaccgaacggtacctacgttcctacccgtagaacgtctacgaccttcgtcggaccgacccgtcgaccgaacggtaccgtacggttcttttacgttacgttttccagggttacgtaaccgttaagttaacgttaacgttaaggtttggggtacgggtacgtaacggttcgggttgggttacccgtacccgtttaaacgggtaacggttggtttacccgttttaaggtaacgttttacggggttccggggaaacccgtaaacgggtcccggtaagggttaaacccgg

SEQ ID NO: 95338 - DNA, 878 bp, Homo sapiens
  misc_feature: GYAE6OF01A91YR.51.36.D03.1.454.CMB.1.raw
tcagcgatcgtatacacgaccggtgctcgatttagctgcgtcacgatctctcttgggggctttctgagagtcgtggatctcatgtgacaagaaaatgaagcacctgtggttcttcctcctcctggtggcggctcccagatgggtcctgtcccagttgcacctgcaggagtcgggcccaggacttgtgaagccgttcggacgacactcgtccctcacctgctctgtctcgtggcgcctccatcagtagtagattaattactacgtgggcgtggacgtccggcgaccggcccccggggaagggtcgtaggtagttggtagttgggacctaggttactacgtaagtttacgtaccgttacgggtaacccctaccgtttacgttacgtaacggttccgtacggtaccgtaaccgtaaaggtacggttacggtacgtacccgaaacccgtaacggttaccggaaccccgggtaccggtaaacccgtaaccccggttaaccccggaaaccgggtaaccccgttaacgggttttacccccttaccccggttaacggtaaaccgggttcccgttaaccggttaacccgtttcccggttaccgggttacccgggaacccccgggtacccggaaccgtaaaccgggtaacccggttaccgggtttcgtttttacggttacgttttaccggttacggttacggtttaccgttaaaggtttaactttaaaccgtttaagggtttacggggttccggtaacggtaaccggttaacggggttcgggtaccggtacccgtttaaacgggtaacgggtttcggttttaccgttttaaggtacgttttacgggttacggggaacccggtaacggacccggttaacgggtaaccgg

SEQ ID NO: 95339 - DNA, 751 bp, Homo sapiens
  misc_feature: GYAE6OF01A9O55.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgttggttcttcctcctcctggtggcggctcccagatgggtcctgtcccagttcgcacctgcaggagtccgggccaggtacttgtgaagtccttcggagacactcgtccctcacctgtcctctcgtctcgtggccgtctcatcgagtagtagtattacttacgtacgtgggactggactccggcgaccggaccccggggagggtcgtggtacgttggagttggactagttactcgtaagttacgtaccggtcgggtaacccttacctttcgttacgtaacgtccggtcctacgttacgaacggtcgtacgtacgtaccacgtacgtaccgacccggacggaccgaccggtaaccgaacggtacccttacgttcccgtaccgtaggaaccgtcgtaccgtaccttcggtacgtacccggaccgtccgaaccgtacgtaccgttaccggtttctttacggtttatttcgtaggttaccgtagttaacgttaattaacggttaaggttgggttacggggtagtaaccgggtttcggtagggtttacccgtacggtttaaccgggaccggtttaggtttcgttttaacggttaaggtttaccgggtttaccgggaacggtaacgggtacccgttaaaggggttaaccccgg

SEQ ID NO: 95340 - DNA, 733 bp, Homo sapiens
  misc_feature: GYAE6OF01CH7AC.51.36.D03.1.454.CMB.1.raw
tcagcgatcgtatacacgaccggtgctcgatttagctgcgtcacgatctctcgttgggggctttctgagagtcgtggatctcatgtgacaaagaaaatgaagcacctgtgttcttcctcctcgtggtggcgctcccagagtggtcctcgtccctagttcgcaccgtgcgagggacggtccgggacccaggtacttgtagaacgtccgttacggaagacctactcgtccctcaccgtgtcttcgtgtcgtcgtcggccgtctccgatacgagtagtagtattaattacgtacggtgggtacgtcggtacgtccggaccggacccgggaccccggggtaagggtcgtaggtagttacggtagttcggactagtactagtagttacgtacgtacggtaccctactttacgtacgtaacgtcgtacctacgtacgaacggtacgtacggtaactcctaacgacgtaccgaccggacgtaaccgaccgtaaccgaacgtccttacgtctaccgtagactcgtacgacctgtcgaccgaccgcacgacgtaccgtacgtttatttacgttacttcgtacgtcgtaacgtaagtacttaagtaggttggtaacgtaccgagttcgggtacgtaccggtaacccgtttaagggttacggttcggttttacgtttaacggacggttttaaccggggttacggtaaaccccgtagggtaaacccgttaaccgggtaaacccgg

SEQ ID NO: 95341 - DNA, 544 bp, Homo sapiens
  misc_feature: GYAE6OF01BJZTZ.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcacggccccccgggaagggctggattggattggcagtatcagttatacgtgggacctaccgttcttcaagtcgtcgctcgaagagtcgagtcacatcgaccgcgacacgtcaagccagttcctccgtgaagctcgacctcgtgtcgaccgccgcagaccgacggtctttagtactttctgtcgtctagtatataagtggtaggtgagtggtggtcgccttacgtacggtgttcgtttgagttagtttcggggacctaagggcgtacggtaacgg

SEQ ID NO: 95342 - DNA, 616 bp, Homo sapiens
  misc_feature: GYAE6OF01AM25T.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtgcggctcccagatgggtcctgtcccagttgcacctgcaggagtcgggcccaggacttgtgaagccttcggagacactcgtccctcacctgctctgtctcgtggcgctccatcgagtagtagattattactacgtgggctggacgtccggcgaccggccccccggggaagggctggagttggagttcggctagtatacgtagttatacgtcgggacctaccgttcttacaacgttcgtcgtactacgaagtcggtacgacgtccacgatacgaccggtcggacgaccgtaccgaacggtacctacgttcctaccgtagacgtctacgtacctcgtgacgacccgacgtcacgaccgtacgttcttacgttactttcgtagtcgtacgttagtattatagtggtaggtcgtacgtaggtcggtcgtaccgttaaggtcggtcgtttactttaggagtttacggttacggacgtaacggtcgtaaggtaaccgg

SEQ ID NO: 95343 - DNA, 729 bp, Homo sapiens
  misc_feature: GYAE6OF01EORI8.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttggagacactgtcccctcacctgctctgtctcgtgcgctcatcagtagagtatattacgtacgtgggctggtacgtccggcaccggcccccgggaagggcgtagggtacttggtagttggccgtaagttactacgtagttactacgtacgggacctacctttcgttacgtaacggtcgtaccgtactacgtaagtcgtacgtacgtccaaccgtacgtacgaccggtaaccggtaacgtaccgaacgtacgtaccgttacgtacccgtagtaacgacgtacgtcgtaccgttcgtacgacccgtccgacgaacgtaccgacggtttctttacgttacgtttcgttcgtagttaccgtagttaagttaacttaacgttagggtacggtacgggacgttaacggttcgggtaccggttacccggttaacgtttaacccggggtagtttacggttttaacgtttaagggttaccgggtttttaaccggggacgggtaaacccggttacggtaaacccggttacgggttaaaacccccggg

SEQ ID NO: 95344 - DNA, 592 bp, Homo sapiens
  misc_feature: GYAE6OF01E3GDQ.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggactccggcgacggaccccccggggaaggggcctggattggattggcagtatcagttatacgtcggacctaccttctacagtcgtcgctcaagagtcgagtcaccagtcgaccgcggacaccgtaccgaacgacctacgttcctccctagaacgtcctacgtacctcgtcgtacggacccgccgcacgaccgacgttctttagttactttcgtagtcgtctaagtattacttaagtggtgggtgacgtaggtggtcgtacccttaggtacggtcgttacgtttagacgttacggtttacggggaccgtaaggtaccgtaacggtaacgg

SEQ ID NO: 95345 - DNA, 603 bp, Homo sapiens
  misc_feature: GYAE6OF01C37P7.51.36.D03.1.454.CMB.1.raw
  modified_base (138)..(138): a, c, t, g, unknown or other
  misc_feature (138)..(138): n is a, c, g, or t
  modified_base (226)..(226): a, c, t, g, unknown or other
  misc_feature (226)..(226): n is a, c, g, or t
  modified_base (534)..(534): a, c, t, g, unknown or other
  misc_feature (534)..(534): n is a, c, g, or t
tcagcgatcgtatacacgaccggtgctcgatttagctgcgtcacgatctctcttgggggctttctgagagtcgtggatctcatgtgcaaagaaaatgaagcacctgtggttcttcctcctcctggtggcgctcccagntgggtcctgtcccagttgcacctgcaggtagtccgggcccaggacttgtagaagtcccttcggaagaccactcgtccctcacctgctntgtctcgtggcgctccatcagttagagatattactagtgggctggactccggcgaccggcccccggggaagggccgtgggtagtggtagttcggctaagtatactaagttatacgttcgggacccttaccttcttacgaacgttccgtacgtctacgtaaagagtcgtagtccaacacgtacgaccggaccgacgtacgtaccgaacgacctagttcctcccgtagaacgtcgtacgacctcgtgtccgacccgtcgacgtagaccgtcgttcttgttacttcgtgtcatagtatagtagtgtggtanagtgtgtacgtcctaagtacggtgttcgtttagacgttaggttcgggaacctaggtcccgaagtaccgg

SEQ ID NO: 95346 - DNA, 882 bp, Homo sapiens
  misc_feature: GYAE6OF01CYY23.51.36.D03.1.454.CMB.1.raw
  modified_base (137)..(137): a, c, t, g, unknown or other
  misc_feature (137)..(137): n is a, c, g, or t
tcagcgatcgtatacacgaccggtgctcgatttagctgcgtcacgatctctcttgggggctttctgagagtcgtggatctcatgtgacaaagaaaatgaagcacctgtggttcttcctcctctggtggcgctccagntgggtcctgtcccagttgcctaccgtgcgaggacgtccgggacccaggtacttgtaggaacgtccgttcggacgaccacgtccgtccctcacctgtcctcgtcgtctcgtcggccgtcctccatcgaagtagtaagtattacttaccgtaggtcggggtcgtacggtaccgtcccggaccggacccccgggacccccgggggtaaggggtccgttaggggttaacggtttacgggttacggtttacgggacgttaacggttaaccgttaccggttaaggtttaaccggttaccggttaacccgggtaaccccttaaccccgttttacgttaaacccggttacggttacccggttacgtaaccgttaacggtaaacggttaccggtaccgtaaaccgttacccaaaccggtaacgttacccgggaacccgggtaaccggtaaaccgtaacccgtaacccggaaccggttacccgttaaccgtttccccgtacgtaacggtaaccggttccttacccggtaaccgttcgttacccggtacccgggtaccccgacccggtaacgtacccggtaccgtttaccgggtttccttttaagtttcgtttaccgtggttaccgtagttaagtacttaagtttacggtggtacgggtacttacggaggtccggtacgttacctagggtaccggtttgtttacggtttaggtacgtttacgggtacggaaacgtaacggtacggtaacggtaccg

SEQ ID NO: 95347 - DNA, 759 bp, Homo sapiens
  misc_feature: GYAE6OF01EZPOR.51.36.D03.1.454.CMB.1.raw
  modified_base (263)..(263): a, c, t, g, unknown or other
  misc_feature (263)..(263): n is a, c, g, or t
  modified_base (354)..(354): a, c, t, g, unknown or other
  misc_feature (354)..(354): n is a, c, g, or t
  modified_base (596)..(596): a, c, t, g, unknown or other
  misc_feature (596)..(596): n is a, c, g, or t
  modified_base (687)..(687): a, c, t, g, unknown or other
  misc_feature (687)..(687): n is a, c, g, or t
tcagcgatcgtatacacgaccggtgctcgatttagctgcgtcacgatctctcttgggggctttctgagagtcgtggatctcatgtgcaagaaatgaagcactgtgttcttcctcctctggtgcgctccagatcggtcctgtcccagttgccacctagcaggagtccgggcccaggtacctttgtagaacgtccctttacgggacaccgacttcggtccctctacctgccttcgtcgtccttcgtcgggccgtaccttccgagntacgtagtacgtagtacgttacttacgtacggtcggtcgtacggtaccggtaccggtacccggaccccggggtaccccggggttaaccacngggggtaaccgtttacgtttttttccttacgggttaaccggttaacgggttaaccggtaaccggttaacggttaacgttaaccgttacggccttaacccgttaccggttaccgtaaccgttaccgttaccgtaaccgtaccgtaacgtacgtacgtacgtacgtacgtacgtacgtaccgaccgtacgtaccgtaccgaacgtaccgtaccgtaccgtaccgtacgtacgtacctcgtacgnccttccgtaccgtcgtaccgtccggaccgaccggaccgtaccggtacgtttaccgttacgtttcgttacgttacgtacgtagtacgtacgntacgttaggttaggtcggtacggtacggttacggtacgtacggtacggttaccggttacgttacggtttcgg

SEQ ID NO: 95348 - DNA, 615 bp, Homo sapiens
  misc_feature: GYAE6OF01A4GWI.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactcgtccctcacctgctctgtctcgtggcggctccatcagtagtagattattactacgtgggctggactccggcacggccccccggggaagggctggagttggagttggcagtatacgtagttatacgtcggacctacttcttacgaagtcgtcgctacgagagtcgagtcacagtcgaccgcggacaccgtaccgaacggacctacgttccctaccgtagaacgtccgtacgtaccgtcgtcggtacgacccggtccgaccgacggaccgtaccggttcttttcgtttacgttttcgtgtcgtacgttagtattaagttaagtggttgggtagtacgtaggtcggtcgtaccgttagtaccggtgttcgtttagtagtttacgggttcgggaccgtaacggcgtacggtaacg

SEQ ID NO: 95349 - DNA, 781 bp, Homo sapiens
  misc_feature: GYAE6OF01AT14K.51.36.D03.1.454.CMB.1.raw
  modified_base (611)..(611): a, c, t, g, unknown or other
  misc_feature (611)..(611): n is a, c, g, or t
tcagcgatcgtatacacgaccggtgctcgatttagctgcgtcacgatctctcgttggggctttctgagagtcgtggatctcatgtgacaaagaaaatgaagcacctgtcggttccttcctcctccgtggtggcgctcccgagagtgggtcctgtcccagttgccaccgtgcgagggtaggtccgggccctaaggtacgtttggtacggaacgtcccgtttacggaacgtaacctaccgttcgtcccccctcctacctcggtccttcgttcgtccgtcgtcgggccgtcctcctatacgtagtagtagtattacgttaccgtacggtcgggtcgtacggtacgtcccggaccgaccccgggaccccccggggtaagggccgttaggggtacgttacggtaggttcggacgtagttactacgtacgttaccgtacggtacggtaccccttaccgttacgttaccgtaacggtccgttcgaccgtacgtaagtacgtacgtacgtctaccgtagtccgggaccgccggaacgtaccgacgtacgtacctcgttcctaccgtagaacgtcgtccgtacctcgtcgtaccgccgtccgacgtaccgacgtcgtttnttacgttacttcgtacgtgtacgtagttactaggttacgtggtcgtacgttaaggtcggttacgtacccgtaccggttaccgggttacggtcgttttaacgggtttacgttaacggtttaccggggtttaccggaaaccgtaaccgggttaccggtaaccgggttaaccg

SEQ ID NO: 95350 - DNA, 705 bp, Homo sapiens
  misc_feature: GYAE6OF01BQPHL.51.36.D03.1.454.CMB.1.raw
tcagcgatcgtatacacgaccggtgctcgatttagctgcgtcacgatctctcttgggggctttctgagagtcgtggatctcatgtgacaagaaaatgaagcacctgtggttcttcctcctctggtggcggctccagatgggtcctgtcccagttgcacctgcaggagtccgggcccaggtacttggtgaacgtccttcggagacactgtccctcacctgctctgtcctcgtcggcgtctccatcaggttagagtattattacgtcggtgggtctggactccggccgaccgggccccgggaagggctggtagttggtagttggactaagttcgtacgtagttacgtacgtacggaccttaccttcgttacgacgttccgtacgctaacgaaggtacgtacgtacgttacaccgtacgtaccggtaccggaccgtaacgtacccggtaaccgtaaccgggtaccttaccgtttacccgtaccgtacggaacgtcccgtacgtacccgttgtccgggtaccgaacccgcgaccaacggtacctacggttctttttacgtacgtttcgtacgtcgtaacgtagtaatttacggtaagttcgggtggtacgaacggttcggtcggttaccgtaccggtaagttacggttgtttcgttttaaggaggtttcgggttaccgggaacctaacggggtaccgtgggtaacccgg

SEQ ID NO: 95351 - DNA, 671 bp, Homo sapiens
  misc_feature: GYAE6OF01CCUI8.51.36.D03.1.454.CMB.1.raw
  modified_base (144)..(144): a, c, t, g, unknown or other
  misc_feature (144)..(144): n is a, c, g, or t
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
tcagcgatcgtatacacgaccggtgctcgatttagctgcgtcacgatctctcgttgggggctttctgagagtcgtggatctcatgtgacaaagaaaatgaagcaccgttgtggtttccttcctcctcctggtggcgctcccagngtcggtcctgtcccagttcgacctcctgcgaggacggtccgggcccaggtactttgagacgtccttcggaanctacgtcgtccctacacgtcgcttctgtctcgnggacgctcatagagttagatattactagtacgtgggctggacgccggacgacccggaccccggggtaaggcgtaggtacggttaggtaggttggacgtagttaccgtagtagttacgacgtacggaaccctttacgtcgttacgaacggtcgtacgtactacgaagtacgtacgtacgactaccagtccgacgccgaactacgacgaacggtactacgttacctccgaaggactcgtacgtaccgtgacggtaccgacccgacgacgacgtacgtacgtttctttaggttcttccgtaggtacctaggtaattaacgtaagttaacggttggtaacggtcgaagttcgaacggtcgtaccgttaggacgttagtttcgtttaacgtagttacgggttacggaagagtaccgtaaggtaccgg

SEQ ID NO: 95352 - DNA, 669 bp, Homo sapiens
  misc_feature: GYAE6OF01B1BCL.51.36.D03.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcgganacactgtccctnacctgctctgtcctcgtggccgctccatcagtagtagatattactacgtggggctggactccggctacggcccccgggaagggtctaggacttggtattggctacgtattctagttactacgtcggaccctaccttcttacgtaagtcgtcgctaccgaaggacgtcgacgtcaaccgtatacggaccgcggactaccgtaccgaacggacctaacgttcccgtaccctaggaacgtctacgtacccttcgtaggtccgaacccggtccgacgacggtacccgcggtttccgttttacgttaacttttcggtacgtcggttactaaggtaactttaagttaacggttggttacgggtgaacggtagggttccggtacgtaccgttaacggtacgggtacgtttcctttaggtaattacgggtttacggggaacctaagggtccggtaacgtaacccggg

SEQ ID NO: 95353 - DNA, 754 bp, Homo sapiens
  misc_feature: GYAE6OF01BX6MY.51.36.D03.1.454.CMB.1.raw
  modified_base (149)..(149): a, c, t, g, unknown or other
  misc_feature (149)..(149): n is a, c, g, or t
tcagcgatcgtatacacgaccggtgctcgatttagctgcgtcacgatctctcgttgggggctttctgagagtcgtggatctcatgtgacaaagaaaatgaagctaccgtgttgttccttcctccttccgtggtgggccggctcccaggngttcggtcctgtcccgagttcgccacgtgcgaggacggtccgggccaggtacttgtagaacgtccgttacgggacaccactccgtccctcacctgcctgtcgtctacgtcggccgctccatacgtaagttagtaatattacttacgtacggtggtactggaccgtccggacgaccccgggtaccccggggaggtcgtaggtagttaggtacgttacggacttaacggttattacgtaaggttaacgtacggtaccggtaccttactttcgtaacgtaacgtccgtacgtacgtaacgtaacggtcgtacgacgtaccaacgtacggtaccggaccgaaccggaacgtaccgtaacgaacccgtacgttccgttacccgtacgttacggaaactccgtaaccgtacctcggtacgtaccgacccgcacgtaacggaccgtttagttctttaaacgttgttacctagtaccgtaatacgtaattaacgtggtagggtacggtataacggtggtttacggaacccttcgttaaccgggtggttacttacggtttaaagtacggtttacggggaacccggttaaagacgttaaccggtacggtaaaccg

SEQ ID NO: 95354 - DNA, 796 bp, Homo sapiens
  misc_feature: GYAE6OF01B31TC.51.36.D03.1.454.CMB.1.raw
  modified_base (208)..(208): a, c, t, g, unknown or other
  misc_feature (208)..(208): n is a, c, g, or t
tcagcgatcgtatacacgaccggtgctcgatttagctgcgtcacgatctctcttgggggctttctgagagtcgtggatctcatgtgacaaagaaaatgaagcacctgtggttcttcctcctcgtggtggcggctcccagatcgggtcctgtcccagttgcacctgcgaggagtccgggccaggacttggtagaacgtccgttcggganaccgacttcgtccctcacctgcttcgtgtctcgtggccgtctcagtcgagtagtagattattacgtacgtgggctggactccgggccaccgggacccccggggaagggtccgtaggtacggttcggtagttcggacgtaagtacgttacgtaacgttacgtacggtacgggtacccttaccgtttacgtactaaggttcctacggtacctacgaaacgtacgtcggtacgttaccaaccgtagtaccggacggaccggactaaccggtaccgaaacggtaccctacgtttaccgtaccgttacggaacgtcccgttacgacccggtttcgtaccggtacggaccccgccgtaacggaaccgtaaccggtccggtttacgttttacgtttaaccgtttcgttcggttaaccttaaccggttaagtaaacgttaagtttaaacggttcgggttacgggtaacgttaaccggtcgggtttaccggtaccggttaaccgttaacggtaaccgggttcgttttaacgtttcgggtaacgttttacgggtaccgggaaaccggttacgggaccggttaaaccggttaacccggg

SEQ ID NO: 95355 - DNA, 741 bp, Homo sapiens
  misc_feature: GYAE6OF01AFVYZ.51.36.D03.1.454.CMB.1.raw
tcagcgatcgtatacacgaccggtgctcgatttagctgcgtcacgatctctcgttgggggctttctgagagtcgtggatctcatgtgacaagaaaatgaagcacctgtggttcttcctcctctggtggcggctccagatcgggtcctgtcccagttcgcacctgcgaggacgtccgggcccagggtacttggtagaacgtcccgttcggagacacttcgtccctcgacctgccttctgtctcgtcggcgctccgatcgagtagtagtattacttacgtacggtggggctggacgtccggacgacccgggacccccggggtaagggtccgtagggtagttggtagttcggactagtacttacgtagttacgtacgtacgggtaccttaccttcgttacgtacgttcgtccgtactaacgaaggtcgtacgtacgtcctacagtccgaccggacggaccgtaccgtaccgacggtaccctcgttacctcccgtagaccgtcgtacgttacctcgtagcccgacccgccgacgacgtacccgttcggtttcttttagttacgtttcgtacgttacgtacgttaagtaacgtttagttaaggttcgggttcggtaacggtacgttcgggttacggtacccgttaaccggtttaaccggtacgggtttctttacggttttaacggttacggttttaaccggggttaccgggtaacgaaacgggttccgtaaacggggttacccggg

SEQ ID NO: 95356 - DNA, 673 bp, Homo sapiens
  misc_feature: GYAE6OF01D8REG.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtccgggcccaagggtacttgtgaagtcccgttacggagaccactcgtcccctcacctgcttctgtctcgtggccgctccatcagtagagattattactacgtgggctggactccggcgaccggaccccccgggaaggggtccgtaggtagtttggtagttggctaagttatactaggtttactacgtacgggtacctaacctttcttacgtaacgtcgtcgctacgaagtcgtacgtacgtaccaccacgtacggacccggacggaacctaccggtaaccgaacggtaacctacgtttaccctacccgtagaaacgtctacgacctcgtcggtaccgacccgtccgacgacgtaccgtacggttctttagttactttccgtgttcgtaccgtaagtacttaagtaagttcgggttaggtcgtaacgtggtacggtcgtacctaggttaacggtcgtttagtttacgtagttacggttacgggactaacgggctaacgggtaacg

SEQ ID NO: 95357 - DNA, 648 bp, Homo sapiens
  misc_feature: GYAE6OF01E3Z33.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtgggctggactccggcgacggcccccccggggaaggggcctgggagttggtattggcagtatctagttaactacgtcgggacctaccttctcaacgtcgtcgctacgaagacgtacgacgtcacatcgaccgcggacgacgtaccgaacggtaccgtacgttccgtcccgtagaacgtcctacgtaccctcgttcggtacgacccggacccgacaacggacccgtacggttcgttttgttaacttttccgtgtacgtacgttaagtaacttaagttaacgtgggttacgggtgtacgtaggtacggttccgtccgttaacgtacgggtagtttcgttttaggtacgtttacgggttacggggaaccgaacgggtaccgtaacgggtaaaccgg

SEQ ID NO: 95358 - DNA, 784 bp, Homo sapiens
  misc_feature: GYAE6OF01C1ENJ.51.36.D03.1.454.CMB.1.raw
tcagcgatcgtatacacgaccggtgctcgatttagctgcgtcacgatctctcttggggctttctgagagtcgtggatctcatgtgcaagaaaatgaagcacctgttggttcttcctcctcctggtggccggctcccagatcgggtcctgtccctagttcgcacctgcgaggagtccgggcccaggtacttgtgaacgtccgttacggagactacgtcgtccctcaccgtgtccttcgtgtccgtcgtggaccgctccatcgagtagtagtattacttacgtacggtgggtctggacgtaccggccgaccggacccccggggaagggtcgtaggtacgttaggatttcggacgtagtactacgttagttactacggtacggtacccttacttacgttacgtaacggttccgtacgtacgttaacgaacgtacgtacggtaacgtccgaacgtacgttacgacccggaacggaccgtaaccgtaaccgaaacggtaccctacggtttacccgtccgttaacggaacgtacccgtaccgtaccgttaccggttacggaccccggtaccggacccggaccgacggtaacccgttaaccggtttcgttttacgttacgttttaacggttccgtacgttacgttaaacgttaacgttaagttacgggttacggttggggtaaccgtacggttaacgggttggttaacccgtaccgttaacccgggttgttacgtttacgtttaaggttcgtttaaccgggttacgggacgtaacggcgtaaacggtaccg

SEQ ID NO: 95359 - DNA, 601 bp, Homo sapiens
  misc_feature: GYAE6OF01BUY3Q.51.36.D03.1.454.CMB.1.raw
  modified_base (216)..(216): a, c, t, g, unknown or other
  misc_feature (216)..(216): n is a, c, g, or t
tcagcgatcgtatacacgaccggtgctcgatttagctgcgtcacgatctctcttgggggctttctgagagtcgtggatctcatgtgcaagaaaatgaagcacctgtcggttcttcctcctcctggtggcggctcccagatgggtcctgtcccagttgccacctgcaggagtcgggcccaggacttgtagaagtccttcggagacactcgtcccctnacctgctctgtctcgtggccgctccatcagtagtagatattactacgtgggctggacgtccggcgacggcccccgggaagggctgggtattggagttcggctagtatcgtagttatacgtggacctacttcttactacgcgttttcgctacagtagtcgagtcaccagtcggaccggcgacgaccgtaccgaacggacctacgttcctccgtagtaacgcgtacgacccttgtcgtcgacccgccgtcgacgacctcggtcttttgttctttcgtgttcgtacgtagtattaatagttggtggtgtacgtggtcggtcgtccgttaggtacggtcttcgtttagtagtttacggttcgggtaaccgtaggccgtaaggtaccggg

SEQ ID NO: 95360 - DNA, 628 bp, Homo sapiens
  misc_feature: GYAE6OF01EVQ75.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggatccggcacggccccccgggaagggctggattggattggcagtatcgtagttatacgtgggacctacttcttacaagtcgtcgctacgaagagtcgagtccacatcgaccgcggacacgtaccaaggaccagttcctcctagaacgctcgacctcgtggtacgaccgccgcacgacgacggttctttagttactttctggtcgtacgttagtaacgttaattaacggttgggttgggtagtaacgtagggtttgggtacgtacccgtttaacggttaccggggtaagtttccgtttttaaggaacgtttagggttttaccggggggaaccccttaaacgggtccgtaaacgggttaacccgggg

SEQ ID NO: 95361 - DNA, 613 bp, Homo sapiens
  misc_feature: GYAE6OF01DV0G6.51.36.D03.1.454.CMB.1.raw
  modified_base (351)..(351): a, c, t, g, unknown or other
  misc_feature (351)..(351): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtcccctcacctgctctgtctcgtggccggctccatcagtagtagatattactacgtgggctggatccggcacgccccgggaagggctggattggattggcagtatcagttatacgtcggacctaccttctcaagtcgtcgctcaagngtcgagtcacatcgaccgcggacacgtaccaaggacctagttcctaccctagaacgtctagacccttcgtcggtcgacccggccgcgacgaccgacggttctttggttacttttcgtggttcgtacgttagtattaagttaagttcggttggggtacaacgtagggttgggtacgtaccctttaacggtacgggtagttccgtttttaggaacgttttacggtttacgggggacctaaacgggccgtaacgggtaaaccggg

SEQ ID NO: 95362 - DNA, 711 bp, Homo sapiens
  misc_feature: GYAE6OF01BB6CL.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtcgggcccaggacttgtgaagccttcggagacactcgtcccctcacctgctctgtctcgtggccgctccatcagtagtagtattattactacgtgggctggactccggcgaccgggccccccggggaaggggctggtagttggtagttggcgtagtatcgtagttatacgtcgggtacctacctttacgttacgaacgtccgtcgtactacgaacgtacgtacgacgtaccaaccgtacgtacgacccggacggaccgaccggtaccgaaacgggacccgtacggtttaccctacccgtaggtaaacgtccgttacggtacccttcgtacggtaccggacccggcccgaccgaacgtaccgtaccggttcttttaggttacttttccgtgttacgtacgttaagtaactttaagttaagttgggttagggtacgtacgtagggttggttaccggtacccgttaagttaaccgggtacgtttccgttttagtaacgtttacgggtttacgggaaccgtaacgggtaccgtaacggtaaccggg

SEQ ID NO: 95363 - DNA, 900 bp, Homo sapiens
  misc_feature: GYAE6OF01AK7WT.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctcgtggcgctccatcagtagtagatattactacgtggggctggactccggcgtaccgggcccccccggggaaggggcgtcggtagtttcgggtagttagggcctaaggttacgtaccgtaaggtttaacgttacccgttacgggggaaccccttaacccgttttccgtttaccgtaaacggttccggttacccggtaccgttaacgaaacgggttaacggttaccggtaaaccggttacccgtaacccgtaacgttaccgggtaacccccgggaccggggtaaaccccgtaacccgggtaacccggtaaaacggggtacccccgttaaccggtttttaccccgttacccccgtaagggtaaacccggtcccggttaccgtaaccccgtttcccggttacggttacccgggaacccccggtcccgggttacccgaaacggtaaccccggttaccgggtttaccgttttaacggttttaacgttttccgttaggttaccggtaacttaacggtaaactttaagttaacggtttaggggttacgggttacgtaaccggttagggttacgggttaccgttaacccgttacggttaaccgggtacgttttacgtttttacggtagttttaacggggtttccgggggaaccgtaaacgggtcggtaaaccgggttaaccccggg

SEQ ID NO: 95364 - DNA, 665 bp, Homo sapiens
  misc_feature: GYAE6OF01B90BN.51.36.D03.1.454.CMB.1.raw
  modified_base (469)..(469): a, c, t, g, unknown or other
  misc_feature (469)..(469): n is a, c, g, or t
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggaggtccgggcccgaggtacttgtgaacgtccttcggagacacgttcgtcccctacacctgcctctgtctcgtggccggtcctccatcgagtagtagattacttacgtacgtgggcgtggacgtccggcaccggacccccgggggagggcgtagggtagtttagggacgttggacgtagttagtacgtaggtttactacggtacggaccttaccgttctactacggtcgtcgctacgaaggtcgtacgacgtccacgagtaccggacgccgacgtaccggtaccgaacggacctacgttaccnccgtagactcgtcaccgttctacggtaccgaccccgtcgaccgtaacgccgtaacggtttctttacgttctttctacggtgttacacgttaatacgttagttgggtagtgaacgtcggtcggtcgtaccggtttagtacgggtctttaggttacgttagttgggttacgggacgtaaggtcccggaaaggtaccgg

SEQ ID NO: 95365 - DNA, 694 bp, Homo sapiens
  misc_feature: GYAE6OF01AMKSF.51.36.D03.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (540)..(540): a, c, t, g, unknown or other
  misc_feature (540)..(540): n is a, c, g, or t
  modified_base (575)..(575): a, c, t, g, unknown or other
  misc_feature (575)..(575): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggcttgtgaagccttcggganacactgtccctnacctgctctgtctacgtggcgctccatcagtagtagatattactacgtggggctggactccggcacggtcccccggggaaggggcctgggtagtttggattcgggactagtatcgtagtttacgtcgtcgggacctacccgttcttacaacggttcgtacgtccttacgaaagtacggttacgacggttaccaccgtaacgtacgaccccgggacgggaaccctaccggtacccgaaacgggtccctaacgtttcctacccgttacgacggtcctacgtacccttcgtaggttccgaacccgtccgacgaacggtaccgtaaccgggttnttttacggtaactttcggtacgtgtctagacttanaacggttggtagggtacgtactagggttcggtcgtacccgttacggtagggttaccgtttagtttggtaaacgttcgggtttacgggaccctaacggggtccgtaacggttaacccggg

SEQ ID NO: 95366 - DNA, 714 bp, Homo sapiens
  misc_feature: GYAE6OF01A74TL.51.36.D03.1.454.CMB.1.raw
  modified_base (211)..(211): a, c, t, g, unknown or other
  misc_feature (211)..(211): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactcgtccctnacctgctctgtctctggcgctcatcagtagtagtatattacgtacgtggggactggacgtcccggcaaccgggaccccccggggaagggggcctgggtacgtttgggtagtttacgggacctaagtacgtactaaggttaacgtacgtacgggtaacccctactttccgttacgaacgttccgtacgtctacgaaacggtcggtcgacgtaccgaccgtacgtacgacccggtacggtaacccgtaccggtaaccgaaacgggtaccctacggtttcccgacccgtaggaacctaccgtcgtaccctcgtcggtaccggacccgtacgccgtacgaacgtcggttactttagtacgtttcgtgtcgtacttaaggtattactaacgtgggtaggtacggtaactggggtacgtaccggtaaccgtttacggacgggtacgtttacgttttaagtaggttacggtttaccggggaactaacgggtcccgtaaaggtaacccggg

SEQ ID NO: 95367 - DNA, 792 bp, Homo sapiens
  misc_feature: GYAE6OF01CL2VQ.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcgctcccagattcgggtcctgtcccagttgccacctgcaggacgtccgggcccaggtacttgtgaacgtccgttcggagactactcgtccctcacctgcttacgtgtcctcgtcggccgtacctccgtatcgtagttagtaagtattagttacgtacggtcgggtactggacgtccggacgacccgggaccccggggtaggtcgtaggtacggttaggtagttacggacgtagtacgtacgtaggtttactaccggtaccggtacccttaccgtttacgttaccgtaacggttccgtaccgtaccgtaacgaacggtacggttaccggtaacttacccgaaccgtagtacccgggaacccggccggtaacccgtaacccgtaccggtaaaccggtacccgttaccggtttacccctaccggtaacgtaaccggtaccctttaccgggtaaccctttccggtaccggtacccgggaaccccgtcccggtaaccgaaccggtacccggttacgttaccgtttttacggttactttccgtgtacgtacttaagtattacgtaggtttggtaacgggtcgtagtcggttggtacccgttacgttacggttacgttgtttcggtttaagtacggttcggttacgggacgtaacgacgttacggtaaccg

SEQ ID NO: 95368 - DNA, 939 bp, Homo sapiens
  misc_feature: GYAE6OF01DBSPJ.51.36.D03.1.454.CMB.1.raw
tcagcgatcgtatacacgaccggtgctcgatttagctgcgtcacgatctctcgttgggggctttctgagagtcgtggatctcatgtgacaaagaaaatgaagccaccttgttcggtttccttccctcccttccgtgggtcgggccggcctcccgagtacgttcgggtccctcgtcccctagttcgccacctggcgagggacggtccggggccctaggtacttggtacgaacgtccgttcggaacgactaccgttcgtcccctactaccctgtccttcgttcgtccctcggttcggccggtcctaccacgtacgtaaggttaagtaagttaagtttaacgttaaccggttaccgggtggggtccgttacgggtaccgtacccggggacccggaaccccggggaccccccgggggtaaggggtccggttagggtacggtttacgggtacgttcgggaacgtacgggttaattaccggttaaagttttaacggtaccggttacccgggtaacccctttaaccttaccgttaaccgtaacggttccggtacgtaccgtaacggtaaacggttaccggtacgtaaccggtcctaaccgtacggtacccggacccggtaacggtaccgtaaccccggtaacggtaacccggttaccgttaccgtttcccacccggtaacggtaacgtcccgttaccgtacccgttggtaccggacccgtaccggacccgtacgtaaccgtaccggttcgtttacgttttacgttagtttcccgtggttaccgaacgttttaacggatttaaaggtttcggtagggttcgggtaacgtacggttacgggttacggtaccttacccggttaaagtttaccggttacggttttacgtttacggttaacgtttacggggttaacccgggagttaaaccggaccgttacggggtaacccg

SEQ ID NO: 95369 - DNA, 618 bp, Homo sapiens
  misc_feature: GYAE6OF01C0QRU.51.36.D03.1.454.CMB.1.raw
  modified_base (367)..(367): a, c, t, g, unknown or other
  misc_feature (367)..(367): n is a, c, g, or t
  modified_base (451)..(451): a, c, t, g, unknown or other
  misc_feature (451)..(451): n is a, c, g, or t
  modified_base (476)..(476): a, c, t, g, unknown or other
  misc_feature (476)..(476): n is a, c, g, or t
  modified_base (523)..(523): a, c, t, g, unknown or other
  misc_feature (523)..(523): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggtacttgtagaacgccttcggaagacactcgccctcacctgctctgtctctggcgactccatcagtagtagtattacttactacgtgggctggactccggcgaccggacccccgggaagggctggagttaggtagttcggctagtatacgtagttactacgtcggtacctactcttacgacgtcgtcncgtacaagcgtacgactcactatcgacgcgacacgtaccgacgactacgtctcctagacgctacgactcgtcgtacgaccgacncgacgaccgtacggttctttacgtntttccgtgttactacgtaagtattaagttaacggtggtacgggttanaacggtggttacggtccgtaccgttagtaccgggtatttaccggtttaatacggtttacgggttacgggaccgtaaggtacgtaacggtaacggg

SEQ ID NO: 95370 - DNA, 757 bp, Homo sapiens
  misc_feature: GYAE6OF01C6ZG6.51.36.D03.1.454.CMB.1.raw
  modified_base (283)..(283): a, c, t, g, unknown or other
  misc_feature (283)..(283): n is a, c, g, or t
  modified_base (460)..(460): a, c, t, g, unknown or other
  misc_feature (460)..(460): n is a, c, g, or t
  modified_base (534)..(534): a, c, t, g, unknown or other
  misc_feature (534)..(534): n is a, c, g, or t
  modified_base (731)..(731): a, c, t, g, unknown or other
  misc_feature (731)..(731): n is a, c, g, or t
tcagcgatcgtatacacgaccggtgctcgatttagctgcgtcacgatctctcgttggggctttctgagagtcgtggatctcatgtgacaaagaaaatgaagctacctgtggtttccttcctcctcgtggtggccgctcccaggtagtcgggtcctgtccctagttcgccacgtgacgaggacggtccgggacccaggtacttggagacgtccgttcggagacctacgtccgtaccctccgtacctgtcccttcgtccgttctcggtcggaccgccttaaccgngtaccgtaaggttagtaagttacttaacgttacgttacggtcgggtcgtacggaccgtccggggacccgaaccccggggtaccccgggaagggtcgtaggtagtacgtgtcgagtagttagtacgtagttacgtacggtcggaaccttaccgtacgtacgacggtacgtctacgtanaacggtctacgacgacgacaggtcaccggacgacgttacccgacgaacggtacctacgtcgtacctagaacgtntacgtactcgtcggaccaccgtccgtaacgacgtaccgttcgttacgttagtttacttcgtacggttacgtacgtatacgttaagttaaccgggttgttaaccggggttcgtaaacggttacggttccggttacgtaccgttaaggggtaaccgttaggttttcccgtttaaggttaccgggttcggtaaacggggnttaaaccggacggttaccggtaacgg

SEQ ID NO: 95371 - DNA, 818 bp, Homo sapiens
  misc_feature: GYAE6OF01EH5M6.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggtacttgtgaagtccttcggagacactcgtcccctcacctgctctgtctcgtggccgtcctaccatcgagtagtagtattattactacgtgggctggactccggcgaccgggaccccccggggaaggggtcgttacggtagttgggtacgttcgggacctaaggttacgttacgtaagtttaacgtaccgtacggggtaaccccttaacccgtttcttaacgtaacggttccgtaccgtacgtacgtaaacggtacggtaccggtaacggtacccaaccctaacggttaccggaacccgggtaccggtaaacccgtaaacccggttaacccggaaaacggggttacccctaacggttttaccccttacccggttaacggtaaaccgtacccgttaaccggtacccgttcgttaccgggttacccgggaacccccggtacccggaaccgtaacggtaacccgtaccgggtttacgttttacggtttaccgttttcgtacggttacgtattaacgtaatttaacggttaaggttcgggttagggtacgtaacggtaggttacggtacgtacccgttaaggtacggtcgttcgtttaagtcgttacgggttcgggaaccgtacggtcgtaacgggtaaccgg

SEQ ID NO: 95372 - DNA, 611 bp, Homo sapiens
  misc_feature: GYAE6OF01CIK26.51.36.D03.1.454.CMB.1.raw
  modified_base (540)..(540): a, c, t, g, unknown or other
  misc_feature (540)..(540): n is a, c, g, or t
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtcgggcccaggacttgtagaagccttcggagacactcgtccctcacctgcctctgtctcgtggcgtcctccatcagtagtagatattactagtgggctggagtccggacgaccgggccccccggggaaggggtccgtgggtagttggtagttggctagtatcgtagttactacgtcgggaccctaccttcttacgaacgtcgtcgactacgaagacgtacgacgtacacagtcgaccgcggactaccgtaccgaacggtacctacgttcctaccgtagaacgtctcgtacctcgtacgtccgaccgccgcgaacgccgtacgttctttagttactttcgtggttcacgttagaattattaggtggtaggtnacgtaggtcggtacgtccgtagtacggtcttcgtttagagttacggttcgggaacctaggtcgaggtaacg

SEQ ID NO: 95373 - DNA, 710 bp, Homo sapiens
  misc_feature: GYAE6OF01AJLEH.51.36.D03.1.454.CMB.1.raw
  modified_base (134)..(134): a, c, t, g, unknown or other
  misc_feature (134)..(134): n is a, c, g, or t
  modified_base (576)..(576): a, c, t, g, unknown or other
  misc_feature (576)..(576): n is a, c, g, or t
  modified_base (591)..(591): a, c, t, g, unknown or other
  misc_feature (591)..(591): n is a, c, g, or t
  modified_base (651)..(651): a, c, t, g, unknown or other
  misc_feature (651)..(651): n is a, c, g, or t
tcagcgatcgtatacacgaccggtgctcgatttagctgcgtcacgatctctcttgggggctttctgagagtcgtggatctcatgtgcaagaaaatgaagcacctgtgttcttcctcctctggtggcgctccagntcgggtcctgtccagttgcacctgcgaggtacgtcgggcccaggtacttggtgaacgtccctttacgggagactcctcgtcccctcaccgttgcttctcgtctcgtggcgctaccatcgaagtagtagacttattacgtacgtgggctggacgttccggacaccgggtacccccgggaaggggtcgtacggtacggttcggacgtttggacgtacgttagtacgtaacgtttacgtacgttacgggaccctacgttcgttacgacggttcgtcgtacctagtaacggtcgtacgcggttaccaacgtacgtcgaccggcggtaacccgaccgtaccgaacggtaccctacgttcctacccgtaagacgtcgtaccgaccttcgtccggtacggacccgaccgtacgaacgtccgtacggttacgttttagtacgttttccgngtactacgtaacgtnttaacgtagttgggtacggttacgaggtacggttcggtacgtacccgttagttacgggtnttaccgttttgaaacggtttcggttacgggaaccttaacggccggtaagttaacccggg

SEQ ID NO: 95374 - DNA, 790 bp, Homo sapiens
  misc_feature: GYAE6OF01DJOP5.51.36.D03.1.454.CMB.1.raw
  modified_base (120)..(120): a, c, t, g, unknown or other
  misc_feature (120)..(120): n is a, c, g, or t
  modified_base (624)..(624): a, c, t, g, unknown or other
  misc_feature (624)..(624): n is a, c, g, or t
tcagcgatcgtatacacgaccggtgctcgatttagctgcgtcacgatctctcttgggggctttctgagagtcgtggatctcatgtgacaaagaaaatgaagcactgtgttcttcctctcnggtggcgctccagatgggtctgtcccagttgcactgacaggagtccgggcccaggtacttggtagaacgtcccgttacggaagacctacttcggtcccctacgtaccctgtcctcgttggtcctcggttcgggccgtaccttaccgtatacgtagtttaacggtacgtaattaaccgttaacgtacggtcgggtcgttaggaacgtccggaccgaccggtacccccggggaaggtcgtaggtacgttaggtacgtcggtactaggttactagttacgtacgtacgtacggaccttacgttctacgtaaggtcctacggacctaacgtagaccgttagacgccgtaactagtaccgaccggtagtaacccgaacgtaaccgaacggtacctagttcccgtaccgttaaggacgtcgttaccgtccgtacgttggaacccgtaccggaccgtacgtaaccgacgtacccggttcttttagtacgtttcgtaagtacgtacgttaanacggttaattaacggtgggttaggtaaccgacgttaacgggttcggttacccgtaaccggttaaccgttacggggttactttaaccgggttttaaggttacccgttttaagggggtaaccggttaaacccggtacgggttaaccgtaaaccggggtttaaacccgg

SEQ ID NO: 95375 - DNA, 688 bp, Homo sapiens
  misc_feature: GYAE6OF01E2XU0.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtgttcttcctcctcctggtggcggctcccagatggtcctgtcccagttgcacctgcaggagtcgggcccaggacttgtgaagccttcggagacactgtccctcacctgctctgtctctggccgctccatcagtagtagatattactacgtggggctggacgtccggcgacggccccccggggaagggcgtggtagttggattggacagtatcgtagttatacgtagggacctaccttctacgtaagtccgtcgaccttacgaaagtacgtacgaacgttccaaccgagtacggaacccgacggaaccgtaacccgtaccgaaacgggtacccacgtttaccttccccgtagtaacgcctacgtacccgtcgtacggtcggaccccgccgacgtaagaccgtacggttctttagttactttcgtaggtgtacgtaagtaattaacttaagtgggttacggtagtaaccgtagggttacggtccgtcccgttaaacggttacgggttacgtttaccgttttagttaacgtttaacggtttacgggggaacccaaacgggtacccgtaaacggggttaaacccggg

SEQ ID NO: 95376 - DNA, 908 bp, Homo sapiens
  misc_feature: GYAE6OF01B8EET.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgttggttcttcctcctccgtggtggccggctcccagatcgggtcctgtcccagttgcacctgacgagggaggtccgggcccagggtacttggtagaacggtcccttacgggagaccaccgttcgtcccctctacctgccttctgtctcgtcggccggtacctccgtatccgtagtaagtagtaattacttaacgttacggtggggtccgtaggtacgtccggaccgaccggggaccccccgggggagggtcgtgggtagttcgggtaggttcggactaggttactacggtaacggtttaataccgtacgggtaccccttaccgtttaccttaccggtaacgttcccgttacgtaccgttaacggtaacggtacggttaccgtaaccgttacccgaaccgtaacggttacccggaacccgggtacccggaaacccgtaaccgggttaacccggaaaccggttacccgtaccgtttcccctacccgtaggtaaacccgtcctaccggaccctttcgtacggtacccggaccccgacccggtaccgaccgtacccggttacggtttacgtttttacgtttacgttttacgtcgggttctaacggtttaagttaaacgtttaacgtttaacgggttcggggtttagggtaacggttaacggttacggggttacgggttaccccgttaacccgtttaccggggtttaaccgggtttcggttttacggtttttaggtaacgggttttaccggggtttcggggggaaaccccgttaaaagggccccgggttaaaaccggttaacccgggg

SEQ ID NO: 95377 - DNA, 894 bp, Homo sapiens
  misc_feature: GYAE6OF01B3A8K.51.36.D03.1.454.CMB.1.raw
tcagcgatcgtatacacgaccggtgctcgatttagctgcgtcacgatctctcgttgggggctttctgagagtcgtggatctcatgtgcaagaaaatgaagcacctgtggttcttcctcctcctggtggcggctcccagatgggtcctgtcccagttgcacctgcaggaggtccgggcccagggtactttggtagaacgtcccgttcggagaccacctcgtcccctcacctgcctctcgtctcgtggccgtctccatctaggtagtagtatattactacgtgggcgtggacgtccggcaccgggcccccgggagggcgtaggtgtggtacgttggacgtagtatcgtagttacgtacgtacgggtaccctaccgttcgttaccgtagttccgtacgtccgtacgtaacggtacgtacgtaacgtacctaacctaacggtaccggtaccccgggtacccggaacccgtaacccgggttaacccgaaaccgggtaaccccctttaacggtttaccccgttaacccccgttacgggaaacccgttacccgtttaccgggtaaccccttccgggtttaccggtaaccccgggaccccggtacccggaccgtaaccggtacccggttaacccggttttccgttttaaccgttttacgttttccgttcgggtttaaccggttaccggtttaacgtttaaagggttaacttttaaacgggtttagggggtttacgggtaacccgggttaccggttaaggggtttacccgggtacggtttacccccggtttaaacggttaccggggtttaaccggtttttaccggtttttggttaaacggttttacggggttttaccggggaaacccggtaacgggttcggtaaacccggggttaaacccggg

SEQ ID NO: 95378 - DNA, 662 bp, Homo sapiens
  misc_feature: GYAE6OF01C9DO8.51.36.D03.1.454.CMB.1.raw
  modified_base (498)..(498): a, c, t, g, unknown or other
  misc_feature (498)..(498): n is a, c, g, or t
  modified_base (508)..(508): a, c, t, g, unknown or other
  misc_feature (508)..(508): n is a, c, g, or t
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtccgggcccaggacttgtgaagcccgttcggagacactcgtccctcacctgctctgtctcgtggcgtctccatcgagtagtagatattactacgtgggctggactccggcaccggcccccgggaagggctggtattggagttcggcagtactctagttatacgtcggacctaccgttcttcgaacgtcgtcgtctacgaaagcgtacgacgtaccaacctacgtcggacccggtacggaaccgtaccggtaccgaacgggtaaccctaggtttcccctacccgtaggaacgtccgtacgaacccttcgtacgtaccgacccggcccganacggtaaccncgggttacttttagttactttcgtcggtacgtacttaagtattacgtaagttggtaggtctacgtaggttggtaccgtcccttaaggtaccggtatttcgttttaggacgtttacggttaccggggacgtaaccgggtacccgttgtaaccccg

SEQ ID NO: 95379 - DNA, 676 bp, Homo sapiens
  misc_feature: GYAE6OF01AJ6GR.51.36.D03.1.454.CMB.1.raw
  modified_base (490)..(490): a, c, t, g, unknown or other
  misc_feature (490)..(490): n is a, c, g, or t
  modified_base (534)..(534): a, c, t, g, unknown or other
  misc_feature (534)..(534): n is a, c, g, or t
  modified_base (600)..(600): a, c, t, g, unknown or other
  misc_feature (600)..(600): n is a, c, g, or t
tcagcgatcgtatacacgaccggtgctcgatttagctgcgtcacgatcgtctcttgggggctttctgagagtcgtggatctcatgtgcaagaaaatgaagcacctgtgttcttcctcctctggtggcggctcccagatgggtcctgtcccagttgcacctgcaggagtccgggcccaggtacttgtgaagtccttcggagacactcgtccctcacctgctctcgtctctgggccgtcctccatcagtagtagtattaattaccgtacgtggggtctcgggacgtcccggccgaccgggacccccccgggggaaggggtcctgggtaggtttgggtacgttggccgtaagttatcgtaaggtttactacgtcgggtaaccctacctttcgtacgaacgttcggtctacgactaacggcgtacgtacgtaccaaccgtacgtacggacccggacggtaaccgaccgtaccgaacggtaccctacgtttcccnccgttagacgtctacgtaaccttcgtcgtaccgacccgtccganacgtccgtacggttctttgttactttcgtacgttcgtacgtagttaatacgttaggtcggtggtanacgtggtcgtcgtacctaggtacggtgtttactttaggagtttagggtaccggacgaacggtcggtaggtaaccgg

SEQ ID NO: 95380 - DNA, 684 bp, Homo sapiens
  misc_feature: GYAE6OF01CSLKH.51.36.D03.1.454.CMB.1.raw
tcagcgatcgtatacacgaccggtgctcgatttagctgcgtcacgatctctcgttggggctttctgagagtcgtggatctcatgtgacaaagaaaatgaagcacctgtgttcttcctcctcctggtggcgctcccgagatggtcctcgtcccagttgcacctgcgaggacgtccgggacccaggtacgttgtagaacgtccgttcggagactacgtcgtcccctcaccgtgccttctcgtctcgtggccgtctaccagtcgagttagtagtattacgttaacgttacggtggggtctggtaccgtcccggaccggaccccgggaccccccggggaaggggccgttagggtaggttggtacgttggacgttagttacgttacggtaagttacgtaaccggtccggtaccccttacctttccgttaacggtacgtcgtcgtacgtaacgaagtcgtacgtacgtaccgaactaacgtccggaaccggcgaaccgaccgtacgaaccgtaccttacgtccctaccgagactcgtacctacgtcgtacgccgaccccgtcgcgtaccgacgttcgttactttgttcttgtgtacgtaacgtagtagtattggtcggtgtacgagttcggtgtcgtactaaggtcgttagttagtttagagttcgggtacgacgacgtcgaagtaccgg

SEQ ID NO: 95381 - DNA, 727 bp, Homo sapiens
  misc_feature: GYAE6OF01DK059.51.36.D03.1.454.CMB.1.raw
  modified_base (679)..(679): a, c, t, g, unknown or other
  misc_feature (679)..(679): n is a, c, g, or t
tcagcgatcgtatacacgaccggtgctcgatttagctgcgtcacgatctctcttgggggctttctgagagtcgtggatctcatgtgcaaagaaaaatgaagcacctgtggttccttcctcctcgtggtggcgctcccagagtgggtcctcgtcccagttgcaccgtgcgaggaggtccgggcccaggtacttggtagaacgtcccgttcgggaagacaccgttcgtcccctcacctgccttcgtcgtctcgtcggcgcctcatcagtagagtattattacgtcggtgggtctggacgtccggaccgaccgggacccccggggaggggcgtggtagttggagttcggacgtacgttatcgttaagttacgttacgtacgggtacccttaccttcgttacctaacggttccgtcgtacctacgaaagtacggttaccgaacgtaccaaccgtagtacccggacccggaccggaccgtaaccggtacccgaacgggtaccctaccggtttccctaccgtagaacggtccctacggtacccgttcgtacgggtacccgtaacccggccgtacaccggtaccgttacggttcttttaagttactttcgtggtagtacttaagatttaagtaaggttgggtaggtactacgtgggttcgaccgtacgttacggtaggttcgtttntttaggaagtttcgggttaacgggaccaaagggtccgtaaggtaccgg

SEQ ID NO: 95382 - DNA, 708 bp, Homo sapiens
  misc_feature: GYAE6OF01BR66A.51.36.D03.1.454.CMB.1.raw
  modified_base (194)..(194): a, c, t, g, unknown or other
  misc_feature (194)..(194): n is a, c, g, or t
  modified_base (546)..(546): a, c, t, g, unknown or other
  misc_feature (546)..(546): n is a, c, g, or t
tcagcgatcgtatacacgaccggtgctcgatttagctgcgtcacgatctctcttgggggctttctgagagtcgtggatctcatgtgcaaagaaaatgaagcacctgtgttcttcctcctcctggtggcgctcccagatgggtcctgtcccagttcgccaccgtgacgagggacgtccgggcccaggtacttggngaacgtccgttacggagaccactcgtccctcaccgtgtcttctcgtctcgtcggccgtctccatcgagtagtagtattacttacgtacggtgggcgtggaccgtccggacggacccggtaccccgggggaggtccgtgggtacgttggtagtcggcgagttactacgtagttacgtacgtaccggtaccttaccgtttcgtacgacgttcgtcgacgtaagaacggtcgtacgacgtaccacgtacgtaccggaccggaccgaacgaccgtaccggaacgtctacgttccacgtagaccgtctacgtaccttcgtcggtaccgcccgacgtacgaccgtaccggttacgttntttacgttaccgtttgtacgttaccgtaagttacgtaattaggttacggtgggtacgtacgggtactcgggtggtacccgttacgtaccgggtacggttcgttttacgttaggtaccggttacggttacgggaaccgtaaggtaccgttaacgggtaacccg

SEQ ID NO: 95383 - DNA, 741 bp, Homo sapiens
  misc_feature: GYAE6OF01CS27N.51.36.D03.1.454.CMB.1.raw
tcagcgatcgtatacacgaccggtgctcgatttagctgcgtcacgatctctcttggggctttctgagagtcgtggatctcatgtgacaaagaaaatgaagcacctgtggttcttcctcctcctggtggcggctcccagatcgggtcctgtcccagttcgcacctgcgaggaggtccgggcccagggtacttggtagaacgtccgttcggagacacgtcgtcccctctacctcgcttcgtgtctcgtcggccgcctcatcgagttagtagtaattattactacggtgggtcgtgacgtccggccgaccggacccccggggaagggtcgtagggtacgttggtacgttggactagtactcgtagttacgtacgtcggtaaccttccgttacgttacgtacgttccgttcctacgtacgtaacggtacgtacgtacgtaccaaccgtacggtaccgaccgtaccggaccgtaccgaacgtaacggtaccttacgttcccgtaccgtagaaccgttcgtacctaccgttcgtcgtaccgacccgtcgtacgaacggtaccttacgggtttctttacgtttcgtttacgtcggttacgtaacgttagtaagttaacgttagggtcgggttaaggtacgtaacggtcgggttcgttaaccgtaccggttaacggttacgggtgtttccgtttaaggttaggttacggttacgggaacccgtaaggtacccggtaacgggttaaccgg

SEQ ID NO: 95384 - DNA, 791 bp, Homo sapiens
  misc_feature: GYAE6OF01DCLSQ.51.36.D03.1.454.CMB.1.raw
  modified_base (776)..(776): a, c, t, g, unknown or other
  misc_feature (776)..(776): n is a, c, g, or t
tcagcgatcgtatacacgaccggtgctcgatttagctgcgtcacgatctctcgttggggctttctgagagtcgtggatctcatgtgacaaagaaaatgaagcacctgtggttccttcctcctcgtggtggccggctcccagagtgggtcctgtcccagttcgcacctgcgaggacggtccggccaggtacttggtagaacgtccgttcggaagaccacttccgtcccctcacctgccttcgtcgtcctcgtcggccgtcctaccagtacaggttacgtagtaattacgttacgtacggtgggtcgtaggaccgtccggacgacccgggtacccccggggtaagggtcgtggttaaggttcggtagtttcggactaagttactacgttaacgttacgtaaccggttcggtaacccttacccgtttcttaaccggtaacgttccgtaccgtacgtaacgaaacggtcgtacgacgtaccaaccgtacggtccgaccggaccggtaaccgtaacccggtaccgaacggtacccgttacgttccccgttaaccgtacgaaacggttcctaccgtaaccgttacgttccggtaccgaccccggaccgttaccgaacgttacccgttacggtttccgtttagtttaccgtttcgtagttaccgtattacgaatttaacgtaggtcgggttacgtaacgtacgtaggttcggaccgtaccgttaaggttaccggttagtttccgttaagtaacggtttccgggttaacgggccttaaacgggngtaaccgggtaaccg

SEQ ID NO: 95385 - DNA, 684 bp, Homo sapiens
  misc_feature: GYAE6OF01EEO48.51.36.D03.1.454.CMB.1.raw
  modified_base (631)..(631): a, c, t, g, unknown or other
  misc_feature (631)..(631): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttcgcacctgcgaggagtccgggcccaggtacttgtagaagccgttcggagacactcgtccctcaccgtgctctgtctcgtggccgctccatcgtagtagtagtattagttactacggtgggctggacgtccggacgaccggacccccggggagggtcgtggtacgttggacgttggctagtatcgtagttacgtacgtcgggaccctacctttcgtacgtaacggttccgtacgtctacgaaagtacggtacgacgtaccgaaccgtagtaccggacccggtcggaaccgtacccgtaaccggaacggtacccgtaacgtttcccgtacccgtaggaaccgtccgtaccgtacccttcgtacgccgaccccggacgccgtaacgaccgtacggttctttgttactttcgtgtcgtacgtagtattacgtagtgggtacggtcgtacgtggttacgtcgtaccgttacggtacggttnttacgtttagacgtttagggttacgggaaccgtaaggtcgtaacggtaaccgg

SEQ ID NO: 95386 - DNA, 869 bp, Homo sapiens
  misc_feature: GYAE6OF01BAHYM.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtgttctcctcctcctggtggcggctcccagatgggtcctgtccctagttgccacctgcaggacggtccgggcccaggtactttggtagaacgtcccttacgggagaccacgttcgtccctcacctgctctgtcctcgtcggccgtcctcctatcgagtagtagtattagttaccgtacggtgggtctggacgtcccggcgacccgggacccccgggggaagggtcgtacgggtagttgggtacgttcgggacgtacgttacgtacgtaggttaacttaccggtacgggtaaccccttaccgtttaccgtttacgtaacggttccgtaccgtaccgtaacgaacgtacgtacgtaacgtacctaaccgacgtaccgggacccggtccggtaaccgtaacccggtaaccgaaaccggtaccgttaaccgttcccgtaccccgtaacggtaaccggttacccgtaccgtacccgttcggtaccggtaccgtaccccggccggaaccgtaccggtaacccggtaccggtttaccgttttagtttacgtttcgttacggtaacgttaccggttaaagttaacgttaaacggtttaacggttcggggttacgggttaccgtaacgggttacggtacggggttaccgttaacccggtttaaacggtacggggtttaccttttacggttttaacggtacgggtttttaccggggttaccggggtaaacccgggtaacggttaaccccgggtaaacgggtttaaacccccggg

SEQ ID NO: 95387 - DNA, 852 bp, Homo sapiens
  misc_feature: GYAE6OF01BA0JY.51.36.D03.1.454.CMB.1.raw
tcagcgatcgtatacacgaccggtgctcgatttagctgcgtcacgatctctcttgggggctttctgagagtcgtggatcctcatgtgacaagaaatgaagccacctgttcgttcttcctcctccgtggtcggcggctcccagtgttcgggtcctgtccctagttcgccactcgacgaggacggtcccggcctaggtacttgtacgacgtccgttacggacgacctaccttccgtcccctcgaccgttcgccgttcgttcgttcccttccggtcggtacccggtcccttacctacgttacgtaacggttaacgtaacgttaattttaaacgtttacccgttaacgggttacggaccggtccggtttaccgggtaaccggtccccgggaaccggtacccccggggtaacccccgggggtaagggttccgtagggtaacgttccgggtaggtttccggacgttacgttacgtaacgtttaggttaccgtaccggttccgggtaaccctttaaccgtttccgttaaccggtaccgttccggccgttacgtaacgtaacggtacggttcccgaagtacccaaccggtacgtacccggaccccggaagtacctaccggtacccgaacgttaccccgtaccgtttacccgtaccgtacggtaactccggtacgttaccgtacgtccaccgggtacccgtccgaacgtccgtaacgttcgtttcgttacttcgtttacgtgtagttactagttaattacgtacgtggtactgtacggtagacggttcgtaaccgtacgttccggttattaggttttcggaacgtttaccggggtactaacggacgtacccggtaaaccgg

SEQ ID NO: 95388 - DNA, 680 bp, Homo sapiens
  misc_feature: GYAE6OF01E0WPB.51.36.D03.1.454.CMB.1.raw
  modified_base (373)..(373): a, c, t, g, unknown or other
  misc_feature (373)..(373): n is a, c, g, or t
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcagggagtccgggcccaggtacttggtgaacgtccgttcggacgacactcgtcccctcacctcgctctgtcctcgtcggccgctccatcgaagtagtagtatattactacgtgggctggacgtccggcgaccggcccccggggagggcgtggtagtggagttggctagtactacgtagttactcgtacggacctacttctacagtcgtcnctacagacgtcgagtaccacagtacgaccgcggacgtaccgtaccgaacgtacctacgttcctaccgagtaccgtcgtaccgtaccgttcgtcggtaccgacccgccgaccgacgtaaccggtcggtttcctttagttacgtttcgtcggtgtacgttaagtaatttaacgttaaggttggttacgggtacgtaacgttagggtacgggttaccgtaccgtttaacggtacggtttacgtttacgttttacggtaagtttaccggggttacgggaacccggtaacgggaccgtaacgggtaacccgg

SEQ ID NO: 95389 - DNA, 684 bp, Homo sapiens
  misc_feature: GYAE6OF01B6MTK.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcgaggacgtcgggcccaggacttgtgaagccttcggagacactcgtaccctcacctgccttctgtcctctggccgtctccatcagtagtagtattattacgtacgtgggctaggactccggacgaccggcccccggggaagggctaggtagtggagttcggctagtactcgtagttactacggtacgggtacctaccttcgttacaacggtcgtcgtctacgaagtacgtcgacgttacgaacctagtaccgaccgacggacctaccggtacccgaacggtaccgtacgttccctaccgtagaacgtcctaccgtactcgtcggtacgacccgcgactacgaccgtacgttctttagttacttcgtacgttagaccgttaagtaactttaacgttagttagggttacgggtacgtaacgtgggttcgggtaccgtaaccggtttacgtacgggttacttcgttttaagtacggtttacgggttaccggggacctaagggtacccggtaaccggttaacccgg

SEQ ID NO: 95390 - DNA, 676 bp, Homo sapiens
  misc_feature: GYAE6OF01APPDH.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactcgtccctcacctgctctgtctctggcgctccatcagtagtagatattactacgtgggctggacgtccggcacggcccccggggaaggggctgggtagttgggattggctagtactctaagttatacgtcgggacctaccttcgttactaacgtcgtcgctacgaacgagtacgacgtcacagtcggaccgcggaacaccgtaccgaacggtacctacgtttccctaccgtacgtaacgtctaccgtacctcgttacgtaccggacccgtccgaccgacgtaccgtcggttacttttagttaacgttttcgtaggttacgtaccgttaagtacgtttaagttaacggtgggttagggtacgtacgtaacgggttggtaccgtacccgttaaggtaacgggttcgtttacgttttaaggtacggtttaacgggtttccggggaacccgtaagggtaccgtaagggttaacccggg

SEQ ID NO: 95391 - DNA, 771 bp, Homo sapiens
  misc_feature: GYAE6OF01EU6FI.51.36.D03.1.454.CMB.1.raw
  modified_base (211)..(211): a, c, t, g, unknown or other
  misc_feature (211)..(211): n is a, c, g, or t
  modified_base (703)..(703): a, c, t, g, unknown or other
  misc_feature (703)..(703): n is a, c, g, or t
tcagcgatcgtatacacgaccggtgctcgatttagctgcgtcacgatctctcttgggggctttctgagagtcgtggatctcatgtgacaagaaaatgaagcacctgtgttctcctcctcgtggtggcgcctcccagtagtggtcctgtccctagttcgccacctgcgaggagtccgggacccaggtacttggagaacgtccgttacggganaacctcgtcggtacccctcaccgtgtcctactgtctccggtacggccgtcctaccgatacgacggttaatagtacttaacgttacgttacggtggggtccgtacggtacgtccggaccgtaccccgggacccccggggtagggtcgtcgggtagttcggaggtttcggacgtagttacgtacgtacgttagttaccgtacggtaacccttacgtttccgttacgtaacggttccgtccgtaccgtaacgtaacggtcgtaccgtacgtacctaaccgtacgtacccgggtaacccgaccggtaacctaacccggtaaccgtaaccggtaccttaaccgttccctaaccggtacgtaacccgtacttacccggtaccgttcgttacggacccggtacccgccgtaaccgacgtaacccgttcgtcgtttaacttccgttacgtacgtacgtagttaacgttcttaagtacgttggtacggtagacgttacggngttaccgtaccgtaggtacggttcttcgttataggttccggtagaccgtaacgtcggtaaacgtacgg

SEQ ID NO: 95392 - DNA, 711 bp, Homo sapiens
  misc_feature: GYAE6OF01BB0KT.51.36.D03.1.454.CMB.1.raw
  modified_base (228)..(228): a, c, t, g, unknown or other
  misc_feature (228)..(228): n is a, c, g, or t
tcagcgatcgtatacacgaccggtgctcgatttagctgcgtcacgatctctcttgggggctttctgagagtcgtggatctcatgtgcaagaaaatgaagcacctgtgttcttcctcctcctggtggcggctcccagatgggtcctgtcccagttgcacctgcgaggagtcggcccaggacttgtgaagtccgttcggagactactcgtccctcacctgctctgtctcnggccgctccatcagtagatattacttacgtacgtcgggtctggacgtccggacgaccggcccccgggggaagggtcgtcggtagtttggagtttggcgtaagttactacgtaggttacgtacgtcggacctaccctttcttacgaacgttccgtacgtcgtacgaagtacggttcgacgttaccaccgtataccggacccgtaccggaaccgtaaccggtaccgaaccgggtaccgtaccgttcccgtacccgtagaacgtccgtacgtaccttcgtcgtccgacccggcccgtacgaacgtccggtacggtttctttagttactttcgtagtcgttacgtaagttaattagttaggttacgggtagggtacgtaggtagggttcggttaccgtacccggtttaaggttaccggtcggttttacttttaggaacgttttacgggtaccgggtaaccgtaaggtaacccgtacgggtaaccggg

SEQ ID NO: 95393 - DNA, 892 bp, Homo sapiens
  misc_feature: GYAE6OF01ACSX2.51.36.D03.1.454.CMB.1.raw
tcagcgatcgtatacacgaccggtgctcgatttagctgcgtcacgatctctcgttgggggctttctgagagtcgtggatctcatgtgacaaagaaaatgaagcacctgttggttcttcctcctcgtggtggcggcctcccagagttcgggtcctcgccctagttgccaccgtgacgagggacggtccgggcccgtaaggtactttggagaacgtcccgttggaacgacctcgtcgtcccctcacctgtccttctcgtccgtcgtcgggccgtcctaccgtagtcgtaagttaagttagtaatttacgttaccgttacgggtcggggtcgtacgggtaccgtccggaacccggacccccggggacccccgggggtaagggtccgttagggtacggtttacgggttagttccgggtaatacggttactacgttacgtttacggtacggtaccgggtaaccccttacgtttaccgtaaccgtacgggttcctaccggtactaacgtaaaggtccggtacgaccgtacctaacgaggtacccggaacccgacggtaacccacggtaccccgtaaacggtacccgttaccgttaccctaccgtaaggtaaccggtccctaaccgtacccgtcgttaccggtacccgacccggtccgaaccggtaaccgtaccggttcggttttacctttaggttccttttacggtacggtacttaacggttaaacttaagttaagggttaacggttgggtaacgggttagtacgggttacggttacggtaccggtttaacggtttaccggttaacggggtttcttttaggggttttaccgtaagggttttccggggttaaccggaaaaccgggttacgggtaaacccgttaaggggtaacccccggg

SEQ ID NO: 95394 - DNA, 800 bp, Homo sapiens
  misc_feature: GYAE6OF01E05IV.51.36.D03.1.454.CMB.1.raw
  modified_base (220)..(220): a, c, t, g, unknown or other
  misc_feature (220)..(220): n is a, c, g, or t
tcagcgatcgtatacacgaccggtgctcgatttagctgcgtcacgatctctcttgggggctttctgagagtcgtggatctcatgtgacaaagaaaatgaagcacctgtcgttccttcctcctcgtggtggcggctcccagagtgggtcctgtcccagttcgcaccgtgcgagggacggtccgggacccaggtactttggtagaacgtcccgttacggganacctacgttcgtcccctacgacctgccttctcggtctacgtcggccgtcctccatcgtaagtagtagtacttaacgttacgtacggtcggggtactcggtacgtcccgggaccgaccccgggggtacccccgggggaagggttccggttagggttaacggtttcgggtatttcggggacttaacggttactccgtaaggtttacgtaccggtaccgggtaacctaccttttccgtacgtaacgttccggtacgtacgtaacgagtacgcgtacgtaccacacgtacggaccgacggactacgtacgaacgtctacgttaccctcgagtactcggtactccgtacgccggtaccgaccgtccgacggacgttaccggtcggtttaccgtttacgttacgttcgtacggttacgttaaccgttaagtaacggtttaatacgggttaggttacgggtacggtaaacggttcgggtacgggttacccgtacccggtttaacgggttaccggttaggttttccctttaaggttaacgttaccggggttaaccggtaacgaacgggtaccggtaaagttacccggg

SEQ ID NO: 95395 - DNA, 839 bp, Homo sapiens
  misc_feature: GYAE6OF01AX4RI.51.36.D03.1.454.CMB.1.raw
  modified_base (587)..(587): a, c, t, g, unknown or other
  misc_feature (587)..(587): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcgaggagtcgggcccaggtacttgtgaagtccgttcggagaccactcgtccctcacctgctctgtcctcgtggccgtctaccatcgagtagtagattattactaccggtgggctggaccgttccgggccgaccggccccccgggggaaggggccttaggtagttggtagttcggcagttactgtagttacgttacgtcgggtacctaccgttcttctaacggttccgtcgtactacgaagacgtacggtacgtaccgacctagtacccggtaccggaccggtaaacctaccggtaacccggtaaacgggacccgtttaaccggtttccccgtacccgttaaccggtaaggtccccttacggtacccgttacgttcggtacccgacccggtcccggaccgtaaccggtaacccgggtacccgtttnttttaccggttttaacgttttcgtcgggttacgttacgtaagttacgtttaacgttaaggttggggttacgggggtaacgttaccggttaacgggttaccgggtttacccggttaacccgtttacggggtttaaaccgggttaacggtttttaccgggttttttaacgtaaacggggttttttacccggggttaacgggggttaaaccccgggtaaacgggtcccgggtaaacccggggtttaaaccccggg

SEQ ID NO: 95396 - DNA, 773 bp, Homo sapiens
  misc_feature: GYAE6OF01BX4AF.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctctggtggcggctcccagatgggtcctgtcccagttgcacctgcaggagtccgggcccaggtacttggtcgaacgtccgttgggagacctactcgtcccctcacctgccttctgtctcgtcgggccgtcctaccatcgagttaagtacgtattacttaccgtacgtgggctggacgtccggcgaccccggggacccccggggaaggggtccgtagggtacgtttgggtacgttggactaagtactacgtacgttaataccggtacgggtaaccctaccgtttacttacgtaacgttccgtcgtacctaagtaacggtcgtacgacgtaccaaccgtagtaccggaccggaccggacctaccggtacgaaacgtaccgtacgttaccctaccgtagtaaccgtcgttaaccgtccgttcgtacggtaccgacccgccgacgaggacccgtcggtttcttttagtacgttttcgtagtacgtacttaacggttattaagggttacttcggggttacggtacgtacggttaggttaccgggttaccgtaaacccggttagggttaaacggttcggttttacgtttaggtttaacggtttaacggggttaccggggttaaacccgaagggttaacccggtaaccgggttaaccccggg

SEQ ID NO: 95397 - DNA, 809 bp, Homo sapiens
  misc_feature: GYAE6OF01BSIR7.51.36.D03.1.454.CMB.1.raw
  modified_base (242)..(242): a, c, t, g, unknown or other
  misc_feature (242)..(242): n is a, c, g, or t
tcagcgatcgtatacacgaccggtgctcgatttagctgcgtcacgatctctcttgggggctttctgagagtcgtggatctcatgtgacaagaaaatgaagcacctgtggttcttcctcctcctggtggcggctcccagagtcggtcctgtcccagttgccacctgcgaggagtccgggcccaggtacttgtgaacgccttcggagacactcgtccctcacctgctctgtctcgtggccgtcnccagtcagtagtagattacttacgtacggtcgggctggacgtccggacaccgggccccccggggaagggtccgtaggtacgtttgggtacgtttcgggacgtaacggttactacgttacgtttaacgtaccgttacgggtaacccttaaccgtttaccgtttaccgtaacggttccgtaccgtacgttaaccgaaaggtacggttaccgaacgtaccgaacctaacggtcgacccgaccggaaccgtacccggtaacccgaacgggttaccctacggttccccgtaaccccggaacgttccgtaccgtaccgttcgttaccggtaccggacccgtccggaccgaacgtaccggttccgttcgtttttactacgttttcgtcgtacgtaccgttaagtaacgtttacgttaaggttgggttaggggtaacgtaacggttcgggttacgggttccggttaacccgtttaaccgtaacggggttacttttccggtttaaacggttaggtttaccggggttttacgggacccgttaaagggtcccggaaacggtttaacccggttacccgg

SEQ ID NO: 95398 - DNA, 786 bp, Homo sapiens
  misc_feature: GYAE6OF01ARS92.51.36.D03.1.454.CMB.1.raw
  modified_base (81)..(81): a, c, t, g, unknown or other
  misc_feature (81)..(81): n is a, c, g, or t
tcagcgatcgtatacacgaccggtgctcgatttagctgcgtcacgatctctcttgggggctttctgagagtcgtggatctnatgtgacaaagaaaatgaagcaccttgtgttcttcctcctcgtggtggcggctcccagagtcgggtcctcgtccctagttcgccactgcgagggacggtccgggcccaggtacttgtgaacgtccgttacggagtacactcgtcccctcacctgtctctcgtctcgtcggccgctccatacgagtagtatatattacgtacgtgggctggactccggcgacccggccccggggaggtcgtaggtagttcggtagtggacctaggttactcgtaacgttacgtacgtaccggtaacccttaccttcttacgtaacggttcgtaccgtaccgtacgtaacggtacgtaccgtaacgtacctacgtaaggtacccggaacccgggaccggtaaccgtacccggtaacccgaacggggtaacccttcccgtttaccggttaccccgtaggtaaccgtcccgttaccggtacccgtacgttcggttacccgacccggtcccgaaccgtaacggtacccggtacgtttcggttttacgtttcgttttcgtacggttaccgtaacttaaggttaacttaaattacgggttgggtacgggttaacgtagttacgggttcgtacgtcccgttaaggtacggtttacgttcgttttaaggaccggtttagggttaccggggtaaccctagggtaccccgttaagggtaaccccgg

SEQ ID NO: 95399 - DNA, 848 bp, Homo sapiens
  misc_feature: GYAE6OF01C47MC.51.36.D03.1.454.CMB.1.raw
  modified_base (150)..(150): a, c, t, g, unknown or other
  misc_feature (150)..(150): n is a, c, g, or t
  modified_base (174)..(174): a, c, t, g, unknown or other
  misc_feature (174)..(174): n is a, c, g, or t
tcagcgatcgtatacacgaccggtgctcgatttagctgcgtcacgatctctcttgggggctttctgagagtcgtggatctcatgtgacaaagaaaatgaagccaccttgtcggtttccttcctcctccgtgggtggccggctacccgagngttcgggtcctcgtaccctagttnccgacctgacgaggtacggtccgggaccaggtacttggagtaacgtcccgttacggaagtacctacgttccgtccctacctccgtggtccttcgttcgtacgttcggcggtccgtactaccgtagtacgtaaggttagtaacgttaacgtttaacgtttacccgttagggggtacgggttccgttaccgggtaaccggtcccggtacccgggaaccccgggggtacccccccgggggtaaagggtcccgttaggggtttaaccggttagggttaacgttcggactaaggttacgtaaccggttagttacgtaacggtccggtaacccttaccgttcgtaaccgtagtccggtacctactaacgacgtacggtcgtaacgtccaacgtacgtccgaccggtaccggtaactacccggtaacgtaaacgtccgttacgtcctaacgtagcgtacgttaacgtccgtacgtaccggtaccacccggtccgtaacgtaccgtaacggttccgttttctttaacggtttacttcgggtaacgttcggtaacgttaacgtaacttaggttacggttcggtaggtacgtacggtcggttacgaccgttactagggttaacgtcgggtttaacttaggtacggttacggttcccgggaataaccggtcgtaacgggtacccg

SEQ ID NO: 95400 - DNA, 847 bp, Homo sapiens
  misc_feature: GYAE6OF01A8TUF.51.36.D03.1.454.CMB.1.raw
tcagcgatcgtatacacgaccggtgctcgatttagctgcgtcacgatctctcttgggggctttctgagagtcgtggatctcatgtgacaaagaaaatgaagcacctgttgttcttcctcctcctggtggcggctccagatggtcctgtcctagttgcacctgcaggagtcggccaggtacttgtgaacgtccttcggagacacgttcgtcccctacacctgtctctgtctcgtcggccgctaccatcgagttagtagtattacgttactacggtgggcgtggacgtccggaccgaccgggacccccggggaaggggtccgtagggtacgtttacggtagtttcggacgttaacgtacgttacgtaacggtttaacgtaccggttaccgggtaacccttacccgttttaccgttaacgtaacggttccggttaccgtaccgttaacgtaaacggtacggtaccgtaacgtaccctaaccgtacgtaccggaacccggaccggtaacccgtaaccggtaacccgaaccggtaaccgtaccggttcccgttaccccgtaaggacccgtaccgttaccggtaacccgttcggttaccgggtaccgaccccgggacccgtacgaaccggtaaccgttacccggtttactttacggtttacgttttccggttaggtaccggttaactaacggttaatttaaggttacggttagggttacggggtagtaaccggttgggttaccgggtacgttaaccccggttacggtaacgggttacgtttacggttttaacggtaacggtttaccgggttaccggggtaaaccggtacgggtaacccgtaacgggttaccgg

SEQ ID NO: 95401 - DNA, 674 bp, Homo sapiens
  misc_feature: GYAE6OF01AGHDG.51.36.D03.1.454.CMB.1.raw
  modified_base (198)..(198): a, c, t, g, unknown or other
  misc_feature (198)..(198): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcgganactactcgtccctcacctgctctgtctcgtggcgctccatcgagtagtagattattactacgtgggctggactccggcacggcccccggggaagggcgtggagttggagttgcgagtatctagttatacgtcggacctaccttcttacgacgtccgtcgtctacgaagtacgtacgtacgtacaccgtagtccgtaccgacggactaccggtaccgaacggtaccgtacgttcccgtaccgtacgaacgtcctacgtacccgttacgtcggtaccgacccggtaccgaccgtacggtaccgtaccggttcttttacgttacttttccgtgttacgtacgttaacgtaattaagttacgttaggttacgggtagacgttagggttcggtaccggttaccgttacggttacggtacgtttacgtttaggtacgtttacggggttacgggaccctaagggtccggtaaggtaacccggg

SEQ ID NO: 95402 - DNA, 794 bp, Homo sapiens
  misc_feature: GYAE6OF01DWB1V.51.36.D03.1.454.CMB.1.raw
  modified_base (140)..(140): a, c, t, g, unknown or other
  misc_feature (140)..(140): n is a, c, g, or t
  modified_base (598)..(598): a, c, t, g, unknown or other
  misc_feature (598)..(598): n is a, c, g, or t
  modified_base (656)..(656): a, c, t, g, unknown or other
  misc_feature (656)..(656): n is a, c, g, or t
  modified_base (663)..(663): a, c, t, g, unknown or other
  misc_feature (663)..(663): n is a, c, g, or t
  modified_base (669)..(669): a, c, t, g, unknown or other
  misc_feature (669)..(669): n is a, c, g, or t
tcagcgatcgtatacacgaccggtgctcgatttagctgcgtcacgatctctcgttgggggctttctgagagtcgtggatctcatgtgacaaagaaaatgaagcacctgtgttccttcctcctcgtggtggcgctcccagngtcgggtcctgtccctagttgcaccgtgcgagggtacggtccgggcccgaggtactttggacgaacgtcccggttcggaacgtacctaccgttcgtcccctacctccgtgtccttcgtcgttccgtcgtcggccgtcctacctagtcgtaagtacgtaagtattaacgttacgttacgggtcgggtcgtacggtacggtcccggaccggaccccgggtaccccccggggggtaagggtccggttagggttacgtttcgggttaacggttcggtctaaggttacgtacgttaacgttaacggttaccggtacggtaacccttaccgtttacgtaccgtacggttaccgtcgtaccttaacggaagtcggtacgacgtaccaacgtagtccggaccgtacggtaccgtaacccgtaacggtaaccgtacccgtttacggttaccctaccgtaacggtacncccgttgtaccgtcgtacggccgaccgtccgacgtaacgtaaccgttcgttacgtttntacgttntacgtntagtactagttactaggtggttacggacgtcgtacggttcggacgttacgtagggttaacggttgtttaaggtttagtacggtttacgggttacgaacccggtagtaaacccggagttaacccgg

SEQ ID NO: 95403 - DNA, 755 bp, Homo sapiens
  misc_feature: GYAE6OF01BDL1O.51.36.D03.1.454.CMB.1.raw
tcagcgatcgtatacacgaccggtgctcgatttagctgcgtcacgatctctcttgggggctttctgagagtcgtggatctcatgtgacaaagaaaatgaagcacctgtggttccttcctcctcctggtggcggctccagatgggtcctgtccagttgcacctgcaggcgtcgggcccaggtacttgtgaacgccttacggagacactcgtcccctcacctgctcttcgtctcgtggccgctccatcagtagtagattattacgtacgtgggctaggactccggacgaccgggacccccggggaagggtctgggtacgtttggtagttcgggactacgttactacgtaaggtttactaaccgtcgggtaaccccttaccgttttaccgtacgtaacggtttccggtacccgtacgtaaccgtaacggtacggttaccggtaacgttacccgaaccgtaacgtacccgggaccccgggtaacgggaacccgtacccgggttaacccgaaacgggttacccgttacggtttacccctacccgtaaggtaaccgtcgtaaccgtccgttcgttacggccgacccggtaccgacgtacgtaacgttccggttacttttgttactttcgtcgttacgtccttaagtaattaacgtttaaggtcgggtaggtcgtacgtcgggttgtacgtcctacggtacggtgtttaacgtttgaacggtttagggttacggggaacgtacgggtcggtaagtaacccgg

SEQ ID NO: 95404 - DNA, 853 bp, Homo sapiens
  misc_feature: GYAE6OF01EJ8RO.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcaccgtgcgaggagtccgggcccaaggtacttggtagaacgccttcggagacacgtcgtccctcacctgctctgtctcgtggccgctcatcgtagtagtagtatattacgtacggtgggctaggacgtccggaccgaccgggacccccggggtaggggtcgttgggtagttacggggtagttcgggacgtaacggttacgtacgttacggtttaacggttaccggtaccggtaaccctttacccgttttaccgttacgttaaccggttccgtaccgtaccgttaacgaaaggtacggtacgtaacgtaccgaacgtaacggtcccgggaacccggtaccggaacccgtaacccggtacccggtaaaccgtaccgttaccggtttcccgtaaccgtcggtaaacgtccccgtagtaaccccgtttggtacggttacccccgaacccggcccgtaaccgtaccggtaacccggtttacccggtttacgttttcgtttaacgtttcccgttaggtacgttaacccgtaaagttacggtttaaacgttagggttacggggttacggtaccgtaaagttaccgggttacggttaccgtaaccccgggttaaggttagggttcccgttttacgtttaaggtaaccggtttttacggggtaccggaaacccgggtaacggttaccccgtaaggttaaccccggg

SEQ ID NO: 95405 - DNA, 890 bp, Homo sapiens
  misc_feature: GYAE6OF01BNL4K.51.36.D03.1.454.CMB.1.raw
tcagcgatcgtatacacgaccggtgctcgatttagctgcgtcacgatctctcttgggggctttctgagagtcgtggatctcatgtgacaaagaaaatgaagcaccttgttggtttccttccctcctccgtggtggccggcctcccagagtgggtcctgtcccagttgcacctgcgaggaggtccgggcccaggtacttgtagaacgtcccgttacgggagaacctaccgttccgtcccctaccgtacccttcggtcccttcgttcggttccttccggtccgggccccggtccctttaccccaagttaccgtaaggtttaacggtaacgttaactttaacgttttacccgttacggttcgggggtccgttacggtaacccgttcccggggaccggtaacccccgggggacccccccgggggggtaaggggtcccgttaggggtaaggttttcggggtacgtttacgggacgttaaggttacgttaaccggttaacggttttaacgtaccggttacccgggttaaccccttaccgttttcttacgtaccggttccgtaccgtcctaggaaacggtaccgtcggtaaccgttccaacccgtagtacccggaaccggaccgtacgaacccggtacgaacgtacccgtcgttacccgtccgaggaccgtcctaccgtaccctggtcccggtaccgccccgtcgaaccggtactacccgggttacgttcgttttagtttaccgttcgttcgtacgttacgttaaagtttaattaacggttaaggttcggttagggtacgtaaggttacgggtcgttacgtacccttaggttacggttccgtttagtttaggtacggtttacgggtacgggaaccgtaacggtgtacccggttaacg

SEQ ID NO: 95406 - DNA, 822 bp, Homo sapiens
  misc_feature: GYAE6OF01CA24I.51.36.D03.1.454.CMB.1.raw
  modified_base (126)..(126): a, c, t, g, unknown or other
  misc_feature (126)..(126): n is a, c, g, or t
  modified_base (161)..(161): a, c, t, g, unknown or other
  misc_feature (161)..(161): n is a, c, g, or t
  modified_base (220)..(220): a, c, t, g, unknown or other
  misc_feature (220)..(220): n is a, c, g, or t
  modified_base (259)..(259): a, c, t, g, unknown or other
  misc_feature (259)..(259): n is a, c, g, or t
  modified_base (810)..(810): a, c, t, g, unknown or other
  misc_feature (810)..(810): n is a, c, g, or t
tcagcgatcgtatacacgaccggtgctcgatttagctgcgtcacgatctctcttgggggctttctgagagtcgtggatctcatgtgacaaagaaatgaagcacctgttgttcttcctcctcgtggnggcgcctcccagtagtcgggtcctgtccctagttnaccaccgtgacgagggacggtccgggccaggtaccttggtacgaacgtccgttcggganacctactcgttccctacaccttcgcctcgtcgtcgtcgnggccgtctccgatacgtagtagtagtaacttacgttaacgtacggtcgggtcgtacggtacgtccggggacccgaccccgggtacccccggggggaagggtccggtaggttaggttagggttacggttcgacgttagttacgtaacgttggttaactaaccgggtcggaacccttaccctttagttaccgacgttaccggtcctacgtaacctaaaggccgttacggacgttacccgaacgtaacgtccggtaaccggtaccgaacgaaccggttaacggaaccgtacccgttaccgttcctttaaccggaacgtccggtacgtaaccgtaaccgtttcggtacggtaccgggtccgaaccccggtacgaaaccggttccgttaaacccggttttcgttttaccgtttaacgttccgtggtttaccggttaatacgttaagtttaccgtaagggtttaccgggaggtttacgaacgttgggtaccgtttacgaaccgttacggtaggttacgtttcggtttaagaccggttcgttacgggacttaacgggntaacggtaccgg

SEQ ID NO: 95407 - DNA, 866 bp, Homo sapiens
  misc_feature: GYAE6OF01C308C.51.36.D03.1.454.CMB.1.raw
  modified_base (245)..(245): a, c, t, g, unknown or other
  misc_feature (245)..(245): n is a, c, g, or t
  modified_base (652)..(652): a, c, t, g, unknown or other
  misc_feature (652)..(652): n is a, c, g, or t
tcagcgatcgtatacacgaccggtgctcgatttagctgcgtcacgatctctcgttggggctttctgagagtcgtggatctcatgtgacaaagaaaaatgaagcacctgttggttccttcctcctcctggtggccggcctacccagtagtcgggtcctcgtccctagttcgccacctgacgaggacgtccgggcccaaggtacttggtagaacgtccttcggacgtacctaccgtcgtacccctcnccccttgccgttcgttcgttcctccggttcgggcccggtcctaccgacttcgtaagttacgtaagtacttaacgttaccgtacggtcggggtcctcggaccgtccggaccgacccgggtcccccgggggaaggtccgttcggtatttacgggtacgtttcggactagttactacgtaggttacgtacggttaccggtacccttaccgttttacgtacgtaaggttccgacgtccgttaaccgaacggtcggtaccgtaagttacccgaaccgagtcccggaaccggtacccggaaaccgtacccggtaacgaaccggtaccgtaccgttaccctacccgtagtaccgccgttacgtaccctcgtccggtacccgaaccgtcccgacgaccgtaccgttacccggttnttttacgggtctttcccgttaggtacgttacccgtaagttacgtttaagtagggtttacggggtacgtcgtaagggttaccggttacgggttaccgtaaccccggttaacggttaccgggtttacgttttaacggtttttaacgggaacggtttttacccgggttaacggggaacccgtttaaaacggggccggttaaacccgggtaacccggg

SEQ ID NO: 95408 - DNA, 954 bp, Homo sapiens
  misc_feature: GYAE6OF01AETHQ.51.36.D03.1.454.CMB.1.raw
  modified_base (237)..(237): a, c, t, g, unknown or other
  misc_feature (237)..(237): n is a, c, g, or t
tcagcgatcgtatacacgaccggtgctcgatttagctgcgtcacggatcgtctcgttgggggcctttctgagagtcgtggatctcatgtgcaagaaaatgaagcacctgtggttcttcctcctcctggtggcggtctcccagatgggtcctgtccagttgcacctgcaggagtcgggccaggacttggtgaagtccttcggagacacgtcgtcccctcacctgtcctcgtgtctcgnggcgcctccatctaggtagtacgtatacttactacgtcgggctacggacgtccggaccgtaccgggacccccccgggggtaagggggtaccgtaccggggtaggtttacgggtaacgttacggggtaccgtaaggttaacgttaccggttaacggttttaaccggtaacccggtttaccggggttaaccccttacccgttttaccgttaaccggttaacggttcccggttacccgtacgtaaccgtaacggtaccggttaccggtaccggttaacccgtaaccgtacggtaccggtaaccccgaaccgggtaaccctaacccggtaccggaaaccggttacccgtaacggttacccgttaccccgtaaggtaaacccggtcccgttaccggtaaccccgttccgttaccgggtacccggtaaacccggtacccggtaccgaaaccggtaacccggtaccggggtttacgttttacggtttaccttttccggttaccggttaacggtacccggttaaagttaacgtttaaacggtttaacgttaccgggggttacgggttaacggtaccgtaggggtttaccgggtcccgggttaacccgttaaaccgggggtttaacggtaccgggtttttaacggtttaacgggttacgttttaaccggggtttacggggtaaacccgggtagggttaaccccgggtaaaccggttaaccccgggg

SEQ ID NO: 95409 - DNA, 765 bp, Homo sapiens
  misc_feature: GYAE6OF01DTAOF.51.36.D03.1.454.CMB.1.raw
  modified_base (717)..(717): a, c, t, g, unknown or other
  misc_feature (717)..(717): n is a, c, g, or t
  modified_base (745)..(745): a, c, t, g, unknown or other
  misc_feature (745)..(745): n is a, c, g, or t
tcagcgatcgtatacacgaccggtgctcgatttagctgcgtcacgatctctcttgggggctttctgagagtcgtggatctcatgtgacaaagaaaatgaagcaccttgtcggtttccttcctcctccgtggtggccggctcccagagtcgggtcctgtccctagttgccaccgtgcgaggagtccgggcccaggtacttgtgaacgtccgttcggaagacaccgttcgtcccctcaccttgccttcgttgtccttcgtcgggccgtcctccgtatacgagtaagtagtaattattaccgtacggtgggctggtactccggaccgaccccggaccccggggaagggtccgttaggtagtttagggtagttcggactaggttacgtcgtaagtttacgtacgtccgggtaaccttacctttcgtacgaacgttccgtacgtacgttacgaaaggcgtacgtaccgtacaccgtaacgccggaaccggacggtaaaccctaccggtaacgtaacggtaccttaaccggtttcccaacccggttaggaaccgttcgttacccgtaaccgttgtaccggtacccgaccccggtaccggacgaaggtaacccgtcgtttaccgtttttacgttacgtttccgttaggtagttacctaagtaactttaacgtagttcggtaggtaacgtacgtaggtcggtaacctccgtttaagtaccgggtntttacgtttgacgttacgggttacgganaacggtcgtaacgggtaacg

SEQ ID NO: 95410 - DNA, 967 bp, Homo sapiens
  misc_feature: GYAE6OF01DE273.51.36.D03.1.454.CMB.1.raw
  modified_base (781)..(781): a, c, t, g, unknown or other
  misc_feature (781)..(781): n is a, c, g, or t
tcagcgatcgtatacacgaccggtgctcgatttagctgcgtcacgatctctcttggggctttctgagagtcgtggatctcatgtgacaaagaaaatgaagctaccttgtggttcttcctcctctggtggcgctccagatgggtcctgtcccagttgcacctgcgaggtaggtccgggacccaggtactttggtagaacgtcccgtttacggagtacctaccgttcgtccccttcgaacccgttcgacctttccgttcggttccgttccggttacgggaccggttccttacccgtaagtaccgtaaggttaacgttaacgtaacgttttaactttaacccgttacggggtcgggggtaccgttacggggtaacccgttcccggggaaccgtaaccccccgggggtacccccccggggggtaaagggggtccgtttagggggtaacgttttcggggtaaacggtttccgggacgttaaacggtttattaaccggtttacgtttaacgttaaccgggtaacccgggttaaaccccttccgttttaccgttaacgtaaccggttccggttaccgtaccgtaaacggtaaacggttacggtaccggtaaacgttaacccgaaccgtaaacccgtttaaacccggggaccggtaaccgtaaaccggttcccggaaaacgggttcccttaaccggtttaccctacccgtaaggaacgtccgtaaccgtaccgtcgttacggtacccggaccccgtacgtaccggtaaccgaccggtttacccggtttnttttacggtttctttacggtgtccgttaacgtaagttaccttaaggtttacgttacgggtgtaacggtacgttacgggtacggttccgtaaccggtttacggtaaccgggtttagtttccgtttaaggttacgtacggggtttaccgggaacgaacgggtttcggaaaccggttacggttaacccg

SEQ ID NO: 95411 - DNA, 852 bp, Homo sapiens
  misc_feature: GYAE6OF01BBPQP.51.36.D03.1.454.CMB.1.raw
  modified_base (65)..(65): a, c, t, g, unknown or other
  misc_feature (65)..(65): n is a, c, g, or t
  modified_base (765)..(765): a, c, t, g, unknown or other
  misc_feature (765)..(765): n is a, c, g, or t
tcagcgatcgtatacacgaccggtgctcgatttagctgcgtcacgatctctcgttggggctttcngagagtcgtggatctcatgtgacaaagaaaatgaacgcctacgttgttcgtttccttccctccgtcgtggtcgggccgtcctaccgaggtgttcggttccgtcgtaccgtgttcgcctaccgtggcggtacgggtacggtccgggacccgtaaggttccgttagtacgtaaccgtccggttacggacgtaccgtccgttccgtccctcgtaccgtcgtccttcgttcgttccgtcggtaccggtccgtcctcgtacgtacgtaggtaggtacttacgttaacgttcggtacggtcggtcgtaccggtaccggtcccggaccggaccccggggtacccgggtaggtcggttggtaggtcggtagttcgacgttagtcgtacgttacgttaccgtacgtccgttaccttacgttacgtaacgtcgtaccgtaccgtactaacggaacgttccggtacgtacgtaacccgtacgtaccgggtaaccggacccgtaccggtaaccgtaacctaacccgggtaacggttaacccttccgttacccggtaacgtcggtaaccgttcccttaccgtactcggggtacccgacccggtaacccggtgtaaaccgttccgggttacccgttggtttttacctttggttaacctttcgggaacgttaacgttaccttaggtaacttacgggtgggtagtcgttaaccggngttccgggtcctaacggttacgttcggttaattcggttttaccggaagtttacggggtacggcgaaacggcttcgggaaaccttcgg

SEQ ID NO: 95412 - DNA, 672 bp, Homo sapiens
  misc_feature: GYAE6OF01AQRAV.51.36.D03.1.454.CMB.1.raw
tcagcgatcgtatacacgaccggtgctcgatttagctgcgtcacgatctctcttggggctttctgagagtcgtggatctcatgtgacaaagaaaatgaagcacctgtgttccttcctcctccgtggtggcgctcccgagagtcggtcctgtcccagttgccacctgcgaggagtccggcccaggtacttgtagaacgtccgttcggacgaccactcgtccctcaccgtgcttctcgtctcgtcggcgtctccatcgtagtagtagattattacgtacgtggctaggacgtccggacgaccggacccccgggaggtcgtaggtacgttggacgttggactagtactacgtagttacgtaccgtacggtaccctaccgttcgtacgtacgtccgtcgactacgaagtcgtacgacgtccgacacgtacgaccgcgaacgaccgtacgaacgtacctacgtcccgtaccgtagacgtcgtacgtaccgttcgtcgaccgtcccgacgtaccgacgtaccgttacggtttcttacgtttacgttcgtagtacgtacgtaagtaacttaagttacggtcggttaggtacgtacgtacggtcgttaccgtacccgttaggttaccggttagtttccgtttagtacgtttacggtacgaacgtacgcgtaacggtaccg

SEQ ID NO: 95413 - DNA, 681 bp, Homo sapiens
  misc_feature: GYAE6OF01BD05W.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtcgggcccaggacttgtagaagccttcggagaccacgtcgtccctcacctgctctgtctcgtggccgctccatcagtagtagatattactacgtgggctggacgtccggcacggcccccgggagggctggagttggtagttcggcagtactcgtagttactacgtcgggacctaccgtttcttacgaacgttccgtcgtcgtacgaaggtacgtaccggagtaccaacgacgtaccggacccgacggaaccgtaccgtaccgaacggaccctagttccctccgtaggaacgtcgtacgacccttcgtcggtaccgacccgccgactacgaccgtacggttcttttacgtcttcgtgtcgtacgtaggtaaattacgtaaggtcgggtaggtcgtaacgtaggttcgggttaccgtcccgttaacgggttaacgggttacgttaccgttttaggtaacggtttacggtttacgggggaacccgttaaacgggtccggtaacggtaaacccggg

SEQ ID NO: 95414 - DNA, 747 bp, Homo sapiens
  misc_feature: GYAE6OF01D9LX1.51.36.D03.1.454.CMB.1.raw
tcagcgatcgtatacacgaccggtgctcgatttagctgcgtcacgatctctcttggggctttctgagagtcgtggatctcatgtgacaagaaaatgaagcacctgtgttcttcctcctctggtggcgctcccagatggtcctgtcccagttgcacctgcgaggacgtccgggcccaagggtacctttggtagaacgtcccgtttacgggaacgacctaccgttcggtcccccttcgaccttgccttcttgtccttcgtcgggccggtcctaccatacgtagttaagtagtattactttactacgtgggctggtacgtccggcgaccggacccccggggaaggtcgtggtagttcggtagttcggactagtactcgtagttactacgtacggtaccctacttctacgtacgtcgtcgtctacgaagtacgtcgacgtccacctagtaccggaccggtacgaccgtaaccggtaccgaaacgtacctacggtttcccctacccgtaaggtaaccgtccgttacgtaccgttcgttacggtaccccgacccggtacccgaccgtacgtacccggttacggtttccgtttttagttaacgtttcgtacggtactaccgttaagtacctttaagtagttcgggttacggtcgtaacgtcggtacggtaccgttaaccgtacggttacgggttacgttccgttttagaacggtttacgggtaccgggaagtacgggtaccgaacggttaccgg

SEQ ID NO: 95415 - DNA, 669 bp, Homo sapiens
  misc_feature: GYAE6OF01CWKTT.51.36.D03.1.454.CMB.1.raw
  modified_base (177)..(177): a, c, t, g, unknown or other
  misc_feature (177)..(177): n is a, c, g, or t
  modified_base (251)..(251): a, c, t, g, unknown or other
  misc_feature (251)..(251): n is a, c, g, or t
  modified_base (276)..(276): a, c, t, g, unknown or other
  misc_feature (276)..(276): n is a, c, g, or t
  modified_base (349)..(349): a, c, t, g, unknown or other
  misc_feature (349)..(349): n is a, c, g, or t
  modified_base (538)..(538): a, c, t, g, unknown or other
  misc_feature (538)..(538): n is a, c, g, or t
tcagcgatcgtatacacgaccggtgctcgatttagctgcgtcacgatctctcgttgggggctttctgagagtcgtggatctcatgtgacaagaaaatgaagcacctgtggttcttcctcctctggtgcgctccagatggtctgtccagttgcacctgcaggagcggccaggtcttgngaacgccgttacggagaccactcgtcccctcgcctgtctcgtgtctcgtggcgacttccgaatcgaagtagtanattattactacggtgggctggtacnccggcgaaccggccccgggtaagggctaggattggattcggcatatacgtagtataacgtggaacctcgttanacgagtcgtacgctacgaagacgtcgaagccactagcgacggacgactacgacgaaacgtcctacggtttaccacccgtagtaaactccgttaccgaacccgtttcgttacggaccgtaaaccccgtcgaccgaacgttacctaacgggtttcttttacgttacgtttccgtaggtacccgtagttaanagtttaacgtaagtttgggtagggtacgaacttgggttcggtacgttaaccctaaagggttccggaggttttaccgtttgttaaacgggtttacgttaccggggaaccgtaaggaccgtaaggtaacccgg

SEQ ID NO: 95416 - DNA, 869 bp, Homo sapiens
  misc_feature: GYAE6OF01BL9K1.51.36.D03.1.454.CMB.1.raw
tcagcgatcgtatacacgaccggtgctcgatttagctgcgtcacgatctctcttgggggctttctgagagtcgtggatctcatgtgacaagaaaatgaagcacctgtggttcttcctcctcgtggtggcgctccagatcgggtcctgtcccagttgcacctgcaggacgtcggcccaggacttgtgaaagccgttcggagaccacgttcgtaccctctaccgtgtccttcgtgttccttacgtggccggtcctacctacgttacgtagttaagtacgtaatttaacgttacgttacggttggggtcgtagggtaaccgtcccgggaccggtaacccggggtaccccccggggggtaaaggggtccggttagggtaacggtttcgggtacgtttcgggacgttaacggttacttacggttaacggtttaacgtaccggttacgggttaaccccttaccgttttacttaccgtaaacggtccgttaccgtactacgaaggtacggtacgtaccgtaccacgtacgtaccggacccggtacggtaccgtacgtaaccgaacggtacccgttagttacccctcgtaacggacgtcgtaccgtaccgtcgtcgtaccgacccgtccgactaccggaccgttacgtttactttacggttactttcgtacgttacgtaccgttaaaggtactttaaacggttacggttacgggttacgggtaaacggtccggttaagggttccgggtttaacctaaccgggtttaaccgggtaaccgggttttacgttttaccggttttaacggtaaggttttaaccggggttaccgggtaaacccggttaacgggtcccgggttaaaacgggttaaaccccgggg

SEQ ID NO: 95417 - DNA, 815 bp, Homo sapiens
  misc_feature: GYAE6OF01B719R.51.36.D03.1.454.CMB.1.raw
  modified_base (70)..(70): a, c, t, g, unknown or other
  misc_feature (70)..(70): n is a, c, g, or t
  modified_base (409)..(409): a, c, t, g, unknown or other
  misc_feature (409)..(409): n is a, c, g, or t
tcagcgatcgtatacacgaccggtgctcgatttagctgcgtcacgatctctcgttgggggctttctgagngtcgtggatctcatgtgacaaagaaaatgaagctacctgttgttccttccctcctccgtgggtggccgtcctcccgaagagttcgggtcctcgtccctagttcgcctaccgtgacgagggtcggtcccgggaccctaaggtcttcggtaggtaacgtcccgttacggacgaccaccgttccgtccctcctacctgccttcgtcgtccgtcgtacggccgtcctccgatacgagtaacgtagtattacgtacgtacggtacgggtcgacggtccgaccggtcccggacccgggaccccggggtaagggctagggtagtttcggtagttcggacgtacgtntacgtaagtctacggtaccgtacttccttactaccgtagtccgtctacgtacgacgtcggtaccgtactaaccaccgtaggtacccggtacccggaccgtaaccgtaaccccggtaccgaacgtaacccggtaccttacccgttaccgtaacggtaactaccgtcccgtaacccgttccggtaccgttaccggaccccgtacccggtaaccgtaccgtaacccggttccgttttactttaacgttccgtttacggtcttacgtacgtaagttagttaacggtaaggtttggacggttaggttacgtagggttaccggttccggtaaccgttacggttaaggttcgtttaacgttagttacggtttacgggaacgggttacccgtaggtaccgtaaccggttacccg

SEQ ID NO: 95418 - DNA, 629 bp, Homo sapiens
  misc_feature: GYAE6OF01A3U46.51.36.D03.1.454.CMB.1.raw
  modified_base (588)..(588): a, c, t, g, unknown or other
  misc_feature (588)..(588): n is a, c, g, or t
tcagcgatcgtatacacgaccggtgctcgatttagctgcgtcacgatctctcttgggggctttctgagagtcgtggatctcatgtgcaagaaaatgaagctacctgtggttcttcctcctcctggtggcggctcccagatgggtcctgtcccagttgcacctgcgaggagtcgggcccaggacttgtgaagccgttcggagacacgtcgtccctcacctgctctgtctctggcgctccatcgagtagtagtatatactacgtgggctggactccggcgacggcccccgggaagggctaggagttggagttggacgtagtactcgtagttatacgtcgggacctacttcgtacaagtcgtacgctacgaagtacgtacgacgtcaacacgtcggaccgtcgacgtaccgtaccgacgtacctacgttccgtaccgtgacgacgtacgaccgttcgtgtaccgccgaccgtacgacgtaccgacgttagtttcgttacgtttccgtcggtcgtaccgtagtaacttaagtacgtaggtcgggtagtacgtcgggtagtccgacttacgtacggtatttcccggtttaagngtttaccgggttggaaccgtaacgggcgtacggtaaccggg

SEQ ID NO: 95419 - DNA, 746 bp, Homo sapiens
  misc_feature: GYAE6OF01DY89X.51.36.D03.1.454.CMB.1.raw
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
tcagcgatcgtatacacgaccggtgctcgatttagctgcgtcacgatctctcttgggggctttctgagagtcgtggatctcatgtgcaaagaaaatgaagcacctgttggttccttcctcctcctggtggcggctcccagatcgggtcctgtcccagttgcacctgcaggaggtccgggcccaggacttgtgaacgccttcgganacnctgtccctcacctgctctgtctcgtcggcgtcctcatacagtagagattattacgtagtcgggctggactccggacgaccggcccccggggaagggtctggtacgttggagttggactagtatactagttacgtacgtacggtacctaccttagttacgaacgttcgaccgtcgttacaaaggtacgtcggtactaccaccgtagtcggaacccggacggaaccaaccgggtaaccaaccgggtaccttaccggttacccgttacccgaggtaaacgttcccgtacgtaacccgtaggtcggtaccgtacccggacccgtacgaaccgtaccgtacggtttcccgttttagtttaaccgtttcggttacggacgttaaccgtagggtttaacttaacggttacggttgggttaggggtaaacgtaggtcgggttagggttacctacccggttaacgttacgggtcggtttaacttttagggtaacgtttacggggttacccgggaaccgtaaacgggtcccgtaaggttaaacccggg

SEQ ID NO: 95420 - DNA, 566 bp, Homo sapiens
  misc_feature: GYAE6OF02I8XBZ.51.36.D03.1.454.CMB.1.raw
  modified_base (347)..(347): a, c, t, g, unknown or other
  misc_feature (347)..(347): n is a, c, g, or t
  modified_base (388)..(388): a, c, t, g, unknown or other
  misc_feature (388)..(388): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcagccccccgggaagggctggattggattggcagtatcagttatactgggaccaccttcttcaagtcgtcgctcaagngtcgagtcacatgaccgcggacacgtccaaggaccagttcncctgaagctgacctctgtcgaccgccgcacgaccacgtctttgtactttcgtagtgtacttagacttataacgtgttagggttagacgaggttgggacgtcccgtaacgttacgggaagttctttttaggaacgttacgttttcgggggacccgtaaagggtcctaacggtaaacggg

SEQ ID NO: 95421 - DNA, 513 bp, Homo sapiens
  misc_feature: GYAE6OF02IV8BC.51.36.D03.1.454.CMB.1.raw
  modified_base (461)..(461): a, c, t, g, unknown or other
  misc_feature (461)..(461): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcagccccccgggaagggctggattggattggcagtatcagttatactgggacctaccttcttcaagtcgtcgctcaagagtcgagtcaccatgaccgcggacacgtccaaggaccagttctcctgaacgctgacctctgtcgaccgccgcagacacggtctttgtattctgtgctagatatatgtggtgacngtggtgctactacggtagtcttttgattagtttgggactaaggcagtaacgg

SEQ ID NO: 95422 - DNA, 559 bp, Homo sapiens
  misc_feature: GYAE6OF02IX6W0.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcagccccccgggaagggctggattggattggcagtatcagttatactgggaccaccttcttcaagtcgtcgctcaagagtcgagtcaccatgaccgcggacacgtcaaggaccagttcctccctgaagctgaccttctgtcgaccgccgacacgaccacggtcttttagtactttctgtgcttagattataagttggtagggtagacgtaggtggtcgcccgttaacgtacgggtagttcgtttttaggactttacggttttcggggacctaagggtcaacggtaacggg

SEQ ID NO: 95423 - DNA, 524 bp, Homo sapiens
  misc_feature: GYAE6OF02I8U9U.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggaaacactgtccctcacctgctctgtctctggcggctccatcagtagtagatattactactggggctggatccggcagccccccgggaaggggctggattggattggcagtatcagttatactgggaccaccttcttcaagtcgtcgctcaagagtcgagtcaccatgaccgcggacacgtccaaggaccagttctccctgaagctgacctctgtcgaccgccgcagacacggtctttcgtatttctgtgctagatataagtgtggtgacagtggtgcctaacgtacggatcgttttgagttatttggggcccaaggtcacggaggtcc

SEQ ID NO: 95424 - DNA, 512 bp, Homo sapiens
  misc_feature: GYAE6OF02GVIDE.51.36.D03.1.454.CMB.1.raw
  modified_base (457)..(457): a, c, t, g, unknown or other
  misc_feature (457)..(457): n is a, c, g, or t
  modified_base (477)..(477): a, c, t, g, unknown or other
  misc_feature (477)..(477): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactgggctggatccggcagccccccgggaagggctggattggattggcagtatcagttatactgggaccaccttcttcaagtcgtcgctcaagagtcgagtcaccatgaccgcggacacgtccaaggaccagttctcctgaagctgacctctgtcgaccgccgcagacacggctttgtatttctgtgctagatataatgtgggtnacagtggtgcctactacggntcttttgattagtttggggccaaggcaggtaacgg

SEQ ID NO: 95425 - DNA, 621 bp, Homo sapiens
  misc_feature: GYAE6OF02JPIMX.51.36.D03.1.454.CMB.1.raw
tcagcgatcgtatacacgaccggtgctcgatttagctgcgtcacgatcgtctcttgggggcctttctgagagtcgtggattctcatgtgcaagaaaatgaagcacctgtggttcttcctcctcctggtggcggctcccagatgggtcctgtcccagttgcacctgcaggagtcgggcccaggacttgtgaagccgttcggaggacactgtccctcgacctgctctgtctctggcgctccatcagtagtagatattactacgtgggctggactccggcacggccccccggggaaggggccgtggtagttggagttgggccagtatacgtaggttagtacgtcgggacctaccgttcttacgaacgtcgtcgtctacgaagacgtcgagtcaccagtcgaccgacggacacgtaccgaacggacctacgttcctacccgtagaacgtctacgaccttctcgtcgaccgccgacacgaccgacgtctttagtactttcgacgttgtactagtacttagttaacgtggttaggtcgtacgtagtcggtacgtaccgttacgtacggtaacgttcgttttaggacgtttaggttaccgggacctaacggtccgtaacggtaaccgg

SEQ ID NO: 95426 - DNA, 731 bp, Homo sapiens
  misc_feature: GYAE6OF02I5Z6I.51.36.D03.1.454.CMB.1.raw
tcagcgatcgtatacacgaccggtgctcgatttagctgcgtcacgatcgtctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtgggctggactccggcgacggaccccccggggaggggtcctggagttcggattggctagtatcgtaggtttactacgtacgggtaccctaccgtttcgttacgtaacggttccggtacgtccgtacgtaacggtacggttcggaacgtaccaaccgtagtacggacccggaccgggaccgtaccggtacccgtaaacgggtacccgtaacggtttccctacccgtacggaacgtaccgttcgtacccgttacgtacggtccggaacccggtcccggaccgaacggaccgtacccggttcttttaacggttcttttccgtagttacggtacttaaggttattaagtttaacgttgggttaggggttactacggtacgggttgggtaccgtccgtttaaccggtacgggtagtttaccgtttttaggtaacgtttcgggttttacggggaccgtaacgggtaccgtacggtaaccgg

SEQ ID NO: 95427 - DNA, 549 bp, Homo sapiens
  misc_feature: GYAE6OF02G8YI9.51.36.D03.1.454.CMB.1.raw
  modified_base (438)..(438): a, c, t, g, unknown or other
  misc_feature (438)..(438): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacgccccccgggaagggctggatggattggcagtatcgtagttatacgtcgggacctaccttctcgtaagtcgtcgctacaagagtcgagtcaccatcgaccgcgacacgtaccaaggaccagttcctcccgtgaacgtctagacctctggtcgaccgccgcacgacncggtctttgtatttctgtgtctagtattataagtggtggtgacgtagtgtacgtccttacgtacggtagttcttttgatttaggtttagggacctaaggcgacggtaacgg

SEQ ID NO: 95428 - DNA, 530 bp, Homo sapiens
  misc_feature: GYAE6OF02GMV2M.51.36.D03.1.454.CMB.1.raw
  modified_base (449)..(449): a, c, t, g, unknown or other
  misc_feature (449)..(449): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcacggcccccccgggaaggggctggattggattggcagtatcagttatactgggacctaccttcttcaagtcgtcgctcaagagtcgagtcaccatgaccgcggacacgtaccaaggaccagttcctccctgaacgctgacctctgtcgacccgccgcagaccacgtctttgtatttcngtgctagatataatggtggtgacagtggtagccttacgtacggagtcttttgattagttggggaccaaggtcaggtaacgg

SEQ ID NO: 95429 - DNA, 571 bp, Homo sapiens
  misc_feature: GYAE6OF02FUHQR.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcacggccccccgggaagggctggattggattggcagtatcagttatactgggacctaccttcttcaagtcgtcgctcaagagtcgagtcaccatgaccgcggacacgtccaaggaccagttcctccctgaacgctgaccctctgtcgaccgccgcacgaccacggtctttgtactttcgtgtcgcttagattaagtaagttggtgggtagacgtaggttggtcgtccttaacgtacgggtagttccgtttttaggaacttttaggtttcgggggaccctaagggtccgtaacggtaacggg

SEQ ID NO: 95430 - DNA, 536 bp, Homo sapiens
  misc_feature: GYAE6OF02IHADP.51.36.D03.1.454.CMB.1.raw
  modified_base (210)..(210): a, c, t, g, unknown or other
  misc_feature (210)..(210): n is a, c, g, or t
  modified_base (393)..(393): a, c, t, g, unknown or other
  misc_feature (393)..(393): n is a, c, g, or t
  modified_base (474)..(474): a, c, t, g, unknown or other
  misc_feature (474)..(474): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctnacctgctctgtctctggcgctccatcagtagtagatattactacgtggggctggatccggcacggccccccgggaagggctggattggattggcagtatcagttatacgtgggacctaccttcttcaagtcgtcgctcaagagtcgagtcacatgaccgcgacacgtccaaggaccagttccncccgtagaacgctcgacctcgtgtacgacccgccgacacgaccacgtctttgtatttcctgtgctagatataagtgtggtnacgagtggtcgcctagtacggtagtcttttagagttagttcgggactaaggtccaagtacgg

SEQ ID NO: 95431 - DNA, 546 bp, Homo sapiens
  misc_feature: GYAE6OF02HZCAT.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcacgccccccgggaagggctggattggattgggcagtatcagttatacgtgggaccacttcttcaagtcgtcgctcaagagtcgagtcacatgaccgcggacacgtccaaggacctacgttcctacccgtgaacgctgacctcgtgtcgaccgccgacacgacctacggtctttagttactttctgtgctagattataatggtggtagctagtcggtagcctacgtacgggagttcttttggagttaggtttcgggacctaaggcgtacgtaacgg

SEQ ID NO: 95432 - DNA, 644 bp, Homo sapiens
  misc_feature: GYAE6OF02GGFUD.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacggccccccgggaaggggctggattggattggcagtatcagttatacgtgggacctaccttcttacaagtcgtcgctacaagagtcgagtcacatcgaccgcggacacgtccaaggacctagttcctcccgtgaacgtctacgaccctcgtcggtcgacccggccgaccacggaccaccgggttcttttaggttacttttcgtcggttcgtacgttaaggtaacttaagttaattgggttaggggttacgtaaccgtagggttcgggttaccgtcccgtttaacggttaccggggtaacgtttccgtttttaaggaacttttagggttttccggggggaaccctaaacggggtccgaaccgggttaaaccggg

SEQ ID NO: 95433 - DNA, 532 bp, Homo sapiens
  misc_feature: GYAE6OF02IKMMZ.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcagccccccgggaagggctggattggattgggcagtatcagttatactgggaccaccttcttcaagtcgtcgctcaagagtcgagtcaccatgaccgcggacacgtccaaggaccagttctccctagaacgctgacctctgtcgaccgccgcagaccacggctttgtatttctgtgtctagatataagtgtgggtgacgagtggtgcctacgtacggagtcgttttgattagttttgggacctaagggtcctaacggtaacgg

SEQ ID NO: 95434 - DNA, 567 bp, Homo sapiens
  misc_feature: GYAE6OF02GE41S.51.36.D03.1.454.CMB.1.raw
  modified_base (482)..(482): a, c, t, g, unknown or other
  misc_feature (482)..(482): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacgccccccgggaaggggctggattggattggcagtatcagttatactgggacctaccttcttcaagtcgtcgctcaagagtcgagtcaccatcgaccgcggacacgtccaaggacctagttcctccctaggaacgctacgacctctcgtcgacccgccgcacgacacggtctttgtactttctgtgtctagtacttataagtggtagggtnacgtaggtggtcgtacccgttaacgtacgggtattcgtttttagacgtttaggtttcggggacctaacgggcgtaacggtaacgg

SEQ ID NO: 95435 - DNA, 522 bp, Homo sapiens
  misc_feature: GYAE6OF02HS62Z.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagccccccgggaaggggctggattggattgggcagtatcagttatactgggaccaccttcttcaagtcgtcgctcaagagtcgagtcaccatgaccgcggacacgtccaaggaccagttctccctgaacgctgacctctgtgaccgccgcacgacacggctttgtatttctagtgctagattataatgtggtgacagtggtgcctactacggagtcttttgattagtttggggcctaagggcaggtaacgg

SEQ ID NO: 95436 - DNA, 540 bp, Homo sapiens
  misc_feature: GYAE6OF02ITUU6.51.36.D03.1.454.CMB.1.raw
  modified_base (395)..(395): a, c, t, g, unknown or other
  misc_feature (395)..(395): n is a, c, g, or t
  modified_base (474)..(474): a, c, t, g, unknown or other
  misc_feature (474)..(474): n is a, c, g, or t
  modified_base (498)..(498): a, c, t, g, unknown or other
  misc_feature (498)..(498): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacggccccccgggaaggggctggattggattgggcagtatcagttatactgggacctaccttcttcaagtcgtcgctcaagagtcgagtcaccatcgaccgcggacacgtccaaggaccagttcnccctgaacgctgacctctgtcgaccgccgcacgacacggtctttgtatttctgtgtctagattattaagtggttgggtnacgagttggtgtcctacgtacggngttcgttttgattagtttcgggacctaaggtcacggtaacgg

SEQ ID NO: 95437 - DNA, 837 bp, Homo sapiens
  misc_feature: GYAE6OF02HEXFO.51.36.D03.1.454.CMB.1.raw
  modified_base (113)..(113): a, c, t, g, unknown or other
  misc_feature (113)..(113): n is a, c, g, or t
  modified_base (211)..(211): a, c, t, g, unknown or other
  misc_feature (211)..(211): n is a, c, g, or t
tcagcgatcgtatacacgaccggtgctcgatttagctgcgtcacgatctctcttgggggctttctgagagtcgtggatctcatgtgcaagaaatgaagcacctgtggttctcnctctggtggcgctccagatgggtcctgtcccagttgcacctgctaggagtcgggccaggtacttggtagaacgtccttcggagactacgtggtccctnaccgtggcttcgtggtcctcgtggcgtactccgatcgagtacgtagtactacttacgtacgtggggtcttacgggtaactccgggtcgtaaccggtccccccggggtaaagggtccgttacgggtaacgttacggggtaacttcgggtaccgtaaggttaacgttcggtaagtttacgtacggtacggggtaaccttaccgttacgttaccgaacggttccgtacgtacgtacgtaacgtacggtaccgtagtccgtaacgtacgtacgacccggtacggtaccgtaccgtaccgtaaacgggtacccgtacgtttcccgtaccgtacgggtaaccgttaccgtacggtaaacccgttcgttacggtaccggtaaccggttaccgtacggtaacgttaccggtacgggtttaccgtttaggttaaccgttttaccgtaagggttaccgtaaccggttaacggttaacgttacgtttaaaacggttccggttaacggggttaccgtaaccggtacggtttacgggtacggttaacccgtttaacggtaacggttcgttaaccgttttaggtaccggtttacgggtttacgggtacccggtaacgggttacctacccgggttaaccgg

SEQ ID NO: 95438 - DNA, 569 bp, Homo sapiens
  misc_feature: GYAE6OF02H9QJJ.51.36.D03.1.454.CMB.1.raw
  modified_base (365)..(365): a, c, t, g, unknown or other
  misc_feature (365)..(365): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtgggctggatccggcacggccccccgggaaggggctggattggattggcagtatctagttatacgtggacctaccttctcgaagtcgtcgctacaagtagtcgagtcacntagaccgcgacacgtccaagaccagtcctaccctgaacgctcgacctcgtcgtacggacccgccgacacggaccgtacgtctttagttacttttcgtgtgtactagtacttagtacgttggtgggtagacgtaggtggtcgaccgtacgtacggacgttcgttttaggagttaggttcggggaccaagggtcaacgggtaacgg

SEQ ID NO: 95439 - DNA, 582 bp, Homo sapiens
  misc_feature: GYAE6OF02ITY2M.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacgccccccgggaagggctggattggagttggcagtatcgagttatacgtcgggacctaccttcttcgaagtcgtcgctcaagagtcgagtcaccatcgaccgcggacaccgtaccgaaggaccctacgttcctccccgtaggaacgtctacgaccttcgtcggtcgacccgccgcacgaccgaccggtctttagtactttctggtcgctagattatagtgtgggtcgacgtagttggtcgtaccgttacgtacggtcgttcgttttagagtttacggtttacggggacctaagggtaccgaggtaaccggg

SEQ ID NO: 95440 - DNA, 587 bp, Homo sapiens
  misc_feature: GYAE6OF02GWIWE.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactacgtggggctggatccggcacggccccccgggaagggctggattggattggcagtatcagttatacgtgggacctaccttctcaagtcgtcgctacagagtcgatcacatcgaccgcgacacgtaccagaccagttcctccgtagaacgtctcgaccttcgtcgcgacccgccgacacgacctacggtcttttacgtactttcgtgtcgacttaggtacttagtaagttggttagggtagacgtgggttacggtcgtaccgttaacgtacgggtagttacgtttttaggacgtttacgggtttcggggaccgtaacgggtccgacggtaacggg

SEQ ID NO: 95441 - DNA, 535 bp, Homo sapiens
  misc_feature: GYAE6OF02IIMHA.51.36.D03.1.454.CMB.1.raw
  modified_base (473)..(473): a, c, t, g, unknown or other
  misc_feature (473)..(473): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcacggccccccgggaaggggctggagttggattggcagtatcagttatacgtgggacctaccttctcaagtcgtcgctcaagagtcgagtcaccatcgaccgcggacacgtccaaggaccagttcctccctagaacgctcgacctcgtgtcgaccgccgcacgacacggtctttgtactttctgtgctagatataatgtggtnacgagtggtgcctacgtacggtagtcttttgagttagtttcgggacctaaggcaggtaacgg

SEQ ID NO: 95442 - DNA, 558 bp, Homo sapiens
  misc_feature: GYAE6OF02F67RU.51.36.D03.1.454.CMB.1.raw
tcagcgatcgtatacacgaccggtgctcgatttagctgcgtcacgatcgtctcttgggggctttctgagagtcgtggatctcatgtgcaagaaaatgaagcacctgtgttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactgggctggatccggcagccccccgggaagggctggattggattggcagtatcagttatactggaccaccttctcaagtcgtcgctcaagagtcgagtcacatgaccgcgacacgtccaaggaccagtctcctgaacgctcgacctctgcgaccgcgcacgaccacggtctttcggtactttcgtgtcgtactagtattaattaatggtagggtagacgtaggtggtcgtaccgttaacgtaacgggtagttccgtttttaggagtttacggtttacggggacctaacgggtacacggtaacggg

SEQ ID NO: 95443 - DNA, 624 bp, Homo sapiens
  misc_feature: GYAE6OF02JJB4C.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtgggctggagtccggcacggccccccgggaagggctggacttggattggcagtatcagttatacgtcgggacctaccgtttctcctaagtcgtcgctacgaagacgttcgagtacaccaatcgaccgacggaccaccgtaccgaagggaccctagttcctcccgtaggaacgccgtacgacccgtacgtacggtccgtaacccggccgtaccgaacgacccgtaccggttacgtttacggttactttccgtgttcgtacgtagtatataaggtcgtaggtgacgtaggttcggtacgtccgttaaccgtacgggtacttagttttcgacgtttaggtttacgggaccgtaacggtcgaacggttaacgg

SEQ ID NO: 95444 - DNA, 533 bp, Homo sapiens
  misc_feature: GYAE6OF02H84TN.51.36.D03.1.454.CMB.1.raw
  modified_base (449)..(449): a, c, t, g, unknown or other
  misc_feature (449)..(449): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctcatcagtagtagatattactactggggctggatccggcacggccccccgggaaggggctggattggattggcagtatcagttatactgggaccaccttcttcaagtcgtcgctacaagagtcgagtcaccatcgaccgcggacacgtccaaggaccagttcctccctgaacgctgacctctgtcgacccgccgcagacacggtctttgtatttctgtnctagattataagtgtggtgactagtggtcgcctacgtacggagttcttttagattagtttggggacctaaggtccaggtaacgg

SEQ ID NO: 95445 - DNA, 555 bp, Homo sapiens
  misc_feature: GYAE6OF02JPLNN.51.36.D03.1.454.CMB.1.raw
  modified_base (228)..(228): a, c, t, g, unknown or other
  misc_feature (228)..(228): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctcgtcccagttgcacctgcgaggaggtccgggcccgacggacttgtgaagccgttcggagacactcgtccctcacctgctctnctctggcggctccatcagtagtagatattactactgggctgggatccggccgaggccccccggggaaggggccgtgggagttgggattggcgagtatcagttatactggacctaccttcttcaagtcgtcgctcaagagtacgagtcaccactgaccgcggacgacgtaccgaacgaccacgttacgtaccctcgaacgactcgacctctcgtcgaccgccgcgacgacacggtcttgtattctgtgtctagatataatagtggtgacgaggtggtgacgtacgtacggtagtacgtttgtagttagtttagggtacgtaaggtacg

SEQ ID NO: 95446 - DNA, 820 bp, Homo sapiens
  misc_feature: GYAE6OF02I4UWB.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggccggctccatcagtagtagatattactactggggctggactccggcacgccccccgggaaggggcctggagttgggattgggactaggtatcgtaagtttactacgtacggggtaccctacctttcgttacgaacgttccgtcgtcctacgaaacggtacgttaccggtacgttacgaaccctaagttcggaacccggccgggtaacctaccgggttacccgaaacgggtacccgtacggtttacctaccccgtaggaaaccgtccgtacggtaacccttcgttcggtaccggtaccccggtacccggtaccgaacggtaccgtaaccgggttccgtttttacggttaacgttttccggttaggttaccggtaccgttaagggttaactttaaacggtttaacgttacggggttttacggggttacgggttaaccggttacgggttacgggtttacccgggtacccgtttaaacccgggtttaacgggggtaaccgtttaccggttttttaagggtaaccggttttaacggggttttttaccggggggaaccccgtaaacgggggtacccgtaaccggggtttaaacccgggg

SEQ ID NO: 95447 - DNA, 518 bp, Homo sapiens
  misc_feature: GYAE6OF02F9FIA.51.36.D03.1.454.CMB.1.raw
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
tcagcgatcgtatacacgaccggtgctcgatttagctgcgtcacgagtcgtctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcagccccccgggaagggctggattggacttggcagtatctagttatacgtgggacctacttcgtcaagtcgtcgctcaagtgtcgagtcacatgacgcgacacgtcaagccagtctcctgaagctgacctctgtgaccgcgcagacacggctttgatttcngtnctagatataatgtgggtnactgtggtcgtccgtacgtacgggattcgtttgagttcgtttggggcctaagggccaggtaacgg

SEQ ID NO: 95448 - DNA, 746 bp, Homo sapiens
  misc_feature: GYAE6OF02J3NVB.51.36.D03.1.454.CMB.1.raw
tcagcgatcgtatacacgaccggtgctcgatttagctgcgtcacgatctctcttggggctttctgagagtcgtggatctcatgtgcaagaaatgaagcacctgtgttcttcctcctctggtggcgctccagatggtcctgtcccagttgcacctgcaggagtccgggcccaggtacttgtgaacgtccgttcggagaccacgtcgtccctcacctgctctgtctcgtggcgctccatcagtagtagatattactacgtgggctggacgtccggcgaccggcccccggggaagggcctgggtacttggtagttcggactagtaactcgtaagtttacgtacgtacgggaacccttaccgtttacgttacaacggttccgtacgaccgttacgaaacggtacgttacggacgttacccgaaccgtacgttaccggaaccccggaccggtaacccgtaaccggttacccgaaaccgggtaacccgtaccgttacccgtaccccgttacggtaacgtaccgtccgtacccgtaccgttaccgtaccggacccggcccgaccgtaaccgtaccgtaccggttaccgttttacgttacgtttcgttacggttacgttaccgtaagttaagttaagttaacgttcggttaggttacgtacgtaggttcggtacggtacccgttaggtaccggttacgtttcgtttagtacggttacggttagggtacccccgtaggtaccgtacggtaaccgg

SEQ ID NO: 95449 - DNA, 543 bp, Homo sapiens
  misc_feature: GYAE6OF02GDLZD.51.36.D03.1.454.CMB.1.raw
  modified_base (399)..(399): a, c, t, g, unknown or other
  misc_feature (399)..(399): n is a, c, g, or t
  modified_base (459)..(459): a, c, t, g, unknown or other
  misc_feature (459)..(459): n is a, c, g, or t
  modified_base (484)..(484): a, c, t, g, unknown or other
  misc_feature (484)..(484): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggactccggcacggccccccggggaaggggctggattggagttggcagtatcagttatacgtgggacctaccttctacaagtcgtcgctacaagagtcgagtcacatcgaccgcggacacgtacaaggacctagttcnccctagaacgctacgacctcgtcgtcgaccgccgcgacgacgacggtctttgtactttcngttcgctagattagtaatggtggtnacgtgtggtcgcctagtacggtattcgtttagattagttcgggacaggtcgagtaacgg

SEQ ID NO: 95450 - DNA, 625 bp, Homo sapiens
  misc_feature: GYAE6OF02IBKOP.51.36.D03.1.454.CMB.1.raw
tcagcgatcgtatacacgaccggtgctcgatttagctgcgtcacgatctctcttgggggctttctgagagtcgtggatctcatgtgcaagaaatgaagcacctgtgttctcctcctctggtgcgctcccagatggtcctgtcccagttgcacctgcaggagtccgggcccaggacttgtgaagccttcggagacactgtccctcacctgctctgtctcgtggcgctaccatcagtagtagatattactacgtgggctggactccggcacggccccccgggaagggcctggacttggattggcagtatcagttatacgtggacctacttctacaagtcgtcgtctacaagagtcgagtcacagtcgaccgcggtacgacgtccgaacggacctagttcctacccgttagaacgtctacgtaccttcgtggtacgacccgtccgacaagacccgtacgttcgtttgttacttttcgtggtacgacttaaggtaacttaagttaagtagggtcggtacgtacggtaggttcggttacgacccgttaacgttacgggtaagtttaccgttttagggtactttaacgggttttccggggaaccctaagggtcccgtaacggtaacccggg

SEQ ID NO: 95451 - DNA, 580 bp, Homo sapiens
  misc_feature: GYAE6OF02GLZVQ.51.36.D03.1.454.CMB.1.raw
  modified_base (462)..(462): a, c, t, g, unknown or other
  misc_feature (462)..(462): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacggccccccggggaaggggctggagttggattggcagtatcagttatacgtgggacctaccttcttcaagtcgtcgctcaagagtcgagtcacatcgaccgcggacacgtaccgaaggacctagttcctcccgtagaacgcctgaccctcgtgtacgaccgccgacacgaccacggtcttttgtatttcgngtgcttagattataagtggtagggtgactaggttggtcgtccgttaacggttacggtacgttcgtttttaggagtttacggtttacggggaccctaagggtaccgaacgggtaaccgg

SEQ ID NO: 95452 - DNA, 565 bp, Homo sapiens
  misc_feature: GYAE6OF02GFUS3.51.36.D03.1.454.CMB.1.raw
  modified_base (491)..(491): a, c, t, g, unknown or other
  misc_feature (491)..(491): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggatccggcacggccccccgggaaggggctggattggattggcagtatcagttatactgggacctaccttcttcaagtcgtcgctacaagagtcgagtcaccatcgaccgcggacacgtccaaggaccagttcctacccgtgaacgtctcgtacccttcgtcgtcgacccgccgccacgaccacggtcttttgttatttcgtgttgctagtattaataagtggtgggtnacgtgtggtcgtccgtaacgtacgggagttcttttaggagttaggtttcggggaccaagggacgtaggtaacgg

SEQ ID NO: 95453 - DNA, 552 bp, Homo sapiens
  misc_feature: GYAE6OF02GAMUU.51.36.D03.1.454.CMB.1.raw
  modified_base (352)..(352): a, c, t, g, unknown or other
  misc_feature (352)..(352): n is a, c, g, or t
  modified_base (480)..(480): a, c, t, g, unknown or other
  misc_feature (480)..(480): n is a, c, g, or t
  modified_base (509)..(509): a, c, t, g, unknown or other
  misc_feature (509)..(509): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacggccccccggggaagggctggattggattggcagtatcagttatactgggaccacctttcttcaagtcgtcgctacaagngtcgagtcaccatgaccgcggacacgtccaacggcctacgttcctccctgaacgctacgacctctcgtcgaccgccgcagaccacggtctttgtactttcgtgtcgctagtattataagtggtgggtnacgtaggttggtagtcctaacgtacgggngttcgttttgagttagtttcggggaccagggtccaggtaacgg

SEQ ID NO: 95454 - DNA, 575 bp, Homo sapiens
  misc_feature: GYAE6OF02I6132.51.36.D03.1.454.CMB.1.raw
  modified_base (403)..(403): a, c, t, g, unknown or other
  misc_feature (403)..(403): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacggccccccgggaggggctggattggattggctagtatcgagttatacgtcgggacctacttcttacaagtcgtcgctacaagacgtcgagtcacatcgaccgcggacacgtcaagccagttcctcctaganctgacctgtcgtcgaccgcgcacgacacggtctttgtacttcgtgtgctagattattaacgtggtaggtacgtacgtaggtcggtacgtccgttaaccgtacgggtagttacgtttttaggacgtttacggttttaccgggggaccctaagggtccgtaacgggtaaccggg

SEQ ID NO: 95455 - DNA, 550 bp, Homo sapiens
  misc_feature: GYAE6OF02JDNA8.51.36.D03.1.454.CMB.1.raw
  modified_base (199)..(199): a, c, t, g, unknown or other
  misc_feature (199)..(199): n is a, c, g, or t
  modified_base (470)..(470): a, c, t, g, unknown or other
  misc_feature (470)..(470): n is a, c, g, or t
  modified_base (486)..(486): a, c, t, g, unknown or other
  misc_feature (486)..(486): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagcccttcgganacactgtccctcacctgctctgtctctggcgctccatcagtagtagatattactactggggctggatccggcacgccccccgggaagggctggattggattggcagtatcagttatactgggacctaccttcttcaagtcgtcgctcagagtcgagtcaccatgacccgcggacaccgtccaaggaccagttacctcccctagaacgctgtaccctcttcgtcgacccgtccgccaggaccacggtctttgtatttctgttcgcttaaggntaatatcgtggtgacnggtaggtcgctacgtacggacgttagttttgattagtttcgggacctaaggcctacggtaacgg

SEQ ID NO: 95456 - DNA, 525 bp, Homo sapiens
  misc_feature: GYAE6OF02GP9LF.51.36.D03.1.454.CMB.1.raw
  modified_base (427)..(427): a, c, t, g, unknown or other
  misc_feature (427)..(427): n is a, c, g, or t
  modified_base (464)..(464): a, c, t, g, unknown or other
  misc_feature (464)..(464): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcacggccccccgggagggctggatggattggcagtatcagttatactgggaccaccttcttcaagtcgtcgctcaagagtcgagtcacatcgaccgcgacacgcaacggaccacgttctcctagaagctacgacctcgtgtcgaccgccgcacgacncggtctttgtacttctgtgactagtatatatgtggtnagtgtggtcgcctagtacggtagtcgttttagattggttcgggcctaaggtcgagtaacgg

SEQ ID NO: 95457 - DNA, 587 bp, Homo sapiens
  misc_feature: GYAE6OF02GX56R.51.36.D03.1.454.CMB.1.raw
  modified_base (351)..(351): a, c, t, g, unknown or other
  misc_feature (351)..(351): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggatccggcacggccccccgggaagggctggattggattggcagtactctagttatacgtgggacctaccttctacaagtcgtcgctanaagtgtacgagtcacatcgaccgcggacaccgtacgaacggacctacgttctacccgtagaacgtctcgtacctgtcgtcgaccgtccgacacgcgtacgtctttgtactttctgtgtctaagtacttaattaacgtggtagggtgtacgtggttggttcgaccttaacggtacggtacgttcgtttttagacgtttacggtttcggggaccctaagggtccgtaacggtaacggg

SEQ ID NO: 95458 - DNA, 612 bp, Homo sapiens
  misc_feature: GYAE6OF02IRJZK.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggacttgtgaagccttcggagacactgtccctcacctgctctgtctcgtggcgctcatcagtagtagatattactacgtgggctggactccggcaccggcccccgggaagggtctggagttggattggcagtactcgtagttatacgtggacctaccttctacaacgtcgtcgctacaagtgtcgacgtcacgatcgaccgacgacgaccgtcgaacgtacctagttcctaccgtagacgtctacgacctcgtagtcgaccgccgacacgaccgtacgtctttagttactttcgtagtcgtacgttaaggtaattaagtaacgttggtacgggtactacggtaggtcggttccgtaccttaacggtacggtagtttacgttttaggtaacgtttacgggtttacgggaccgtaacgggtccgtaacggtaacgg

SEQ ID NO: 95459 - DNA, 538 bp, Homo sapiens
  misc_feature: GYAE6OF02HF98Y.51.36.D03.1.454.CMB.1.raw
  modified_base (425)..(425): a, c, t, g, unknown or other
  misc_feature (425)..(425): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcacgccccccgggaagggctggattggattggcagtatcagttatactgggaccaccttcttcaagtcgtcgctcaagagtcgagtcacatgaccgcggacacgtccaaggaccagttctccctgaacgctgacctctgtcgaccgccgcagacncgtctttgtatttcgtgtcgctagattatagtggtgggtgactaggtggtcgtccgtacgtacggtagttcgttttagatttagtttcggggacctaagggtccaggtaacgg

SEQ ID NO: 95460 - DNA, 548 bp, Homo sapiens
  misc_feature: GYAE6OF02GVNHX.51.36.D03.1.454.CMB.1.raw
  modified_base (351)..(351): a, c, t, g, unknown or other
  misc_feature (351)..(351): n is a, c, g, or t
  modified_base (476)..(476): a, c, t, g, unknown or other
  misc_feature (476)..(476): n is a, c, g, or t
  modified_base (502)..(502): a, c, t, g, unknown or other
  misc_feature (502)..(502): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacgccccccgggaagggctggattggattggcagtatcagttatacgtcgggacctaccttctacaagtcgtcgatcaagngtcgagtcacatcgaccgcggacacgtaccaacggacctagttcctccctagaacgctcgaccttctcgtcgaccgccgacacgacacgtctttgtatttctgtgctagattataagtgtaggtnacgtagtggtcgtcctacgttacggnttacgttttgatttacggttcggggactaaggccgtaaggtaacgg

SEQ ID NO: 95461 - DNA, 680 bp, Homo sapiens
  misc_feature: GYAE6OF02JIHVY.51.36.D03.1.454.CMB.1.raw
  modified_base (200)..(200): a, c, t, g, unknown or other
  misc_feature (200)..(200): n is a, c, g, or t
tcagcgatcgtatacacgaccggtgctcgatttagctgcgtcacgatctctcttgggggcttttgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacnctgtccctcacctgctctgtctctggcggctccatcagtagtagatattactacgtggggctggactccggacacggccccccgggaagggcgtggacttgggattggactagtactcgagttatacgtcgggacctaccttcgtactaagtccgtccgtactcgaaagtacgtacgacgtcaacctatcggaccgtacggacgacgtacccgaacgacccgtaagttccctaccgtaggaacgtccgtacggtaacccttgtacggtccgacccgtccgccgacgaccgtacggtctttacggttatttccgtggtacgtaccgttaagtaacttaagttaagttcgggttaggtacgtaccgtagggttcggttacgtacccgttaacggtaacgggtacgtttaccgttttaggtaatttaacgggttttacccggggaccgttaaaggggtccgtaaacggtaccgggttaacccg

SEQ ID NO: 95462 - DNA, 519 bp, Homo sapiens
  misc_feature: GYAE6OF02GYQPR.51.36.D03.1.454.CMB.1.raw
  modified_base (460)..(460): a, c, t, g, unknown or other
  misc_feature (460)..(460): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcagccccccgggagggctggattggattggcagtatcagttatactgggaccaccttcttcaagtcgtcgctcaagagtcgagtcacatgaccgcggacacgtccaaggccagttcctccctgaacgctgacctctgtcgaccgccgcagacacgggcttttgtatttctgtgctagatataatgtggtnacagtggtgcctacgtacggagtcttttgattagtttggggcctaaggtcacggtacgg

SEQ ID NO: 95463 - DNA, 582 bp, Homo sapiens
  misc_feature: GYAE6OF02HEW3G.51.36.D03.1.454.CMB.1.raw
  modified_base (479)..(479): a, c, t, g, unknown or other
  misc_feature (479)..(479): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggccggctccatcagtagtagatattactacgtggggctggatccggcacgccccccgggaagggctggattggattggcagtatcgtagttactacgtgggacctaccttcttacaagtcgtcgctacaagagtcgagtcacatcgaccgcggacacgtccaaggaccagttctccctgaagctgacctctgtcgacccgcgcacgaccacgtctttgtatttctgtcgctaagattataaagtggttagggngtacgaggttggtcgtacccgttacgtaacgggagtttccgtttttaggaacgttttacgggttttacggggacccgtaaagggtacctaacgggtaaccggg

SEQ ID NO: 95464 - DNA, 589 bp, Homo sapiens
  misc_feature: GYAE6OF02G98ML.51.36.D03.1.454.CMB.1.raw
  modified_base (210)..(210): a, c, t, g, unknown or other
  misc_feature (210)..(210): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctnacctgctctgtctctggcgctccatcagtagtagatattactactggggctggatccggcacggccccccgggaagggctggattggattggcagtatcagttatacgtcgggacctaccttcttacaagtcgtcgctcaagagtcgagtcaccatcgaccgcggacacgtccaaggacctagttcctcccgtagaacgtctagacctcgtgtcgaccgccgcacgactacggtctttgtactttctgtgtactagtattattaagtggtagggtgaccgtaggttcggtacggtcccgttaacgttaccgggtagttccgtttttaggaacgttttacgggtttcgggggaccctaaggggtcctaacgggtaacggg

SEQ ID NO: 95465 - DNA, 634 bp, Homo sapiens
  misc_feature: GYAE6OF02HLMYJ.51.36.D03.1.454.CMB.1.raw
  modified_base (365)..(365): a, c, t, g, unknown or other
  misc_feature (365)..(365): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtgggctggactccggcgacggcccccccggggaaggggctggtattggattggcagtatacgtagttatacgtgggaccctacctttcttacaacgtcgtcgctacaagngtcgagtcacagtcgaccgcggacacgtaccgaaggacctacgttcctcccgtagaacgctacgaccttctgtcgaccgccgacacgacctacggtcttttagtactttcgtaggtcgactacgtattaacttaagttaggtcgggttagaccgtagggtttacgggttacgttaccgttaaccggttaccggggtagtttccgtttttaaggtaccgtttacggttttacgggggacccgtaaacgggtcgtaaccgggttaaccggg

SEQ ID NO: 95466 - DNA, 537 bp, Homo sapiens
  misc_feature: GYAE6OF02GOSWZ.51.36.D03.1.454.CMB.1.raw
  modified_base (210)..(210): a, c, t, g, unknown or other
  misc_feature (210)..(210): n is a, c, g, or t
  modified_base (468)..(468): a, c, t, g, unknown or other
  misc_feature (468)..(468): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctnacctgctctgtctctggcgctccatcagtagtagatattactactggggctggatccggcacgccccccgggaagggctggattggattggcagtatcagttatactgggacctaccgttctcaagtcgtcgctcaagagtcgagtcacatcgacgcggacacgtaccaaggaccagttcctcctgaacgctgacctctgtcgaccgcacagacacggtctttagtattcgtgtcgctagattaataagtgtagggtnagtagtggtcgcctacgttacggagttcttttagattacggtttgggaccgtaaggtcgaaggtaacgg

SEQ ID NO: 95467 - DNA, 557 bp, Homo sapiens
  misc_feature: GYAE6OF02F8R0M.51.36.D03.1.454.CMB.1.raw
  modified_base (442)..(442): a, c, t, g, unknown or other
  misc_feature (442)..(442): n is a, c, g, or t
  modified_base (462)..(462): a, c, t, g, unknown or other
  misc_feature (462)..(462): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacgccccccgggaagggctggagttggattggcagtatcgagttatactcgggacctaccttctacaagtccgtcgtctcgaagagtacgagtcacagtcgaccgcggacacgtaccaaggaccagttcctacctagaacgtctacgacctcgtgtcgacccgcgcagaccncgtctttgtacttctgtcgntagattatagtggtggtgacgtgtggtcgtactacgtacgggtgttacttttaggagtttacggtttgggacctaagggtccgtaaggtaaccgg

SEQ ID NO: 95468 - DNA, 528 bp, Homo sapiens
  misc_feature: GYAE6OF02HNN5L.51.36.D03.1.454.CMB.1.raw
  modified_base (462)..(462): a, c, t, g, unknown or other
  misc_feature (462)..(462): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcacgcccccgggaagggctggattggattggcagtatcagttatactgggaccaccttcttcaacgtcgtcgctcaagagtcgagtcacatcgaccgcggacacgtccaaggaccagttctcctagaacgctgacctctgtcgaccgccgcagacacggtctttgtattctgtgctagattataatgtggtnactgtgtcgcctaacgtcggattcgttttagacgttacgtttgggacctaaggtccaaggtaacgg

SEQ ID NO: 95469 - DNA, 632 bp, Homo sapiens
  misc_feature: GYAE6OF02G5MH9.51.36.D03.1.454.CMB.1.raw
  modified_base (545)..(545): a, c, t, g, unknown or other
  misc_feature (545)..(545): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagattattactacgtggggctggactccggcaccggccccccggggaagggcgtggagttggattgggcagtatctagttatacgtgggtaccctaccttcttacaacggttccgtcgtcctacgaagtcgtacgtacgtacacctagtccgaccgaccgaccgtaccgtaccgaacggacctacggttcctacccgtagaacgtccgtacgaccttcgtacggtccgacccggccgacacgacgtaccggttcttttagttactttcgtaggtgtactagtattaagttagttggttgggtntacggtggtggtcgtaccgttacgttacggtagttcgttttagtactttacgggttacgggaccgtaacgggtacgtaacggtacgg

SEQ ID NO: 95470 - DNA, 570 bp, Homo sapiens
  misc_feature: GYAE6OF02G2XN3.51.36.D03.1.454.CMB.1.raw
  modified_base (352)..(352): a, c, t, g, unknown or other
  misc_feature (352)..(352): n is a, c, g, or t
  modified_base (411)..(411): a, c, t, g, unknown or other
  misc_feature (411)..(411): n is a, c, g, or t
  modified_base (423)..(423): a, c, t, g, unknown or other
  misc_feature (423)..(423): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacggccccccgggaaggggctgggattggattggcagtatcagttatactgggacctaccttcttcaagtcgtcgctcaagngtcgagtcaccatcgaccgcgacacgtaccaaggaccagttcctcctgacgctgacctntgtcgaccgccncgagaccgacggtcttttgttactttcgtgttcgcgtagtattaagttaagttggtgggttacgacgtagggttggtcgtcccgttacgtacgggtagttcgttttagagtttaggtttcggggaccctaagggtcctaaggtacgg

SEQ ID NO: 95471 - DNA, 600 bp, Homo sapiens
  misc_feature: GYAE6OF02IDJ0E.51.36.D03.1.454.CMB.1.raw
  modified_base (294)..(294): a, c, t, g, unknown or other
  misc_feature (294)..(294): n is a, c, g, or t
  modified_base (407)..(407): a, c, t, g, unknown or other
  misc_feature (407)..(407): n is a, c, g, or t
  modified_base (511)..(511): a, c, t, g, unknown or other
  misc_feature (511)..(511): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtgggctggatccggcacggccccccgggaagggctaggnttggagttggcagtatcagttatacgtgggacctaccttctcaagtccgtcgctcgaagcgtcgagtcacctatacgaccggcggactaccgtaccaacggacctagtttccnccctagacgctacgacctcgtcgtcgacccgtccgacacgacctacgggtcttttagttatttcgtggttgtaccgttagtattaagtaagttcggtagggtanacgtaggttcgggtctaccgttaccgtagggtacgttcgttttagacgtttaggtttcgggggaaccacggtaccgtacggtaaaccgg

SEQ ID NO: 95472 - DNA, 558 bp, Homo sapiens
  misc_feature: GYAE6OF02F2EYN.51.36.D03.1.454.CMB.1.raw
tcagcgatcgtatacacgaccggtgctcgatttagctgcgtcacgatctctcttgggggctttctgagagtcgtggatctcatgtgcaagaaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtgggctggatccggcacggccccccggggaaggggctggagttggattggacagtatcgtagttatacgtcggacctaccttcttcaagtcgtcgctacaagagtcgagtcacatcgaccgcggacacgtaccaaggaccagtctccgtagaacgctacgacctcgtcgtacgaccgccgcacgacctacggtctttagtactttcgtgtgactagattagtatggtggtgacgtgtgtcgtctacgtacggtagttctttagacttacggtttacgggaccgtaaggtccgaaggtaacgg

SEQ ID NO: 95473 - DNA, 854 bp, Homo sapiens
  misc_feature: GYAE6OF02HK5K3.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtgggctggtactccggcgacggccccccggggaagggctgggagttggtattggacgtaggttatcgtagtttataccgtacgggaccttacctttcgttacgaacggttccgtaccgtacctacgaaacggtacggttccgtaacgttaccgacctaacgtacggtaacccgccgggaaccgtaccggtaacccgaaacgggtaacccgtacggtttaccctacccggttacggaaacgtccgttacggtaacccttcggttacgggttaccggtaacccggtcccggtaccgtaaacgggtaacccggtaacggggttttcctttttaaccggttaacgtttttccggttacgggttaccgttaccgttaaaggttaacgtttaaacgtttaaacggtttcgggtttaacggggttaccggtaaccggttacgggtttaaggggttacccggttaaccccggtttaaccgggtttaaaccgggggtttaaccggtttaaccggttttttttaaggaaccgggttttttaacggtttttaccgggggggaacccgttaaaacccgggggttaccgtaacccggggtttaaacccgggg

SEQ ID NO: 95474 - DNA, 618 bp, Homo sapiens
  misc_feature: GYAE6OF02G79MX.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggatccggcacggcccccccggggaaggggctggagttggattggctagtatcgagttatacgtcggacctaccgttcttacaagtcgtcgctcaagagtcgagtcacatcgaccgcgacacgtaccaaggaccctagttcctaccgtagaacgtctcgtacctctcggtcgacccgccgcacgaccacgggtcctttgttaactttcgtgttgtaccttaagtaattaagttaagtggttagggtacgacgttagggttggtacgtcccgttaacgtaccggggttagttaccgttttttaggaacgttttacgggtttcggggaacccgtaagggtccgtaacggttaaccggg

SEQ ID NO: 95475 - DNA, 623 bp, Homo sapiens
  misc_feature: GYAE6OF02F4HD8.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtgttcttcctcctcctggtggcggctcccagatgggtcctgtcccagttgcacctgcaggagtccgggcccaggacttgtgaagtccttcggagacactcgtccctcacctgctctgtctcgtggcgctccatcagtagtagatattactacgtgggctggactccggcgaccggccccccggggaagggctggtagttggagttggactagtatacgtagttatacgtcggacctaccttctacgtacgtcgtcgactacgaagacgtcgagtacacatcgaccgcggactaccgtaccgaacggacctacgttccctccgtagtaacgcctacgtacctcgtcgtcgacccgtccgacacgacctacggttctttagttactttcgtgtcgtacgttagtacttagtacgttggtggtagtacgtaggttcggtaccgtaccgttaacgtacgggtatttacgttttagtacgtttagggtttccgggaaccgtaagggtaccgtaacggtaacgg

SEQ ID NO: 95476 - DNA, 616 bp, Homo sapiens
  misc_feature: GYAE6OF02I3UU5.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggatccggcacggccccccgggaaggggctggagttggattggcagtatcagttatacgtgggacctaccttcttacgaagtcgtcgctacgaagcgtcgagtcacctatcgaccgcggacacgtaccaacggaccacgtttcctacccgtagaacgtcgtcgacccttcgtcggtccgaccgcccgacgacggaccgtaccggttcttttacgttacgtttcgtacgtcgtacgtaagtattaagttaagttggtgggtagtaaccgtggttacggtcgtaccgttaccgtacgggtacgtttcgttttagtagttacggtttcggggacccaagggtaccgtacggtaacgg

SEQ ID NO: 95477 - DNA, 641 bp, Homo sapiens
  misc_feature: GYAE6OF02JFW30.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacgccccccgggaaggggctggattggattggcaggtatcagttatactgggacctaccttcttcaagtccgtcgctacaagagtcgagtcaccatcgaccgcgacacgtccgaaggacctagttcctcctagaacgctcgaccttcgtgtcgaccgccgcacggaccgacggtcttttggtacttttcgtgtcgtaccgttagtacgttaattaaagttcgggttaggggtagtaacccgtagggtttcgggtacggtaccccgtttaacggttaaccggggtacgtttaccgtttttttaggaacgtttttacgggtttttaccgggggaaccctaaacgggggtcccgtaaaccgggttaaaccgggg

SEQ ID NO: 95478 - DNA, 664 bp, Homo sapiens
  misc_feature: GYAE6OF02ICW0D.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtcgggcccaggacgttgtgaagcctttcggagacactgtccctcacctgctctgtctctggcgctccatcagtagtagatattactacgtgggctggactccggcacggccccccgggaagggctggattggattggcagtatcgagttagtacgtcgggacctaccttctacgaagttccgtcgctacgaagcgtcgagtcaccgatacgaccggcggaccacgtaccgaacggtacctagtttccctaccgtagaacgtctacggacccttcgtacggtacgacccggtccgaccgtaacggacccgtacgggttcttttacgttacgtttttccgtggttcgacgttaagtactttaagttaagttgggttgggtacgtacgtagggttcgggttacgtacccgttaacggtaaccgggttcgtttaccgtttttaggtacgtttacgggtttacgggggaaccctaagggtacccgtaacgggtaaccggg

SEQ ID NO: 95479 - DNA, 725 bp, Homo sapiens
  misc_feature: GYAE6OF02GXCM2.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcacggccccccggggaagggctggattggattggcagtatcagttatacgtgggacctaccttcttacgaacgtcgtcgtactacaaggtacgtcgagtcaccagtcgaccgacggacaccgtaccgaacggacctacgtttcctacccgttaggaaacgtccgtacgtaacccttccgttacggtaccgtaacccgggtcccgaccgaacgaacccgtaccgggttctttttacggttaacttttcgtacggttcgtaccttaaggtaactttaacgtttaaacgttgggtttcgggggtacgtaaccgttagggttcgggttaccggtaccccgtttaaaccgggttaaccggggttaacgtttaccggtttttttaggaacggtttttaacggggttttaccggggggtaaccccgtaaaggggtacccggtaaacgggttaaacccggggg

SEQ ID NO: 95480 - DNA, 646 bp, Homo sapiens
  misc_feature: GYAE6OF02GYINY.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactcgtccctcacctgctctgtctctggcgctccatcagtagtagatattactacgtggggtctggactccggcacggccccccggggaagggctggagttggagttggcgagtactactagttatacgtcgggacctaccttcttacgacgtcgtcgtctacaagagtacgagtccactagtcgaccgacggacaccgtaccgaacggcctagttccctaccctagacgtctacgtaccttcgtcgtcgaccgcccgcgacgaccgacggttctttcgttacgtttcgtcggttacgtacgttagtaagtttaagttaagtcggttgggtacgtaacgtaggttcggtccgtaacccgttaccggtaacgggttacgtttacggtttttacggtagtttacggtttaccgggggaccctaagggtccgtaacgggttaacccggg

SEQ ID NO: 95481 - DNA, 538 bp, Homo sapiens
  misc_feature: GYAE6OF02GK3MM.51.36.D03.1.454.CMB.1.raw
  modified_base (483)..(483): a, c, t, g, unknown or other
  misc_feature (483)..(483): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcacgccccccgggaagggctggattggattggcagtatcagttatacgtgggacctaccttcttcaagtcgtcgctcaagagtcgagtcaccatgaccgcggacaccgtaccaacggaccacgttcctccccgtgaacgtctgaccctcgtcgtcgaccgccgcgaagccgacggtctttgtatttctgtgcttagattatatggtggtcganggtggtcgcctacgtacggtattcgtttgattagttggacctaggcaggtaacgg

SEQ ID NO: 95482 - DNA, 561 bp, Homo sapiens
  misc_feature: GYAE6OF02HX504.51.36.D03.1.454.CMB.1.raw
  modified_base (492)..(492): a, c, t, g, unknown or other
  misc_feature (492)..(492): n is a, c, g, or t
tcagcgatcgtatacacgaccggtgctcgatttagctgcgtcacgatctctcttgggggctttctgagagtcgtggatctcatgtgcaagaaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggactccggcacggccccccgggaggggctggattggattgggcagtatcagtttatacgtgggacctaccttcttcaacgtcgtcgctacgaagagtcgagtcaccatcgaccgcggacacgtaccgaaggaccagttcctcctagaacgctagaccctctcgtacgaccgccgacacgacctacggtctttagtatttcgtgttgactagattataagttggtgggtnacgagtggtcgaccttacgtacggattcgtttgagtttcgtttacggggacctaaggtcgaagtaacgg

SEQ ID NO: 95483 - DNA, 662 bp, Homo sapiens
  misc_feature: GYAE6OF02G75PC.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggacttgtgaagtccttcggagacactcgtccctcacctgcttctgtctctggcgctccatcagtagtagattattactacgtgggctggatccggcacggccccccgggaagggctggattggattggacagtatcgtagttactacgtcgggacctaccttctacaacgtcgtcgctacaagtagtcgagtcacatcgaccgcggacacgtaccgaacggaccagtttcctcccgtagaaacgtcctacgtaccttcgtcggtacgacccgtccggaccgtaacggaccgtaaccgggttcctttttacgttaacgttttccgtggttcgtaccttaaggtaactttaaagttaacggttggttacgggttacgtaccgttaggttcggtacggtaccgtttaacgttacgggtagtttccgtttttaggaacgtttacgggtttacgggaacccgtaagggtaccgtaacgggttaaccgg

SEQ ID NO: 95484 - DNA, 662 bp, Homo sapiens
  misc_feature: GYAE6OF02IBXV6.51.36.D03.1.454.CMB.1.raw
  modified_base (522)..(522): a, c, t, g, unknown or other
  misc_feature (522)..(522): n is a, c, g, or t
  modified_base (539)..(539): a, c, t, g, unknown or other
  misc_feature (539)..(539): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgagcctttcggagacactcgtccctcacctgctctgtctcgtggccggctccatcagtagtagtatattactacgtggggctggactccggccgaccggcccccggggaaggggccgtaggtagttggtagttcgggactaagtactcgtaggtttatacgtcgggtacctacctttctacgtaacgttcgtaccgtctacgaaagacgttcgaacgttcaacctagtacgacccggacggtaaccaacggttaccgaaacggtacctacggtttaccctacccgtaggaacgtcttacgacccttcgtcgtcgacccgcccgcaacgacctacgtntttagttacttttacgngttagcttagtaacttaagtagttaggtggtacgacgtaggtacggtcgtaccgttaacgtacggtacgtttcgttttagagtttcggttaccggggtacctaacgggcctaacggtaaccgg

SEQ ID NO: 95485 - DNA, 662 bp, Homo sapiens
  misc_feature: GYAE6OF02IR81Y.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctctggtggcggctcccagatgggtcctgtcccagttgcacctgcaggagtcgggcccaggacttgtagaagccttcggagacactgtccctcacctgctctgtctcgtggcgctcatcagtagtagatattactactggggtctggactccgggcacggccccccggggaagggctcgggattggattggctagtatcgagttatacgtcgggacctacctttctacaagtcgtcgtctacgaaggtagtcgaacgttcaccgagtcgaaccggtccggaaccacggttaccgaaacgggtaccctaacggtttccctacccgttaggaacggtccttacggtaaccttccgttggtacgtaacccggcccgacgaacgtccggaaacgggttcctttttacggttactttcgttacggttcgcgtaacgtaattagttaacgttcggtgggtagtaccgtaggttcggtcgtacccgtaccgtagggtacttgttttagacgtttacgggtttccgggccgaaacggttcgaacggtaacggg

SEQ ID NO: 95486 - DNA, 735 bp, Homo sapiens
  misc_feature: GYAE6OF02IRB52.51.36.D03.1.454.CMB.1.raw
  modified_base (165)..(165): a, c, t, g, unknown or other
  misc_feature (165)..(165): n is a, c, g, or t
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (449)..(449): a, c, t, g, unknown or other
  misc_feature (449)..(449): n is a, c, g, or t
tcagcgatcgtatacacgaccggtgctcgatttagctgcgtcacgagtctctcttggggctttctgagagtcgtggatctcatgtgcaagaaatgaagcacctgtggttcttcctcctcctggtggcggctcccagatgggtcctgtcccagttgcactgcaggntcgggccaggtacttgngaagccttcgganacactgtccctnactgctctgtctcgtggcggtctccgatcgagtatagatacttactacgtgggacctggtactccggacaccggacccccgggagggtcctaggtagttggaacgttggactaggttacgtcgtaggttacgtacgtacgggaccttaccgtttcgttacgtaagtccgtccgactacgtaaggtcgtacgacgtcctacacgtcgaaccggcgacctacgtacgaacggtacctgttaccnccgtaggactcgttacgaccgttcgtagttaccggaccgtaccgtacgaacgtacccgttacgggttacttttacgttaacgtttccggtacggttaacgaccgtttaaaggtacgtttaaaggtttaaacgttggggttaaccgggtaagttaaacccggtggggtttaccggttacccggtaactttaacccgggtaacgggtaacgttttaccggtttttacggaacggtttttcgggttaaccggggaacctaacgggttacccggtaaacggttacccggg

SEQ ID NO: 95487 - DNA, 575 bp, Homo sapiens
  misc_feature: GYAE6OF02F8ZB1.51.36.D03.1.454.CMB.1.raw
  modified_base (470)..(470): a, c, t, g, unknown or other
  misc_feature (470)..(470): n is a, c, g, or t
tcagcgatcgtatacacgaccggtgctcgatttagctgcgtcacgagtcctctccttgggggctttctgagaggtcgtggagtctcatgtgcaagaaaatgaaggcaccgtgtggttcttcctcctcctggtggtcggctcccaggactggggtcctgtcccagttgcacctgcacggagtcgggcccaggacttgtcgaacgcctttcggagacactgtccctcacctggctctgtctctggcggtctccatcagtagtagatattactactggggctggatccggcaggccccccgggaggggctggattggattgggcagtatcagttatacgtgggacctaccttcttcaagtcgtcgctcaagagtcgagtcacctatcgaccgcggacacgtaccaaggaccagttctccctgaacgctcgacctctgtcgccgtccgcagaccacggtctttgtatttctgtnctagtatataatggttggtagacgtagtggtacgccgttaacgtacgggtagttcgttttagagtttacggtttacggggacctaacgggtcctaaggtaaccgg

SEQ ID NO: 95488 - DNA, 628 bp, Homo sapiens
  misc_feature: GYAE6OF02FTUJX.51.36.D03.1.454.CMB.1.raw
  modified_base (210)..(210): a, c, t, g, unknown or other
  misc_feature (210)..(210): n is a, c, g, or t
  modified_base (554)..(554): a, c, t, g, unknown or other
  misc_feature (554)..(554): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctnacctgctctgtctctggcggctccatcagtagtagatattactacgtgggtctggtacgtccggacgaccggacccccggggagggtcgtggtagttggtagttggacgtagtatacgtagttacgtacgtacggaccctacttcttacgtacgttcgtcgtacgtacgaaggtacgtacgtacgtacaccgtagtacgaccgacggacgtaccgtacgaacggaccgtacgttccgtaccgtagacgtctacgtacctcgtcgtccgaccgccgacgacgaccgtacggttctttacgtactttcgtggttcgtacgttagtaattaagtagttggttaggtntagtagtcggtcgtacgtacgtacggtacgttcgtttaggtacgttggttacggacgtacggtacgaggtacgg

SEQ ID NO: 95489 - DNA, 780 bp, Homo sapiens
  misc_feature: GYAE6OF02H5AMV.51.36.D03.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctctggtggcggctcccagatgggtcctgtcccagttgcacctgcaggagtccgggcccaggacttgtgaacgccttcggganacactcgtccctnacctgccttctgtctctgggccgctccatcagttagagattattactacgtggggtctggagtccggacaccggccccccgggaaggggtctggaagtttcggacgtttcgggcctaaggttactacgtaggttttacttaccgtacggggtaacccttaccttccgttacgtaacggtccgttacgaccttacgaacggtacgtccggtagtaccacctaagttcggaacccggccggtaacgtaccggtacccgaaacgggtacccttaacggtttccctaccccggttagaaaccggttccgttacgtaaccccgttcgttaccgggtacggtacccccggtccgtaaccgaacggtaacccgttacgggtccgtttttacggttaaccttttcggttacgtcgttaaccttaagtaacgttaaattaacggttcgggttagggtcgtaacgtagggtccggttacgacccgtttaacggttacgggtagttttaccggttttagaaccggttttgggttttacccgggggacctaaacggggttccgaacggttaaacccggg

SEQ ID NO: 95490 - DNA, 553 bp, Homo sapiens
  misc_feature: GYAE6OF02I0W99.51.36.D03.1.454.CMB.1.raw
  modified_base (213)..(213): a, c, t, g, unknown or other
  misc_feature (213)..(213): n is a, c, g, or t
  modified_base (355)..(355): a, c, t, g, unknown or other
  misc_feature (355)..(355): n is a, c, g, or t
  modified_base (492)..(492): a, c, t, g, unknown or other
  misc_feature (492)..(492): n is a, c, g, or t
tcagcgatcgtatacacgaccggtgctcgatttagctgcgtcacgatctctcttggggcgtttctgagagtcgtggatctcatgtgcaagaaaatgaagcacctgtggtttcttcctcctcctggtggcggctcccagatgggtccttgtcccagttgcacctgcaggagtccgggcccaggacttgtgaagccttcggagacactgtccctnacctgctctgtctctggcgcctccagtcagtactagatattactacgtgggctggagtccgcacggcccccgggaagggctggattggagttggcagtatctagtatactggacctacttcgttcagtccgtcgctacaagngtacgagtcacgatcgacccgcgtaccgaccgtaccaaggacctacgttacctccctgtaacgcgttcgaaccttcgtagtccgaccgccgcgacgacacggtcttgtattctagtgactagattagtaatggtggngagagtggtcgtactacgacgtagtcttttagagttagttggaccgtaaggcaacgtacgg

SEQ ID NO: 95491 - DNA, 553 bp, Homo sapiens
  misc_feature: GYAE6OF02FYTPH.51.36.D03.1.454.CMB.1.raw
  modified_base (501)..(501): a, c, t, g, unknown or other
  misc_feature (501)..(501): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcagccccccgggaagggctggattggattgggcagtatcagttatacgtgggaccacgttcttacaagtcgtcgctcaagagtcgagtcaccatgaccgcggacacgtccaaggaccagttctccctagaacgctgacctctgcgaccgcgacagaccacggtctttgtactttctgtcgtctaggattaagtaatggtggttagacaggttcggtgtccctaagttacggngttccgttttaggactttaggtttacggggacctaagggtccaaggtaacgg

SEQ ID NO: 95492 - DNA, 597 bp, Homo sapiens
  misc_feature: GYAE6OF02IK47Y.51.36.D03.1.454.CMB.1.raw
  modified_base (511)..(511): a, c, t, g, unknown or other
  misc_feature (511)..(511): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctcgtggcgctccatcagtagtagatattactacgtggggctggatccggcgaccggccccccggggagggcgtggagttggagttggcagtatctagttactacgtggacctaccttcttacgaagtcgtcgctacaagagtcgagtcaccgatcgaccgcggacacgtccgaaggacctacgttcctacccgtagaacgtctacgaccctcgtcgtcgacccgccgcgacgaccgtcgtctttagttactttcgtgtcgtactagtacttagttaagtggtagggtanacgtaggttggtacgtccgttacgtacgggtacgttcgtttttagacgttttaggttcggggacctaacggtcgtaacggtaacgg

SEQ ID NO: 95493 - DNA, 685 bp, Homo sapiens
  misc_feature: GYAE6OF02G9ILQ.51.36.D03.1.454.CMB.1.raw
tcagcgatcgtatacacgaccggtgctcgatttagctgcgtcacgagtctctcttgggggctttctgagagtcgtggatctcagtgtgcaagaaaagtgaagcacctgtggttcttccgtcctcctggtggcggctcccagagtgggtcctgtcccagttgcacctgcaggagtcgggcccaggacttggtgaagccttcggagacactcgtccctcacctgctctgtctcgtggcggctccgatcgagtagtagatattactacgtggggactggactccggcaccggcccccccggggaaggggtccgtggtagttggagttcggacgagttagtcgtagttactacgtcgggaccctccttcgttacgaagtccgtctactcgaagtagtcgacgtcaccgtagtcgaccgtcgaccgtaccgtaccgaacggtaccctacggtttccctaccccgtagaacgtcctacgacccgttcgtcggtaccgacccgccgtacgaacgaccgtacggttctttacggtttatttccgtgttcgtacgttaggtatttaacgttaagttcggttagggtcgtaacgtggttcggtacgtcccgttaacggttacgggtactttccggttttagtaacgtttacgggtttaccggggacctaacgggtaccgtaacggttaacccggg

SEQ ID NO: 95494 - DNA, 738 bp, Homo sapiens
  misc_feature: GYAE6OF02JOACV.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtgggctggactccggcacggcccccgggaagggctggagttggagttcggctagtatcgtagttactacgtcggacctaccgttcttacgaacgttccgtcgtacctacgaacggtacgtcggtaacgtccaacgtacgtacgacccggtacgggtaaccctaacccgggtacctaaacggggtaccctaacggtttccctaccccgtacggtaaacgtccgttacggtacccttcggtacggtacccggaaccccggtccgaccgtaaccgggtaacccgtaccgggtttaccttttcggtttaacgttttccgtcggttacgtaccggttaacgttaacgtttaagtttaacgtggttacggggttacgtaacggttaggttccggttaccgtacccgttaacggtacgggtacgtttaccggttttagtaacggttttacggttaccggggacctaacgggtccggtaacggttaccggg

SEQ ID NO: 95495 - DNA, 650 bp, Homo sapiens
  misc_feature: GYAE6OF02I8EIH.51.36.D03.1.454.CMB.1.raw
  modified_base (210)..(210): a, c, t, g, unknown or other
  misc_feature (210)..(210): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggccagggacttgtgaagccttcggagacactgtccctnacctgctctgtctctggcgctccatcagtagtagatattactactgggctggatccggcacggcccccgggaagggctaggtatggattggacagtatcagttatacgtacggcctaccttcttcaagtcgtcggtctacaaggacgtcgaacgtcaccgtagtcgaacccgcggaaccgtaccgtaccgaaacgggacctaacgttcctcccgtacggtaagccttacggaccgttcgtcggtaccgtacccggccgaccacggaccgtaacgggttcctttacgtactttcgttacgtcgtaacgttagtaattagttaacggtggttacgggtataacggtaggtttcggtacggtaccttaacggttacgggtacgttccgttttagtacggtttacgggttttgggaccgtaacgggtaccgtagggttaaccgg

SEQ ID NO: 95496 - DNA, 681 bp, Homo sapiens
  misc_feature: GYAE6OF02GOYR7.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggactccggcaccggccccccggggaagggctggagttggagttggcagttatctagttatacgtcgggacctaccttcttactaagtcgtcgctacaagtagtacgagtcactagtcgaccggcggacgtaccgtaccgaacgggtacctacgtttccctcccgtaggaacggtccgtacgtacccgttcgttccgggtaccggacccgggcccgaccgaaccggacccggtaccgggttcctttttaggttacgtttttcgtcggttagtaccgttaagtaactttaattaaagtttgggtagggttcgaacgttggttcggtacggtccctttaacggtaccgggtaagtttcgtttttaggtaacgtttacgggtttaccgggggaccttaacggggaccgaaccgggttaacgg

SEQ ID NO: 95497 - DNA, 715 bp, Homo sapiens
  misc_feature: GYAE6OF02IE8RT.51.36.D03.1.454.CMB.1.raw
  modified_base (220)..(220): a, c, t, g, unknown or other
  misc_feature (220)..(220): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggacttgtgaagccgttcggagacactgtccctcacctgctntgtctctggcgctccatcagtagtagtatattactacgtgggctggatccggcgaccggccccccgggagggtctggtattggattggcgagtactcgtagttactacgtcggacctacttcgtacgtacgtcgtcgtcgtacaagtacgtacgacgtccacgtagtcgaccggtcggaccgtaccgtacgaacggtaccgtacgttccctaccgtaggaacgtccgtacgtacccgttcgtcggttaccggacccggtcccgacgaaccgtaaccggtacggtttccgttttacgttaacgtttcgttaggttacgtacgttaagtaactttaagttaacggtttggggtacgggtacgtaccgggttgggttaccggttaccggttaacccgttaccggttaaccggttacggttttaccggttttaaggtacggttttacgggtttaccgggggtacctaaacgggtaccccggtaagggttaaaccccggg

SEQ ID NO: 95498 - DNA, 583 bp, Homo sapiens
  misc_feature: GYAE6OF02FK226.51.36.D03.1.454.CMB.1.raw
  modified_base (491)..(491): a, c, t, g, unknown or other
  misc_feature (491)..(491): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcactccatcagtagtagatattactacgtgggctggatccggcacggccccccggggaagggctggagttggattggcagtatctagttatacgtcggtacctacctttcgttacgaacgtcgtcgtactacgaagagtacgagtccaccagtcgaccgacggacaccgtaccgaaggacctacgttcctcccgagaacgtcctcgtacctcgtcgtacgaccgccgcgacgacgaccgtctttagttactttgtgtcgtctanattatagtggtggtacacgtggtcgtcgtacctaacgtacggattcgttttagacgtttacggttacgggacctaaggaccgtaggtaacgg

SEQ ID NO: 95499 - DNA, 570 bp, Homo sapiens
  misc_feature: GYAE6OF02GIIJA.51.36.D03.1.454.CMB.1.raw
  modified_base (496)..(496): a, c, t, g, unknown or other
  misc_feature (496)..(496): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctgttggcggctcccagatgggtcctgtcccagttgcacctgcaggagtcgggcccaggacttgtgaagccttcggagacactgtccctcacctgctctgtctctggcgctccatcagtagtagatattactacgtggggctggagtccggcgacggcccccccggggaaggggcgtggagttggattggcagtatcgtagttatacgtcggacctacctttaactcgaagtcgtcgctacgaagagtacgagtcaccatgaccgcggacacgtccaacggaccagttcctccgtgacgctcgacctctgtcgaccgccgacacgacctacggtctttagtatttctgtcgtactagtactagtaatggtgggtanacgtggtggtcgccgtaacgtacggagttacgttttgagttacggtttgggaccgaacggtcgaacgtaaccgg

SEQ ID NO: 95500 - DNA, 637 bp, Homo sapiens
  misc_feature: GYAE6OF02GEG0V.51.36.D03.1.454.CMB.1.raw
  modified_base (226)..(226): a, c, t, g, unknown or other
  misc_feature (226)..(226): n is a, c, g, or t
tcagcgatcgtatacacgaccggtgctcgatttagctgcgtcacgatctctcttgggggctttctgagagtcgtggatctcatgtgcaagaaaaatgaagcacctgtggttcttcctcctcctggtggcggctcccagatgggtcctgtcccagttgcacctgcaggagtcgggcccaggacttgtgaagccttcggagacactgtccctcacctgctctgtctcnggcgctccatcagtagtagatatactagtggggctggatccggcacggcccccccgggaaggggcgtaggagttggattggcgagtatctagttaatacgtcgggaaccctaccgtttcgttacgtaaagttccgtccgtctacctaaaggacgttacggacgtaccaacctagtcgacccggaccggaacaccggtaccaaacgggtaccctaagttccctacccgtgaagtcctacgtaccctcgttcgcggaacccgtccgacacggaccgtacggtccttttcgtatttcgtagtgtactagacttaagtacgttggtaggtcgtacgtggtggtacgtcctaacggttacggacgtgtttttacgagtttacggtttcggggaaccacggtactaacgggtaacgg

SEQ ID NO: 95501 - DNA, 649 bp, Homo sapiens
  misc_feature: GYAE6OF02G6U75.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagtccttcggagacactgtccctcacctgctctgtctctggcgctccatcagtagtagattattactacgtgggctggactccggcaccgggcccccgggaggggctgggagttggagttggcgtagtatcgtagttactacgtcggacctaccttctacgtaagtcgtcgctacgaagtacgtcgagtacacagtcgaccgcggaccacgtaccgaacggacctacgtttccgtacctaggaacgtccgtacgtacccttcgtacgtcggtacccgccgacgtacgaccgtacggttccttttagttactttcgtgttcgtacgttagtaattattaaggtcggtgggtacgacggttaggttcggttaccggtaccgttaacggtaacgggttgtttacgttttaggtaacgtttacgggttaccggggaaccgtaacgggtaccgtaacggtaaccggg

SEQ ID NO: 95502 - DNA, 729 bp, Homo sapiens
  misc_feature: GYAE6OF02JP5OK.51.36.D03.1.454.CMB.1.raw
tcagcgatcgtatacacgaccggtgctcgatttagctgcgtcacgatctctcttggggctttctgagagtcgtggatctcatgtgcaagaaaatgaagcacctgtggttcttcctcctcctggtggcggctcccagatgggtcctgtcccagttgccacctgcaggagtcgggccaggcttgtgaagccttcggagacactgtccctcacctgctctgtctcgtggcgctccatcagttagtagatattactacgtgggtctggacgtccggccaccgggcccccccggggaaggggccgtagggtagttggagtttcggcgtaggtatcgtagtttagtacgtcgggtaacctaccgtttaccgtacgtaacgtccggtcgtaccttacgtaagacggttcgtacgtaccgaacctagtccgacccggccggtaaaccgtaccggtaccgaaacggaacccgtacgttaccctacccgtacggacgtacctacgtacctaccgtcggtaccggtacccggaccgtaccgaacgtaccgtacgggtacccttttggttacttttcggtcgttcggtaccgttaggtaacttaagttacggtttcgggttagggtacggtacgtacggttacgggttccggtaccgttaacgtacgggtacgtttacgttttagttaacggttcggttttaccgggaaccggtaacgggtaccggtacggttaaccgggg

SEQ ID NO: 95503 - DNA, 674 bp, Homo sapiens
  misc_feature: GYAE6OF02INZ5A.51.36.D03.1.454.CMB.1.raw
  modified_base (211)..(211): a, c, t, g, unknown or other
  misc_feature (211)..(211): n is a, c, g, or t
  modified_base (521)..(521): a, c, t, g, unknown or other
  misc_feature (521)..(521): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggacttgtgaagccttcggagacactgtccctnacctgctctgtctctggcagcctccatcagtagtagatattactacgtgggctggacgtccggcaccggccccccgggaagggtcctgggtacgttgggagttcggcgtaagtactacgtagtttaactacgtcggtaacctacctttcgttacaacgttccgtacgactacgaagtagtacgtaacgtaccaaccgtagtcgaccggacggtaccaccgtaccgaaacgggtaccctaacgtttcctaccctaggaacgtcctacgtacctcgttgtaccgacccgaccgacgacgtaccgtaccggtnttttacggtacttttaccgtggttcgtacgttaataacttaacgtaaggttgggttcggtagacgtaggttcggtccgtaccgtagttaaccggtagtttaccgttttagtaacgtttagggtttacgggaaccgtaacgggtacctaacggg

SEQ ID NO: 95504 - DNA, 627 bp, Homo sapiens
  misc_feature: GYAE6OF02HOXS3.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactcgtccctcacctgctctgtctctggcggcctccatcagtagtagatattactacgtggggctggacgtccggcgaccgggccccccggggaaggggcgtggagttggagttcgggcgagttactcgtagttatacgtcgggtacctaccttcttacgaacgttcgtcgctacaagtcgtacgacgtccacgtagtcgaccgcggaccacgtaccgaacggacctacgttcctcccgtagaacgtccgtcgtacctcgtacggtcgacccgccgacacgaccgtacgtctttagtacttgtgtcgtatagtataatagtggtggtagcgtaggttcggtacgtacccgttacgttacgggtagtttccgttttagtacggttttaggttccggggtaccgaacgggtaccgtaaccgggtaacgg

SEQ ID NO: 95505 - DNA, 643 bp, Homo sapiens
  misc_feature: GYAE6OF02FYABV.51.36.D03.1.454.CMB.1.raw
  modified_base (434)..(434): a, c, t, g, unknown or other
  misc_feature (434)..(434): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggagtccggcaccggccccccgggaaggggctggtagttggagttggcagtatcgtagttatacgtcgggacctacctttctacaagtcgtcgctcgaagtagtcgagtcaccatcgaccgcggacaccgtccaaggacctacgttcctcctaggtacgtcgtcgtaccgtntcgtcgcccgccgcaacggaccgtacggttcttttacgttacttttcgtgttacgtacttaagtacgtttaattacggttagggttacggtacgtacggttaggttggtccggttaaccgttaacggttaccgggtacgttttacgttttacggtagttttaccgggtttacggggaacccgtacgggtaccggtaacggtaacccggg

SEQ ID NO: 95506 - DNA, 599 bp, Homo sapiens
  misc_feature: GYAE6OF02GLC0Z.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagcctttcggagacactgtccctcacctgctctgtctctggcgctccatcagtagtagatattactactggggctggatccggcacggccccccgggaagggctggagttggattgggcagtatcgagtttactacgtgggaccctaccttcttacaagtccgtcgctcaagagtcgagtcaccatacgaccggcggaccaccggacccaaggacctacgttcctcccgtagaacgtcctcgtaccgtctgtacgacccgccgacgacgaccgacggtctttgttacttttcgtagttcgcgttagtattagttaatggtgggtagacgtaggttggtcggtccttaacggtacggtacgttccttttaggactttggtttacggggacctaagggccgtaacggtaaccgg

SEQ ID NO: 95507 - DNA, 566 bp, Homo sapiens
  misc_feature: GYAE6OF02GSOOL.51.36.D03.1.454.CMB.1.raw
  modified_base (361)..(361): a, c, t, g, unknown or other
  misc_feature (361)..(361): n is a, c, g, or t
  modified_base (401)..(401): a, c, t, g, unknown or other
  misc_feature (401)..(401): n is a, c, g, or t
  modified_base (468)..(468): a, c, t, g, unknown or other
  misc_feature (468)..(468): n is a, c, g, or t
  modified_base (485)..(485): a, c, t, g, unknown or other
  misc_feature (485)..(485): n is a, c, g, or t
tcagcgatcgtatacacgaccggtgctcgatttagctgcgtcacgatctctcttgggggctttctgagagtcgtggatctcatgtgcaagaaaaatgaagcacctgtggttcttcctcctcctggtggcggctcccagatgggtcctgtcccagttgcacctgcaggagtcgggcccaggacttgtgagccttcggagacactgtccctcacctgctctgtctctggcggctccatcagtagtagatattactacgtggggctggactccggcacggcccccggggaagggctggattggattggcagtatcgagttatacgtcggacctaccttcttacgaacgttcgtcgctacgaagngtacgagtcacatcgaccgcggacacgtaccgaagtaccngttcctccctagaatctcgaccttctgcgaccgccgcgacgacgcgtctttgtattcgtgtgctagnttaataagtggtgggtnacgtagtcggtcgtcttaacgtaggtacgttacgttttaggtagttaggtttacggggacgtaacggtacgacggtaacgg

SEQ ID NO: 95508 - DNA, 552 bp, Homo sapiens
  misc_feature: GYAE6OF02HPVA1.51.36.D03.1.454.CMB.1.raw
  modified_base (198)..(198): a, c, t, g, unknown or other
  misc_feature (198)..(198): n is a, c, g, or t
  modified_base (487)..(487): a, c, t, g, unknown or other
  misc_feature (487)..(487): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcgganacactgtccctcacctgctctgtctctggcgctccatcagtagtagatattactactggggctggatccggcacgccccccgggaaggggctgggattggattggcaggtatcagttatacgtgggaccaccttcttcaagtcgtcgctcaagtgtcgagtcaccagtcgaccgcggacacgtccgaaggaccacgttcctaccctgaacgctgacctctcggtcgacccgccgcacgacacggtctttagttatttcgtgtgcttagacttattaatggtgggtgacnggttggcgccgtacgtacggattcgtttagagttaggttgggaccctaaggccgtaaggtaacgg

SEQ ID NO: 95509 - DNA, 648 bp, Homo sapiens
  misc_feature: GYAE6OF02H1I8P.51.36.D03.1.454.CMB.1.raw
  modified_base (551)..(551): a, c, t, g, unknown or other
  misc_feature (551)..(551): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggactcggcgacggcccccgggaaggggctggacttggagttggcagtatcagttatacgtgggacctaccttcttcaagtcgtacgctacaagagtcgagtcaccatacgaccgcggaacaccgtacccaaggacctacgtttaccctcccgtaggaacgtccgtacgaccctcgtcgtacggacccggcccgccgtaacggacccgtaacgggtctttttacgggtactttttcggttacggtcgttacgttaacgtaatttaacgttaaagttcggttaggggtanacgttagggtcggttcggtacccgtttaacgtacggtagtttaccgttttaggtaacgttacggttttcggggaaccgtaacggcaacgggtaacgg

SEQ ID NO: 95510 - DNA, 645 bp, Homo sapiens
  misc_feature: GYAE6OF02HOXSZ.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctgtggcgctcatcagtagtagatattactacgtggggctggatccggcaccggccccccggggaaggggctggtagttgggtattgggcagtatcgagttatacgtcggtacctaccttctacgtaagtcgtcgtcgtacgaaggtacgtacgtacgtaccaccgtagtaccggaccgacggaaccacgtacccgaacggtaccctacgttccctaccgtagaacgtctacgtacctcgtcgtaccgacccgccgacagaccgacgttctttagtactttcgtagtcgtacttaaggtattaagtacgtggtacgggtagtacgtaggttcgggtactacccgttacgttaacgggtacgtttccgttttaggacgttttacgggttaccgggaccgtaacgggtcccggtaaggtaacccgg

SEQ ID NO: 95511 - DNA, 664 bp, Homo sapiens
  misc_feature: GYAE6OF02GB8SY.51.36.D03.1.454.CMB.1.raw
  modified_base (244)..(244): a, c, t, g, unknown or other
  misc_feature (244)..(244): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtanatattactactggggctggactccggcaccggccccccggggaagggcctggagttggagttggctagtatcgaagtttactacgtcgggtacctaccttcttacaacgttccgtacgctacgtaaggtacggtaccgtagtaccaccagttacggacccggtccggaaccgtaccggtaacccgaaacgggacccttacggtttccctaccccgtaggaacgtctacgtacccttcgtcgtccgacccgtccgacaacgaccgtacggtctttagttacttcgtgtcgacgttacgtattaagtaagttcggtagggtacgtactagggttgtacggtacccgttaacggttccgggtagttccgtttttaggtaacgtttcgggttacgggtaccgaaggttacgaccgggttaacgg

SEQ ID NO: 95512 - DNA, 585 bp, Homo sapiens
  misc_feature: GYAE6OF02GRLYY.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggctcaggacttgtgaagccttcggagacactgtccctcacctgctctgtctctggcgctccatcagtagtagatattactacgtgggctggatccggcacggccccccgggaagggctggagttggattggcagtatcagttatacgtgggacctaccttcttacaagtcgtcgctacaagagtcgagtcacatcgaccgcggacacgtaccgaacggacctagttcctacccgtagaacgtctacgacctctggtccgacccgccgacgacgacgtaccggtcttttagttactttcgtgtcgtcgttaagtattaagtagtggtagggtagtacgtaggtcggtctacccgttacgtacggtacgttcgttttaggagtttaggtttccgggactaacgggcttaaacggg

SEQ ID NO: 95513 - DNA, 555 bp, Homo sapiens
  misc_feature: GYAE6OF02ISYU2.51.36.D03.1.454.CMB.1.raw
  modified_base (344)..(344): a, c, t, g, unknown or other
  misc_feature (344)..(344): n is a, c, g, or t
  modified_base (393)..(393): a, c, t, g, unknown or other
  misc_feature (393)..(393): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggatccggcacggccccccgggaagggctggattggattggcagtatcagttatacgtgggacctaccttcttcaagtcgtcnctacaagagtcgagtcacatcgaccgcgacacgtccaaggaccagttcnccctgaacgctgacctcgtgtcgaccgtccgcacgacctacggtctttgtatttcgtgtcgtctagattagtaatgtgggtagacgtagtggtggtacctacgttacggagttcgtttttaggactttaggtttcggggacctaaggtccgaacggtaacgg

SEQ ID NO: 95514 - DNA, 664 bp, Homo sapiens
  misc_feature: GYAE6OF02GY5LH.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggagtccggcacggccccccggggaaggggctggagttggattggcgagtatcgtagttagtacgtcgggacctacctttcgttacaagtccgtacgctacgtaaggacgtcgagttccacctagtcgaccggtcgaccgaccgtaccgaaacggccgtaacgtttccctacccgtagaacggtccgtacgtacccttcgtacggtccggtacccggcccgaccgaacggtaaccgtacccgggttcttttacggtttacttttcggtacgttcgtacgttaagtaacgttaattaacggttgtaggggttacacgtggttacggtccgtaccgttaacggtaccggtagttcgttttaggattttacgggttcggggtaaccagggtaccgaggtaaccgg

SEQ ID NO: 95515 - DNA, 609 bp, Homo sapiens
  misc_feature: GYAE6OF02IA2CE.51.36.D03.1.454.CMB.1.raw
  modified_base (356)..(356): a, c, t, g, unknown or other
  misc_feature (356)..(356): n is a, c, g, or t
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtcggcccaggacttgtgaagccttggagacactcgtcctcacctgctctgtctcgtgcgctccatcagtagtagtatattactacgtgggctggacgtccggcaccggccccccgggaaggggtcctggacttggagttggctagtatcgtaagttactacgtcggacctacttctacaagtcgtcnctacaagtcgtcgacgtacaccgtgtacgaccgaccggaccaccggtaccaaacggcccgtaagtttccctacccgtagaacgtactacggacccttacgtcgtaccgacccgccgacgacgaccgtacggtcttttagtcttttcgagttcgacttagtattaagtagtggtacgtgacgtgttacggtctaccgttacgcggtagtttcgtttagacgttcgggttcgggacctaggtaccacggtaacgg

SEQ ID NO: 95516 - DNA, 619 bp, Homo sapiens
  misc_feature: GYAE6OF02IHHEW.51.36.D03.1.454.CMB.1.raw
  modified_base (520)..(520): a, c, t, g, unknown or other
  misc_feature (520)..(520): n is a, c, g, or t
  modified_base (575)..(575): a, c, t, g, unknown or other
  misc_feature (575)..(575): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggtacttgtgaagccttcggagacactcgtccctcacctgctctgtctctggccgctccatcagtagtagatattactacgtgggctggactccggcacggccccccggggaagggccgtggtacgttggagttggctagtatctagttatacgtacggacctacctttctacaacgtccgtcgacctacgaagtacgtcgacgtacaccagtccgaccgcggaccaccggtaccaaacgggaccctacgtttccctaccccgttaggaaacgtccttacggacccttcgtcgtaccggaacccgtcccgacacggacccgtacggtcttttagttatttcgngttcgctatattataagtggtgggtagataggtggtcgtaccgtacgtacgggtnttcgtttagagttacggtttcgggaccaaggtccgaggtaacgg

SEQ ID NO: 95517 - DNA, 606 bp, Homo sapiens
  misc_feature: GYAE6OF02F1Y4E.51.36.D03.1.454.CMB.1.raw
  modified_base (479)..(479): a, c, t, g, unknown or other
  misc_feature (479)..(479): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggactccggcacggcccccgggaagggctggagtggagttggcagtactcgtagttatacgtcggacctacctttcttcgtaagtcgtcgctacaagtagtcgagtcaccagtcgaccgcggacaccgtaccgaaggacctacgttcctccgtagaacgtctcgtacccttcgtcgtcgacccgcgacaacgaccgtacgttctttgttactttcgngttcgtacttagaagttaatagtggtgggtacgacgtagttcggtacgtccgtaacgtacggtacgtttcgttttaggtacgtttacgggttacgggaaccgtaacgggtaccgtaacggtaaccgg

SEQ ID NO: 95518 - DNA, 940 bp, Homo sapiens
  misc_feature: GYAE6OF02FH8CS.51.36.D03.1.454.CMB.1.raw
tcagcgatcgtatacacgaccggtgctcgatttagctgcgtcacgatctctcttggggctttctgagagtcgtggatctcatgtgcaagaaaatgaagcacctgtgttcttcctcctcctggtgcgctcccagatggtcctgtcccagttgccacctgcaggagtccgggccaggacttgtagaacgtccttcggacgacactcgtccctcacctgcctcgtcgtctcgtcggccgtcctcctatccgtaagtacgtagaacttacttaacgtcgtcggggtctcggtaaccgtcccgggccgtacccgggaccccccccgggggtaaggggtccctacgggtacgtttacggacttcggtaaccgtaagttacgttacgttaacggtttaaccgtaccggtacgggttaacccctaacccgttttaccgtaccgtaaacggggttccctaccggtacccttacggaaaccggtacgttaccggtaacgtcccgtaaccgacgttaacccggtaaccccggaccgggtaaaccccgtaaccggtaaccccggtaaacggtaaaccccgtttcggtaccccttaccccgaaggtaacccgtaccgttaccgtaaccccgttaccgtacgttaaccggacccccggttaccgaccgtaaaccggttaacccgttacccggtttacgttttaacgtttacgttttaaccgtcgttaccggtaaacgttaacgttaaaacgttaacgttaaacggttcgggttaacggggttaaccggtaaccggttacggttacccgggtaaccgtaaccccgttttaaacgggtacccgggtttttaaaccgttaccccgttttttagggtaaacccggttttaaccgggggtttaacccggggtaacccgtaaacggggtaccccgttaaacccgggtttaacccccgggg

SEQ ID NO: 95519 - DNA, 623 bp, Homo sapiens
  misc_feature: GYAE6OF02G35GZ.51.36.D03.1.454.CMB.1.raw
  modified_base (544)..(544): a, c, t, g, unknown or other
  misc_feature (544)..(544): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtgggctggactccggcgacggccccccggggaagggctggagttggattggcagtatcgtagttacgtacgtcgggtacctaccgtttcttacgaacgttccggtcgtactacgaaagtacgtcgaacgtaccaaccgagtacggacccggacggaccgtaacgtacccgaacggtacctacgtttcctacccgtagacgtcgtacgtacctcgtcgtacgaccgccgacgacgtaccgacggttctttgtactttcgtgtgtactagtataagttacgtgtagggtanacgtagtcggtcgtaccgtacgtacggtagttccgttttagagtttggttaccgggaccgtaaggtacgacgtaaccgg

SEQ ID NO: 95520 - DNA, 684 bp, Homo sapiens
  misc_feature: GYAE6OF02IBMNP.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctcatcagtagtagattattacgtacgtgggactggactccgggacgacggcccccccgggaaggggcctaggagttacggtagtttgggacctaggtactacgtagttacgtacgtacgggtaccctaccgtttacgttacgaagtccgtacgaccgtacgaagtcgtacgtacggtaccaccgtacgtacgaccggtaccggaaccgtaaccgttaccgaaaccggtacctaaccgtttcctaccccgtagaacgtcctacgacctcgtggtccgacccgcgaccacgtaaccgtcgggttaccttttaggtacttttcggtagtcgtacgttaagtaacgtttaataacgtcgggttaggagtaccgttagggttcggtagcctttaacggacgttagtttccgttttaagacgtttagggttacggacccgtaagggtcctaaggtaccgg

SEQ ID NO: 95521 - DNA, 594 bp, Homo sapiens
  misc_feature: GYAE6OF02IGRM9.51.36.D03.1.454.CMB.1.raw
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggactttgtgaagccttcggagacactgtccctcacctgctctgtctctggcgctccatcagtagtagatattactactggggctggatccggcacgcccccgggaagggctggattggattggcagtntcagttatacgtgggaccaccttctcaagtcgtcgctcaagngtcgagtcacagtcgaccgtcggacacgtccaaggacctacgttctaccctgaacgtctcgacctctgtacgacccgccgtacacgaccgtacggcttttagtactttctaggtgacctagtattataagttggtgggttacgacgtaggttcgggtcggtaccttaccggtaacggtagtttccgttttaggacgttttacggtttccgggggaaccctaaggggtacccgtaaggtaacccggg

SEQ ID NO: 95522 - DNA, 610 bp, Homo sapiens
  misc_feature: GYAE6OF02GEEBC.51.36.D03.1.454.CMB.1.raw
  modified_base (359)..(359): a, c, t, g, unknown or other
  misc_feature (359)..(359): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagattattactacgtgggctggatccggcacggccccccgggaagggctggacgttggattggcagtatcagttatacgtgggacctacctttcttacaagtccgtcgctcgaaagngtacgagtcacagtacgaccgcggacaccgtcaaggcctaagttcctccgtagaacgtctcgacccttctcgtcgacccgtccgcacgaccacggttccttttagttacttttccaggttcgtacgttaagtacttaagttaagttggttagggtagaccgtaggttcggtcgtaccgttaacggtacggtaagtttccgttttaggactttcgggtttacggggacctaagggtccgtaacggtaaccgg

SEQ ID NO: 95523 - DNA, 762 bp, Homo sapiens
  misc_feature: GYAE6OF02H94IQ.51.36.D03.1.454.CMB.1.raw
  modified_base (243)..(243): a, c, t, g, unknown or other
  misc_feature (243)..(243): n is a, c, g, or t
tcagcgatcgtatacacgaccggtgctcgatttagctgcgtcacgatctctcgttgggggctttctgagagtcgtggatctcatgtgcaagaaaatgaagcacctgtgttcttcctcctctggtggcggctcccagatgggtcctcgtcccagttgcacctgcaggagtcggcccaggtacttgagaagtccttagggagacactcgtccctcaccgtgcttctcgtctcgtggcgccttcanctagtagtagtattactttaccgtacggtcggggtcgtacggtacgtccggacgaccccgggacccccccgggggaaggggtccgttaggtaggtttacggtacgtttacgggaccgttaggttaacgttaccgtaagttttaacgtaaccgggttacgggtaacccttaccgttttacgtaaccgtaacggttccggtaccgtaccgtaaccgtaagtaccggttcgaacgttaccacgtacgtaccggaaccggtacggacctaacccggtaccgaaacgggtaccgtaaccgtttccgtacccgttaaggaacctccggttaactcccgttacgtacggtaccggacccgtcgaccgtaacgaaccggtcgtttaccttttagtacgttttcctagttcgtactaaaccgttataagtttaaccgtgtaagggttaccgataggtacggtcgtaaccgtaccgttaggactttacgttgtaagtttacgggtacggacgtagtacggattacccgg

SEQ ID NO: 95524 - DNA, 682 bp, Homo sapiens
  misc_feature: GYAE6OF02FXUK2.51.36.D03.1.454.CMB.1.raw
  modified_base (198)..(198): a, c, t, g, unknown or other
  misc_feature (198)..(198): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccaaatgggtcctgtcccagttgcacctgcaggagtcgggcccaggacttgtgaagccttcgganacactgtcccctcaccttgctctgtctctggcgctccatcagtagtagattattactacgtggggctggatccggcacggccccccggggaaggggctggacgttggagttggctagtatcgagttatacgtcgggaccctaccttcttacgtaacgttcggtcgctacgaaacgtagtaccgaaggtccaaccagtacgacccggcggaccgaccgttaccgaaacggaccgtacgtttcctcccgtagaaacgtcctacgacccttcgtcgtcggacccgtccgacgaacgtacccgtacggttcctttacgtttacgtttaccgtggttacgtccgttaagtaactttagttaacgttgggttcgggtacgtacgtaggtttcggtcgtacccgttaacggttaacgggtacgtttccgttttaggtactttacggggtttacgggaaccggaaggtaccggtaccgggttagtaccccgg

SEQ ID NO: 95525 - DNA, 558 bp, Homo sapiens
  misc_feature: GYAE6OF02IZ655.51.36.D03.1.454.CMB.1.raw
  modified_base (352)..(352): a, c, t, g, unknown or other
  misc_feature (352)..(352): n is a, c, g, or t
  modified_base (397)..(397): a, c, t, g, unknown or other
  misc_feature (397)..(397): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttggagacactgtccctcacctgctctgtctctggcgctccatcagtagtagatattactactggggctggatccggcacggccccccgggaagggctggattggattggcagtatcagttatacgtcgggacctaccttcttcaagtcgtcgctacaagngtcgagtcaccagtcgaccgcgacacgtaccaaggaccacgttcncctgaagctagacctcgtgcgaccgcgcacgacacggtctttgtactttcgtgtgtctagtatattaagtgttaggtgacgtaggtggtacgtccgttaacgtcgggtattccgttttggaactttcggtttcggggacctaagggtccgaagtaaccggg

SEQ ID NO: 95526 - DNA, 747 bp, Homo sapiens
  misc_feature: GYAE6OF02HKVPT.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcactgtgttctcctcctctggtggcgctcccagagtgggtcctgtccctagttcgcacctgcgaggacgtccgggcccaggtacttgtagaacgtccgttacggagaccacgtcgtcccctacgacctgcctctgtcctcgtggccgcctcatacgtagtagtagtataattacgtacgtgggacgtggaccgtccggcgacccgggacccccggggaagggtcgtacggtagttggtagttcggactagtactcgtaagttacgtacgtacggtaccttaccttcttacgtacgttcgaccgtacgtacgtaagtcgtacgtacgtacctaacagtaccgaccggtacgaccgtaacgaccggtaacgtaccgttcgtacccgttacccgagtacgtccttacggtaccttcggacggtccgacccgtccgtacgaccgttaaccgtcgtttacttaggttacttcgtacgtagtacgtaagttaacttaacgtacgggttggtaacggtacgtaacggtacgggtttacgtaccggttaaccgttaaccgggttacggttaacgtttaggtttttaacggttacgggttaaccggggttttccgaaaccggggtaaaccggtaccgttaaacgggttaacccggg

SEQ ID NO: 95527 - DNA, 777 bp, Homo sapiens
  misc_feature: GYAE6OF02JPCS9.51.36.D03.1.454.CMB.1.raw
  modified_base (227)..(227): a, c, t, g, unknown or other
  misc_feature (227)..(227): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgccacctgcaggagtcgggcccaggacttgtgaagccttcggagacactcgtccctcacctgctctgtctcnggcgctcatcagtagtagatattactacgtgggctggactccggcgaccggtccccccgggggaagggccgtagggtacgttagggtacgttacgggaccaaggttactacgtaaggtttacgtaccggtcgggaacccttacccgtttacttacgaaacggttccggtacgtcctaacgaaacggtcggtaccgtacgttaccgaaccgacgttcggaacccggccggtaacccaccggttaccgaaacggtacccgtaacgtttcccgtaccgtaacggtaacgtacccgttacggttaacccttacggttacgggaccgtaaccccgggacgaccggtaacggtacccgtacgtttaccggtttattaccgtttaccgtggtaccggtacttaagtaacgttaattaacggttcgggttacgggtacttaacgtacgggttcggttaccgtaacccggtttaaggtaccgggttcttttaacgttttacggtaacgtttttacgggttaccggggaccctaacggggttacgtaccgggttaaccgg

SEQ ID NO: 95528 - DNA, 710 bp, Homo sapiens
  misc_feature: GYAE6OF02JV0VJ.51.36.D03.1.454.CMB.1.raw
  modified_base (254)..(254): a, c, t, g, unknown or other
  misc_feature (254)..(254): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcgaggagtccgggcccaggtacttgtagaagtccttcggagacactcgtccctcacctgctctgtctcgtggccgctaccatcgagtagtanattattactacgtgggtctggactccggacgaccggacccccgggagggtccgtaggtagttggtagttcggactagtactacgtaagttactacggtacggaccttaccttcgttacgaacgttcggtctacctaacgaacgtcgtacgtacgtccacgtacgtccgaaccggccggaaccgtaccggtaaccgaacggtaccctaacgtttacccgtacccgtagaaccggtccgtacgtacccttcggtaaccgtcccggacccgaccgtacggtaaccgtaccgtacgttccgttttagttactttcggtacgtcgtaccgtaagtacgttacgtaagttggttaggtcgtaacgtgggttccgtaccggtacgttaacggtacggttacgttacgttttacgtacgtttagggttcccggaaccgtaacggtaccgtaaccgggttaccgg

SEQ ID NO: 95529 - DNA, 629 bp, Homo sapiens
  misc_feature: GYAE6OF02G0PQL.51.36.D03.1.454.CMB.1.raw
  modified_base (528)..(528): a, c, t, g, unknown or other
  misc_feature (528)..(528): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggtacttgtgaagccttcggagacactgtccctcacctgcctctgtctcgtggcgctccatcagtagtagattattactacgtggggctggactccggcacggccccccgggaaggggctgggtagttgggagttggcgagtatctagttactacgtcggacctccttcttcgtaagtccgtcgctacaagtacgtcgacgtccaccgtatacgaccgacggacaccgtaccgaacggacctacgttcctcccgtagaacgctcgacctcgtgtccgccgtccgacacgaccgtacgtctttagtactttcgtaggtcgtcgtaagtacttaagtaagttggttagggtntacgtacgggttcggttacgtacccgttaacgtacgggtacgttacgtttttacggagtttacgggtttcgggacccgtaagggtaccgtacggtaaccgg

SEQ ID NO: 95530 - DNA, 678 bp, Homo sapiens
  misc_feature: GYAE6OF02IP841.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctctggtggcggctcccagatgggtcctgtcccagttgcacctgcaggagtcgggcccaggacttgtgaagccttcggagacactgtccctcacctgctctgtctcgtggccgctccatcagtagtagatattactacgtgggctggacgtccggcgaccggccccccggggaaggggcgtggtagttaggtagtttgggacgtagtatacgtaagttacgtacgtcgggaccttaccttcttacgtaacgtcgtcgtactacgtaagtacgtacgtacgtacacctagtacgaaccggaccggtaaccgtaccggtaccgaacggtaacctacgttacctacccgtagaacgtctacgtacctcgtcgtacgaccgccgacacgaccgtcgttcgttagttacgtttcgtagttacgacgttaagtaattaacgttaagttgggtacgggttagtaacgtagggttacggtaccggtaccgttaaccggttaacggtacgtttacgttttaaggtagtttacgggtttacgggaccgtaaacggtccgtaacggtaccgg

SEQ ID NO: 95531 - DNA, 591 bp, Homo sapiens
  misc_feature: GYAE6OF02FSKQX.51.36.D03.1.454.CMB.1.raw
  modified_base (362)..(362): a, c, t, g, unknown or other
  misc_feature (362)..(362): n is a, c, g, or t
  modified_base (511)..(511): a, c, t, g, unknown or other
  misc_feature (511)..(511): n is a, c, g, or t
tcagcgatcgtatacacgaccggtgctcgatttagctgcgtcacgatctctcttggggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactacgtggggctggatccggcacggccccccggggaaggggcctggattgggattggacagtatcgtagttactacgtgggacctaccttctcaagtcgtcgctacaagngtcgagtcaccatcgaccgcgacacgtacaaggacctagtcctcctagagtctcggtacctcgtcggtcgacccgtccgacgtacgaccgtacgggttcctttagttacttttcgtagttgtactaggattagttaaagtggtagggtntacgtagtcggtgtaccttaacgtacggtagtacgtttttagatttacggtttcgggggacctaaggcgtaacgtaacgg

SEQ ID NO: 95532 - DNA, 648 bp, Homo sapiens
  misc_feature: GYAE6OF02FZNYK.51.36.D03.1.454.CMB.1.raw
  modified_base (520)..(520): a, c, t, g, unknown or other
  misc_feature (520)..(520): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctcgtggcgctccatcgagtagtagatattacctacgtgggctggtactccggcgaccgggccccccggggaaggggtctggagttgggagttgggctaggtactacgtaggtttactacggtcgggtaccctacctttccgttactaacggttcgtcggcttacgaagtacgtacgtacgtcacctagtcgaccgcgaccgtacgtacgaacgtcctacgttcctaccgtgtaatccgtacgtacctcgtcgcgacccggtccgacacggtacctcgttacgttttcgtacttttcgnggtactacggttaataattaacgttaaggtcggttagggtacgtacgtaggtcggtcgtaccgttaccgtacgggtacttcgtttagacgtttagggttccgggactaacgggtccgtaacggtacgg

SEQ ID NO: 95533 - DNA, 591 bp, Homo sapiens
  misc_feature: GYAE6OF02HXC58.51.36.D03.1.454.CMB.1.raw
  modified_base (186)..(186): a, c, t, g, unknown or other
  misc_feature (186)..(186): n is a, c, g, or t
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
  modified_base (315)..(315): a, c, t, g, unknown or other
  misc_feature (315)..(315): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcgctcccagatgggtcctgtcccagttgccacctgcaggagtccgggccaggactttgngaacgccttcggagacactcgtccctcacctgctctgtctctggcgctccatcagtagtanattattactacgtgggctggntccggcgacggcccccgggaagggcgtaggagttggattggacagtntacgtagttactacgtcggacctaccttctacaacgtcgacgtctacgaagtacgtcgtacgtacaactacgtacgaacccggacggtaacctacggtaccgaacggacctcgttacctccgtagacgtctcgactcgtacgtcgaccgcgcacgactgtcttagtattcgtgtacatagtattactagtgtagagtactaggtcgtcgtaacgtaccggtaaggtcgttagtttagtacgttaggttacgggacctaacggtcgtacggtaacgg

SEQ ID NO: 95534 - DNA, 755 bp, Homo sapiens
  misc_feature: GYAE6OF02JJ3U5.51.36.D03.1.454.CMB.1.raw
  modified_base (631)..(631): a, c, t, g, unknown or other
  misc_feature (631)..(631): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccgttcggagacactgtccctcacctgctctgtctctggcgctccatcgagtagtagatattactacgtgggtctggactccggactaccgggccccccggggaagggtctaggtagttggagttcgggctaggtactctaacggttagtacgtacgggacccttaccgtttcgtttacgaacggttccggtaccgtccgtacgaaacggtacgttcggtaacgtaccgaacctaacgtacggtaacccggaccggtaccaacccggtaccgaaacggtacccgtaaccgtttccgtaccccgtagaaaccgtcgttacgtaaccctcgttcggtaccgacccggtccgtacgaaccgtaccggtaaccggtttctttacggtttactttcgtcgttacggtacttaacgggaactttaagtaacggttcggttacggggtntaaccggttagttcgggtaccgtaacccggtttaacggtaccggggttagttttacggttttaggtaccgttttacggggtttaccggggaacccttaacgggtaccgtaccggttaaaccggg

SEQ ID NO: 95535 - DNA, 693 bp, Homo sapiens
  misc_feature: GYAE6OF02GA03U.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgccacctgcagggagtcgggcccaggtacttgtgaagccttcggagacactgtccctcacctgctctgtctctggcgcctccatcagtagtagatattactacggtgggctggactccggccgacggaccccccggggagggtcgtggagttggagttcggctagttactacgagtttatacgtacgggaaccttacctttcgttacgtaaacgttccgtaccgtacttacgaaaggtacggtaccgtacggtaccaacctacgttacggacccggaccggtaacctaaccggtaccgaaaccggtacctacggttacctcccgtagaacgtcttacggacccttcgtcgtaccgacccgacgccgaacgacctaccgggttcttttacgttatttccgtagtcgtacttaagtacttaagttaacgttgggtaggtacgacgttaggtcggttaccgtaccgttaacggtacgggtacttttcgtttaggtacgtttacgggtttacgggacccgtaggtacccgtaaggtaaccgg

SEQ ID NO: 95536 - DNA, 678 bp, Homo sapiens
  misc_feature: GYAE6OF02H353A.51.36.D03.1.454.CMB.1.raw
  modified_base (517)..(517): a, c, t, g, unknown or other
  misc_feature (517)..(517): n is a, c, g, or t
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcaggagtccgggccaggacttgtgaagccttcggagaccactcgtccctcacctgctctgtctctggccgctcatcagtagagatattactacggtgggctggacgtccggacgaccggcccccgggagggcgtggagttggagttggacaggttactactagttaagtacgtcggggacccttacctttcgttacgtaacggtccgtacgcctacgtaaggacggtacgtacgtaccaacctagtacgaccgacggactaccgtaccgaacggtacctacggtttcctacccctaggtacgtctacgtaccgttcgtcggtccgacccggccgacgtacgaccgtacgggttnttttacgttcttttacgtagttcgtagttacgtattaacgttaaggtggttacgggtagtacgtagggtcggttacgacccgtttaacggttacgggtacgtttacgttttgtaagtttacgggttacggggaaccgtaagggaccgtacgggttaaccgg

SEQ ID NO: 95537 - DNA, 657 bp, Homo sapiens
  misc_feature: GYAE6OF02IQOIY.51.36.D03.1.454.CMB.1.raw
  modified_base (571)..(571): a, c, t, g, unknown or other
  misc_feature (571)..(571): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagattattactacgtgggctgactccggcgaccggcccccggggagggctggagttggagttcggctagtactcgtagttactacgtacgggaccctaccttcttacgtaacggttccgtcgcctacgaaggtacgtcgtaagtccaacgtagtccggaaccggaccggaaccgtaccggttacccgaaacgggtaccctacggtttaccctcccgtaggaacgtcctaccggtacccttcgtcggtaccggacccggcccgacacgtaccgtacggttctttaggtactttcgtagtacgtcttaagtattaagttagtggtaggtanacgtagttcggtacgtccgttacgtacggtacgttacgttttaggtacgttagggttaccgggacctaaggtccgtaaggtaccgg

SEQ ID NO: 95538 - DNA, 794 bp, Homo sapiens
  misc_feature: GYAE6OF02JWGHY.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcgaggaggtccgggacccgaggtacgttgtaggaacgtccgttggagacacgttcgtccctcacctgtcctcttcgtctcgtggccgctccatcgagtaagtagtattacttaacgtcgtcgggctacggtaccgtccggacgacccgggaccccggggacgggcgtaggtacggttaggagttcggacgtaaggtacgttacggtaagtttaacgtaccggtaccggtaacccttacgtttaccgtacgtaaccggtcgtaccgtcgttaacgacggttacgtacgtacggtacctaaccgtacggtaaccggacccggacccggtaacgtaacccggtaccggtaaacggtacccttacggttacccccttacggtaacggtaaccggtaccgttacggtaacccgtcgttcggacccgggtacccggccaacggaaccgtaaccggtacgtttaccgttttacgttcgttttcgacgggttcgttaactaaggttaacttaacggtttacgtggggttaacggtacgtaagtccgggttggttacccggaaccgtttaacgtacgggttcgtttacgttttaaggaccggtttagggttacggaccggttacggacggtaacgggtacg

SEQ ID NO: 95539 - DNA, 630 bp, Homo sapiens
  misc_feature: GYAE6OF02IF0BU.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtgggctggactccggcaccggccccccgggaaggggctggagttggagttggcagtatcgagttatacgtcgggacctacctttcttcaacgtcgtcgctacagagtcgagtcactagtcgaccgcggacacgtaccgaacggacctacgttcctcccgtagaacgtctacgacctcgtcgtacgacccgtccgacgacgaccgtaccggttctttacgttacttttcgtgttcgtacttaagtattacgttaagtgggttgggtagtacgtaggtcggtacgtacccgttaccggtaacgggtacgtttacgttttaggtacgtttacgggttttaccggggaccgtaacgggtacccgtaacgggtaaccggg

SEQ ID NO: 95540 - DNA, 776 bp, Homo sapiens
  misc_feature: GYAE6OF02HIG4Y.51.36.D03.1.454.CMB.1.raw
  modified_base (225)..(225): a, c, t, g, unknown or other
  misc_feature (225)..(225): n is a, c, g, or t
tcagcgatcgtatacacgaccggtgctcgatttagctgcgtcacgatctctcttgggggctttctgagagtcgtggatctcatgtgcaagaaaatgaagcacctgtgttcttcctctcctggtggcggctcccagatgggtcctgtcccagttgcacctgcaggagtccgggcccaggacttgtgaagtccttcggagacactgtccctcacctgctctgtctcnggcgctccatcagtcgtagatacttactacgtggggctggatcccggacgacggacccccccgggggaagggtccgtagggtacgttgggtacgttcgggacctaggttactaccgtaaggtttaactaaccgtacgggtaacccctaccttttaccgtttaccgaacggttccggttaccggtcctaaccgtaaggtacggttacgacggttaccaaccgtattacgggaacccgtaccggaaccgtacccggtaaccgaaacggtaccctaacgtttccctacccgtaggaaacgtccgttacgtacccttcgtacggttaccgaccccggtaccgtaccggaacgtacccggtacggtttacgtttttacgttacgtttttccgttagggtccgtaaccgttaagtactttaaagttaagttacgggttgggtcaaccggttaggttccggttacgtacccggttaccggtacggttacgtttacgttttaaggttaagtttaccggggttccgggtaaccggtaacggtacccgaacggttaaccgg

SEQ ID NO: 95541 - DNA, 571 bp, Homo sapiens
  misc_feature: GYAE6OF02FGVUB.51.36.D03.1.454.CMB.1.raw
  modified_base (416)..(416): a, c, t, g, unknown or other
  misc_feature (416)..(416): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactactggggctggactccggcacgcccccccgggaatcgggctggattggattggcagtatctagttatacgtgggacctacctttctcaagtcgtcgctcaagagtcgagtcacatcgaccgcggacacgtccaaggaccagttcctccctgaacgctgacctcngtcgaccgccgcacgacgtaccggctttgtactttcgtgtcgcgtaagtataataagtggtagggtagacgtaggtgggtacgcccgttaacgtaccgggtacgttcgttttagaacgtttacggtttaggggaccctagggtacctaaaccggg

SEQ ID NO: 95542 - DNA, 758 bp, Homo sapiens
  misc_feature: GYAE6OF02JOERE.51.36.D03.1.454.CMB.1.raw
tcagcgatcgtatacacgaccggtgctcgatttagctgcgtcacgatctctcttggggtcgtttctgagagtcgtggatctcatgtgcaagaaaatgaagcacctgtggttcttcctcctcctggtggcggctcccagatgggtcctgtcccagttgcacctgcaggacgtcgggcccaggacttggtgaacgtccttggacgacacttgacccctcgacccttgcttcgtgtactcgtgggacgcctaccatccagtagtagatattactacgtcgggctaggacgtccgcacggccccccgggaagggccgtggtagttgagtggacaggtatcgagttactacgtcgggtaacctacccgtttccgttacgtaacgttccggtaccgtaccttacgaagtacggtaacgtacggttacccaaccgtagttaccggaaccccggaccggtaaccgtaacccggttaccgaaaaccggggtaccctacgggtttacccttacccggtacgtaaacggtcgtacgtaaccctcgttacgtaccggtaccgcccgtaccgaacgtaccggtaccgttctttaagttccgttttacgtcggttacgtaccttaaggtaactttaacgtaaagttcggttagggtacgtaacgtcgttagggtacccgtaccgttaaggtaaccggttcgtttaccgtttttagggagtttttaccgggttacggggtacccgtaacgggtacgtaaaccggttaaccggg

SEQ ID NO: 95543 - DNA, 780 bp, Homo sapiens
  misc_feature: GYAE6OF02H62GN.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctctggtgcgctccagatcgggtcctgtcccagttgcacctgcaggagtccgggcccaggtacttgtagaacgccgtttacggagaccacttcggttcccctcgtacctgccttacgtcgttcctcgtggcgcctccatacgagttagagtattattactacgtgggtcgtgcgtccggacgaccggacccccggggtaaggggcttaggtacggtttaggtagttcgggactaaggttacgttacgtaaggtttaacgtacggttaccgggacccttaccgtttttaccgtacgtaacggttccgttaccgtaccgttacgaaacggtaccgttacggtaacggttaccgaacctaacgtccggtaacccgggccgggtaaacccgtaacccgggttaacccggtaaaccgggtacccgttaacgggttttacccctacccgggttaagaaaccgtccggttacgtacccgttcgtacggtaccgaccccggacctacggaaccgtaccgtacggtttctttacgtttaacgttcgttaggtcgtagtacgttaatacgttagtcggttagtacgtgtacggttggtacgtacccgttaggtacgtcgtttacgtttggacgtttacgggtaccgggtacaacggtaccgtacggtaacgg

SEQ ID NO: 95544 - DNA, 701 bp, Homo sapiens
  misc_feature: GYAE6OF02HR5R2.51.36.D03.1.454.CMB.1.raw
  modified_base (242)..(242): a, c, t, g, unknown or other
  misc_feature (242)..(242): n is a, c, g, or t
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
  modified_base (335)..(335): a, c, t, g, unknown or other
  misc_feature (335)..(335): n is a, c, g, or t
  modified_base (509)..(509): a, c, t, g, unknown or other
  misc_feature (509)..(509): n is a, c, g, or t
  modified_base (642)..(642): a, c, t, g, unknown or other
  misc_feature (642)..(642): n is a, c, g, or t
tcagcgatcgtatacacgaccggtgctcgatttagctgcgtcacgatctctcttgggggctttctgagagtcgtggatctcatgtgcaaagaaatgaagcacctgtggttcttcctcctcctggtggcggcctcccagatcgggtcctgtcccgagttgccacctgcgagggacgtccgggcccagggctttggagaagccttcgggagactctcgtcccctcaccgtgtctctgtcttcgnggccgctccattcgagtagtanatattactagngggcgtggatccggcaccgggacccccggggaagggccgtggtgttggatcgggcagttntcgagttacgtcgtaggacctcttctcgaacggttccgtcgtaccgtacaaggtcggttacgtaggtcaaccctagtaccggacgtccggaaccgaccgttccgaacggtaaccgacgtttccgtaccccgtggaactccgtacgaccctgtcgtccggaaccgtccggaaccncggtaaaccggtaccgttcggttttacgtttaacgtttttccggaggtttcgacggttacgtaatttaaacttacgggttaggtccgggttagttacggacgggttttcggacgttcccgtagtttaacgggngtttaccggtttagtacgttagggtttaccggaacggacggtacggtacgtaacccggg

SEQ ID NO: 95545 - DNA, 842 bp, Homo sapiens
  misc_feature: GYAE6OF02J0RCT.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgtctctgtccttcgtcggcggctcgatcagtagtagattatactacgtgggtctggtacgtccggaccgacggtccccccggggaagggtcgtcggtaagttcgggtacgttcggtctaacggttacgtaccgtagtttaacgttacgtacgggaacccttccgttacgttacctacgtccggttacgcgtacgaaggtacgtaccgtacgtacctaaccgacgttacgaccggtaccggtacgtaacccggttaccggaaacgggtccccgtaaccggttttaccgtaccccgtaacggtaaaccgggtacccgttacgtaaaccccttcgggttaccggtaccgggttaaccccggccccggtaacgaacccccgggtaacggttaccccgggttactttttacgggttttaaacccgttttcccgttaacgggtaccgttacccgttaagggtaacctttaggttaaaccggtttgggtaacggggttacgtacccgtagggttaccgggtaccggttacccggtaaacggtttacgggtaccggttttacgttttaacggaccgggttttaacggttaacccgggggtaccggtaaacgggtccggtaaacgggttaacccggg

SEQ ID NO: 95546 - DNA, 735 bp, Homo sapiens
  misc_feature: GYAE6OF02FZARZ.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggacttgtgaagccttcggagacactgtccctcacctgctctgtctctggcgctccatcagtagtagtattattactacgtggggctggacgtccggcgaccgggacccccccggggaaggggtccgtggtagttgggtagttcgggacgtagttactaccgtagtttacgtaccggttacgggtaacccctaccgttttccgttacgtaacgttccggtaccgacttaccgaaggtacgtcgacgtaccgtaccgtatacggaccggccggtaaccgtaccggtaccgaacgggtaccccgtaacgtttcccgtacccgtagaacgtccgttacgtaacccttcgtcggtaccgaacccgcccgacgtacggaccgtacggttctttttacggttactttgtacggtcgtacgttagtactttaagtaacgttggttacgggtactaacggtagggttcggtacgtacccgttaacggttacgggtacgtttacgttttaggtaacgttttcgggtttaccgggaccgtaacgggtaccgtaaccgggttaaccgg

SEQ ID NO: 95547 - DNA, 601 bp, Homo sapiens
  misc_feature: GYAE6OF02IMHAG.51.36.D03.1.454.CMB.1.raw
  modified_base (154)..(154): a, c, t, g, unknown or other
  misc_feature (154)..(154): n is a, c, g, or t
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (387)..(387): a, c, t, g, unknown or other
  misc_feature (387)..(387): n is a, c, g, or t
tcagcgatcgtatacacgaccggtgctcgatttagctgcgtcacgatctctcttgggggctttctgagagtcgtggatctcatgtgcaaagaaaatgaagcacctgtgttcttcctcctctggtggcgctcccagatgggtcctgtcccagttncacctgcaggagtcgggcccaggacttgtgaagccttcgganacactgtccctnacctgctctgtctctggcgctccatcagtagtagatattactacgtgggctggacgtccggcgaccggaccccccggggtaagggccgtggagttggacgttggacagtatcgtagttatacgtggacctaccttacttacgaacgtcgtacgactactaagacgtacgagtctaaccngtcgacgacggacacgtaccgaacggacctagttcctccgtagacgctacgtactctgtacgccgcacagaccgtgtactttgtattcgtagtcgagtagtactattaagtcggtaaggtcgtaacgtaggttcggtcgtaaccgttacgtacgggttacgttacgttttagacgtttacggttgggacccgtaagggtccgtaaggtaaccgg

SEQ ID NO: 95548 - DNA, 704 bp, Homo sapiens
  misc_feature: GYAE6OF02IEYB5.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcactgcaggagtcgggccaggacttgtgaagccttacggagacactcgtccctcacctgctctgtctcgtggcgctccatcagtagtagatattactacgtggggctggactccggacgaccggccccccggggaaggggtccgtgggtacgttagggtacgtttcgggacaaggttagtacgtagttacgttaccggtacgggaacccttacctttacgtacgtacggttccgtcgtcctacgaagtacggtccgaacgttcaacctacgtacggaacccggcgggaacctaaccggtacccgaacgggtaccctacgtttccccgtaccctagaaccgtccgttacgtacccttcgtcgggttaccgacccggtaccgtacgaacgtaccgtaccgggtcttttacggttacgttttcgagttcgtacgtaacgtattaataagttggttacgggtactagtagggtcggtacgttcccgtacgtaacggtacgtttcgtttaggtacgtttcggttacgggaccgtaaggcgtaacggtaaccgg

SEQ ID NO: 95549 - DNA, 631 bp, Homo sapiens
  misc_feature: GYAE6OF02F6DCM.51.36.D03.1.454.CMB.1.raw
  modified_base (167)..(167): a, c, t, g, unknown or other
  misc_feature (167)..(167): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggngtcgggcccaggacttgtgaagccttcggagacactgtccctcacctgctctgtctctggcgctccatcagtagtagatacttactacgtgggctggactccggcacggaccccccggggagggctggtagttggagttggacagtagtctagtttactacgtcggtacctacctttcttacgaacgttcgtcgacttacgaagtacgttacgacgtaccgacctagtcggacccgccggtaccgaccgtaccgaaacggacccttacgttccctacccgtaggaacgtcgtcgtacccttcgtacgtaccggacccgtccgacgacgaccgtacggttctttagttactttcgtgtgactagtattaatagtggttggacgtacgtggtcgtcgtaccttaggtacggtacgtttcgtttagacgtttacggtttcgggacctaagggtaccgaggtaaccgg

SEQ ID NO: 95550 - DNA, 670 bp, Homo sapiens
  misc_feature: GYAE6OF02GEFLS.51.36.D03.1.454.CMB.1.raw
  modified_base (243)..(243): a, c, t, g, unknown or other
  misc_feature (243)..(243): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcggcccaggacttgtgagccttcggagacactgtccctcacctgctctgtctcgtggcgtctcatcagtagtanattattactacgtggggctggtactcccggcgccggaccccccggggaagggtccgtggtagttgggattggactaggtatcgtagttatacgtcgggacccttacgttctacgtagtccgtcgtccgtacaaaggcgtacgacgtcacgtacgtacgcccggaacggtaccaccgtaccgaacggtaccgtacggtttcctacccgtaggaacgtccgtacgtacccgtcgttcggtaccgaccggtccgaccgaaccggtaaccggtcccggttaccttttagttacgttttcgcgttaacgtctaaggtacttaagtaacgttggtaggttactaggtagttcggacgttccgttaacgtacgggttacgttacgttttaggtacgttacgggtttacgggaccgaacggtcgacggtaaccgg

SEQ ID NO: 95551 - DNA, 620 bp, Homo sapiens
  misc_feature: GYAE6OF02JL1LC.51.36.D03.1.454.CMB.1.raw
  modified_base (546)..(546): a, c, t, g, unknown or other
  misc_feature (546)..(546): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactcgtccctcacctgctctgtctcgtggcgctccatcagtagtagattattactacgtggggctggagtcccggcgaccggccccccgggaaggggcgtggagttggattggacagtatcgagttactacgtcgggacctactttctacgaagtccgtcgctacgaagtcgtacgagtccactagtgtacccggcggaactaccggtaccgaaacggtacctacgttcctacccgtagaacgtctacgtacccttcgtacgtcggaccgtcccgacgtacgaccgtacgttcctttgttactttacgtcgtacgtacttagtaactttagttagtggtagggtanacgtggtaggtcgacgttacgttggtactttcgtttagtagttggttacgggaccgtaggtaccaggtaaccgg

SEQ ID NO: 95552 - DNA, 632 bp, Homo sapiens
  misc_feature: GYAE6OF02HB4DP.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagtatattactacgtgggctggactccggcgaccggccccccgggaagggtcgtggtagttggagttggctagtatacgtagttagtacgtaccgggtacctaccttacttacgtacgtccgtccgtactacgaaggtacgtacggacgtaccaacctacgtacggacccgtcgggacctaccgtacccgaaacgggtacccgtacgtttcccgtaccccgtaggacgtctccgtaacctcgtcgtccgacccgtcgcctacgacctacggtacctttagttcttacgtgtcgtactagtattagtagttggtgtcgtagtggtggtcgtaccgttacgtacggtgttactttagtacgtttggtcgggaccaggtacgtacggtaacgg

SEQ ID NO: 95553 - DNA, 644 bp, Homo sapiens
  misc_feature: GYAE6OF02IMSHV.51.36.D03.1.454.CMB.1.raw
  modified_base (213)..(213): a, c, t, g, unknown or other
  misc_feature (213)..(213): n is a, c, g, or t
  modified_base (473)..(473): a, c, t, g, unknown or other
  misc_feature (473)..(473): n is a, c, g, or t
tcagcgatcgtatacacgaccggtgctcgatttagctgcgtcacgatctctcttgggggctttctgagagtcgtggatctcatgtgcaagaaatgaagcacctgtggttcttcctcctcctggtggcggctcccagatgggtcctgtcccagttgccacctgcgaggagtccgggcccaggacttgtgagccttcggagacactgtcccctanaccctgctctgtcctcgtgcggctccatcagtagagtattacttactacgtgggcttggactccggaccacggccccccggggaaggggcttggtacgttggtattggctaggtatctagttataccgtacgggacctaccttcgttaccgtaagtcggtctcttccgaagtcgtacggtacgcctactacgtcgtacccgcggaccctacgtccgaaaccggtctaacgttccctcccgtagtaacgcctcgtaccctnttcgggccgaaccgcgataacccgtacgacgtctttttacgagttttccgagttccgtattaacggattattaagttggttacgggtgtaaccgtggtacggtctaccgttacgtacggtatttacgtttaggtcttaggtttccggaccggttaagccgttagtacccgg

SEQ ID NO: 95554 - DNA, 697 bp, Homo sapiens
  misc_feature: GYAE6OF02FNNPQ.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggtacgttgtgaacgccgttcggagacactgtccctcacctgctctgtctcgtcggcgcctccatcgagttagtagattatactaggtgggctggacgtccggcgaccggacccccggggagggcgtgggtagtgggtagttcggacgtagttacgtacgtagtttacgtacgtacggacccttacttccgttacgacggttccgtccgtctacgtaaggtacgtacgtacgtacaaccgtagtacccggaccggaccggtacctaccggtaccgaacggaccttacggtacctccgtaaggtcgacctacgtacccttgtacgtcgaccccgacgacgacgtaccgtacggttcctttgttactttccggtgttcgacttaacgatttaagttaacggttgggttaccgggtagtaccggtgttacgggtaccgtaaccgttacggtttacgggtaattttccggtttagttaacggtttcgggttagggacccgtaacggtaccggtacggtaacgg

SEQ ID NO: 95555 - DNA, 754 bp, Homo sapiens
  misc_feature: GYAE6OF02JXVGM.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcagggagtcgggcccaggacttgtgaagccttcggagacacgtcgtccctcacctgctctgtctctggcgctcatcagtagtagatattactacgtgggtctggactccggcgaccggccccccggggaagggctgggagttggtacgttggacagtactctagttactacgtacggtaccctaccgttcttacgtaacgtcgtcgtcgtacgaagtacggttacgaacgttccgaccagtccgaaccggtacggaccgtaccgtacccgaacggaccgtaacgtttacccgtacccgtggaaaccgtcgtcgtaaccgttccgtacggttaccgacccgggtacccgtaccgaaccggtacccgtaccgggtttaccttttacggtttaacgtttccgtttacggttcgtaaccgtttaacgtaatttaacgtttaaacggttgggtttacgggttacgtaaccggttggttacgggttaccggaaccccgtttaaccggttacggtaacggtttaccgtttttaggtaacggttttacggtttaccgggggtaaccgtaaaccgggtaccggtaaacgggttaacccggg

SEQ ID NO: 95556 - DNA, 641 bp, Homo sapiens
  misc_feature: GYAE6OF02FGUVF.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctggatccgggcacggcccccccggggaaggggcctgggacttggattgggactagtatctagttatacgtgggaccacctttcttacaagttcgtcgctacgaagagtcgagtcacatcgaccgcggacacgtaccaaggacctagtcctcccgtgaaacgtctacgaccctctggtacgacccgccgaccacggaccacgggttccttttagttacttttccgtgttcgacgttaagtaattaataacgttggtggggtacgtaacgtagggttcggtacgtaaccccgttaaggtaaccggggtaagttcgttttttaggaacgtttacgggttttaccgggggaccgtaaacggggtaccgaacggttaaacccggg

SEQ ID NO: 95557 - DNA, 651 bp, Homo sapiens
  misc_feature: GYAE6OF02HY70V.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagcactgtccctcacctgctctgtctcgtggccgctccatcagtagtagatattactacgtgggctggatccggcgacggtaccccccggggaaggggctaggtagttaggagttggacaggtatcgtagtttatacgtcggtacctacctttcgtactaacgtcgtacgctacgaagagttcgacgtcaacctagtcgaccgcggacaccgtacgaaacggacctacgttcctacccgtagaacgtctacgtacctctaggtcgacccgccgacacgaccgtacggtctttagttagtttcgtagttacgacgttaagtaattaacttaaggttcggtagggtactacgtacgggttaggtacgtaccgttaacgttaacgggtcgtttacgttttaggtaacgttttacgggttttaggggaacccgtaacgggtaccgtaacggttaaccgg

SEQ ID NO: 95558 - DNA, 802 bp, Homo sapiens
  misc_feature: GYAE6OF02HVV1M.51.36.D03.1.454.CMB.1.raw
  modified_base (187)..(187): a, c, t, g, unknown or other
  misc_feature (187)..(187): n is a, c, g, or t
tcagcgatcgtatacacgaccggtgctcgatttagctgcgtcacgagtctctcttggggctttctgagagtcgtggatctcatgtgcaagaaatgaagcacctgtgttcttcctcctcctggtggcgctcccagagtcggtacctgtcccagttcgccacctgcaggacgtcggcccaggtacttgngaacgtccttacggagacacgtcgtccctcaccgtgcttcgtgtctacgcggccgtctccattcaagttagtagattacttacgtacgtcggctggacgtccggacgacccggacccccgggtaaggtcgtaggtacgttaggtacgttcggacgttaagttactacgtaacgtttaacgttaccggtacggttaaccccttaccgtttacgttacgtaacgttccgtaccgttacgtacgaaagtcgtacgtacgtacctaccgtaagtccgaccgtaccggaacgtaccggtaccgtaaaccggtaccttacgtttccgtacccgtaggtacgtacccgtacgttacccgtgttacggtaacccgaccgtccgtaaccgacgtacccgttaccgggtttcttttttaacgggtactttccggttacggtaccgttaagttaacgtaacgtttaacgtttaaaggttcgggttacggttaaccggtacgtttacggggttcgttaacccggtacccgtttaaccgggtacggttaaccgttttcgttttaacggaggttttacccggggtttaccgggacccgttaaacggtaccggtaaccgggttaacccgg

SEQ ID NO: 95559 - DNA, 541 bp, Homo sapiens
  misc_feature: GYAE6OF02FTDYG.51.36.D03.1.454.CMB.1.raw
  modified_base (394)..(394): a, c, t, g, unknown or other
  misc_feature (394)..(394): n is a, c, g, or t
  modified_base (434)..(434): a, c, t, g, unknown or other
  misc_feature (434)..(434): n is a, c, g, or t
  modified_base (448)..(448): a, c, t, g, unknown or other
  misc_feature (448)..(448): n is a, c, g, or t
tcagcgatcgtatacacgaccggtgctcgatttagctgcgtcacgatctctcttgggggctttctgagagtcgtggatctcatgtgcaagaaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactatggggctggatccggcagcccccccgggaagggctggattggattggcagtatctagttatactgggaccaccttctacaagtcgtcgctcaagtagtcgagtcacatcgacgcggacacgtcaaggcagtctccaganctgacctcgtgcgaccgcgcagcacgtctttagtctttcngtcgctagattaanacgtggtggtagacgtgtcggtcgtcctaacgtacggagttcgttttaggaactttaggtttcggggacctaacgggacgtaaccggtaacgg

SEQ ID NO: 95560 - DNA, 799 bp, Homo sapiens
  misc_feature: GYAE6OF02FN9BB.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagtagtagatattactacgtggggctaggtactccgggcaccgggtaccccccccgggggaagggggtccgtagggtagttgggtaacgtttcgggccgtaagttacgtacgtaaggttttaactaccggttcggggaacccttacccgtttcgtttaccgaacgtttccggtccgtcttaccgaaggacggttcggaacgttaccgaacctagtaccgaacccggtaccgggaaccctaacccgggttaccaaacggggtaccctaacggtttccctaacccgttacggaaacgtccgttaccggaacccctttcggttcggtaccgggtaccccggacccgtacgtacggtaaccgtaccgggttacgtttttacgttacgtttttccgacggtttacgaccgtttaaggtaacttaagttaacgttggttacgggtagaacggttagggttcggttaccggaaccttaaccgggttaaaccgggtgtttaaccggtttttcggaaggttttacggggtttaccggggtaaccgtaagggtaccgtaccgggtaaaccggg

SEQ ID NO: 95561 - DNA, 717 bp, Homo sapiens
  misc_feature: GYAE6OF02IMJ4H.51.36.D03.1.454.CMB.1.raw
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagatgggtcctgtcccagttgcacctgcgaggagtcgggcccaggtacttgtgaagtccttcgggagaccactcgtccctcacctcgctctgtctcgtggccgtctccatcagtagtagtatatttactacgtggggctaggacgtccggacgacccgggaccccccggggtaagggtccgtaggtacgttaggtacgttggacgtagttacgtacgtagttacgtacgtaccggtaccttacctttcgtacgtaacgtccgtacgtactacgaagtacgtaccgaacttaccgacctacgacggtacccggtaccgacccgtaccggtaacccgaacggtacccgtaacgttaccctcccgtaagaaccgtcgtaccgtaccgtacttcggacgcccgaccgtacgaccgtaccgtacggtttacgtttagttaacgtttcgttacggtagtacgttaagttacgttaataaggttggttaggtagtaacgtcgggtagtccgtacgtttaccggaacggttcgttaccttttaggtactttagggtttaccggaaccgtaggtacctaacgggtaaccg

SEQ ID NO: 95562 - DNA, 676 bp, Homo sapiens
  misc_feature: GYAE6OF02GM8B0.51.36.D03.1.454.CMB.1.raw
  modified_base (589)..(589): a, c, t, g, unknown or other
  misc_feature (589)..(589): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagaccactcgtccctcacctgctctgtctctggcgctccatcagtagtagatattactacgtgggctggatccggacaccggccccccggggaaggggctaggacgttggagttggctagttactctagtttactacgtcgggacctaccttcgttaccaaggttccgtcgtacttacgaaacgtacgtacggtacgtccaacctagttaccggacccggccgggtaacctaccggtacccgaaacgggaccctacggtttaccctccccgtaaggtaacgtccgtacgtacccttcgtacggtacgaccccggtccgacgaacgtaccgacgttcttttagtactttcgtggttacgtacgttaagtattaacgttaagttcggtgggttanacggtagttggcgttaccgtaacggtacgggtacgtttcgttttagtacgttaggtttcgggaacgtacggtagtaacggtaaccgg

SEQ ID NO: 95563 - DNA, 691 bp, Homo sapiens
  misc_feature: GYAE6OF02HRASP.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctcgtggcgcctccatcgagtagtagatacttactacgtggggctggacgtccggacgaccggcccccccgggggaagggcgttggtagttaggtagtttgggcctaggtattacgtaagtttacgtaccgtcgggaacccttaccgtttcttacgtaacggttcgtcgtccttacgaaggtacgttacgacgtaccacctacgtacgacccggacggacctaaccggtacccgaaacggtaccctacgtttaccctacccgtagaaccgtcgtaccgacttcgtcgtacgaacccggcccgacgaacgaccgtacggttctttcgttattccgttggttacacgttagtaacttagttaacggttggtcgggttagtacgtcggttcggtacggtaccgttacgtacgggtagttacgttttaggtagtttacggggttcgggaacctaacggtcggtaacggtaccgg

SEQ ID NO: 95564 - DNA, 720 bp, Homo sapiens
  misc_feature: GYAE6OF02I6DSU.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctccgtggtggcgctcccagatggtcctgtcccagttgcacctgcaggagtcgggcccaggacttgtgaagccgttcggagacactcgtccctcacgtgctctgtctcgtggcgcctcaatcagtacgtagtatacttacgtacgtgggcgtaggactcccggcgaccggccccccggggaagggtccgtaggtacgttaggtcgttcggactaggtactacgtagttacgtacgtacggacctaccttcgttacgtaacggttccgtacggtacctacggtaaacgcggttacggtacgttacgactaagtacgacccggacggtacctaacggtaccgaaacgggtaccctacgttaccctccgtaacggtaacgactccgtaaccgttcgtacgttcggaaccccggtccggtaacctacgtaacccggtcgttaccgttttagttaaccgttttccggtagtaccgttacgtaaagtacgttaaagttacggtggtacgggtagtaacgtgttacgggtacgtacccgtttagaccggtaactttcgtttaaggtaacgtttcgggttaccggggactaacgggtacgtacggtaacgg

SEQ ID NO: 95565 - DNA, 713 bp, Homo sapiens
  misc_feature: GYAE6OF02FQTQE.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcgctccatcagttagtagatattactactggggctggactccggcgacggccccccgggaaggggctggagttggattggctagtagtcagttactacgtagggaccctaccgttccttacaacggttccgtccgtacgtacgtaaacggagtaccgtacgtaccaaccgtaacgttacggacccggaccgggtaaccgtaacccggtacccaaacggggtaccctaacggtttccctaccccgtacggaaacggtccttccggtaaccctccgttcggtccgtaacccggcccgtaccgacggaaccgtccgggtaccgtttttagttaacgttttcgtacgttcgtaccgttaagtacttaagttaagttcgggttaggggttacgacggtagtcgggtacgtcccgttaacggtaccgggtagtttaccgtttttaggacgtttagggtttcggggaaccgtagggtaccgtaacggtaacgg

SEQ ID NO: 95566 - DNA, 699 bp, Homo sapiens
  misc_feature: GYAE6OF02F839J.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtgttcttcctcctctggtggcgctcccagatggtcctgtcccagttgcacctgcaggagtcgggcccaggacttgtagaagccttcggagacactcgtccctcacctgctctgtctctggcgctccatcagtagtagatattactacgtgggctggactccggcgaccggaccccccggggaagggtccgtggtacgttggtagttggctagtactactagttatacgtcggaccctaccgttcgtactaagtcgtcgtctacgaagtacgtcgagtcaacgatacgaccgacggacaccgtaaccgaacggtaccctacggttcctcccgtacggaacgtcctacgtacccttcgtcggtacgacccgtccggacaacggtaccgtaccgggttactttttaggttaaccttttccggtacgttacggtaccgtttaacgtaagtttaacgttaaagttcgggtttaggggtagtaaccggtgggttccggttacggtaaccccgtttaacggttaccgggttacgtttacgttttacggaacgttttcgggttaccggggaacctaacgggtaccgtaacgggttaacccgg

SEQ ID NO: 95567 - DNA, 639 bp, Homo sapiens
  misc_feature: GYAE6OF02F8GCT.51.36.D03.1.454.CMB.1.raw
tcagcgatcgtatacacgaccggtgctcgatttagctgcgtcacgatctctcttgggggctttctgagagtcgtggatctcgatgtgcaagaaaatgaagcacctgtgttcttcctcctcctggtgcggctcccagatgggtcctgtcccgagttgcacctgcgaggagtccgggcccaggacttgtgaagtccctttcggagacactgtccctcgacctgctctgtctctggcgctccatcagtagtagatattactacgtgggctggatccggcacggccccccgggagggctggattggattggcagtatctagttatacgtgggacctaccttcttcaagtcgtcgtctacaagcgtcgagtcacatcgaccgcggacacgtccgaaggacctacgttcctcccgtagaacgtctacgtacctcgtcggtccgacccggcgactacgaccgtacggttccttttggttactttctggtcgtacttaggtaattaacttaagtggttacgggtagtaccgtagggttcggtaccggtacccgttaacggtaacgggttacgtttacgtttttacggtaaggttttaggttttacccgggggaacctaacggggttaccgtaacgggttaacccggg

SEQ ID NO: 95568 - DNA, 820 bp, Homo sapiens
  misc_feature: GYAE6OF02JX8MR.51.36.D03.1.454.CMB.1.raw
  modified_base (197)..(197): a, c, t, g, unknown or other
  misc_feature (197)..(197): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcgctcccagatgggtcctgtcccagttgcacctgcaggagtcgggcccaggacttgtgaagccttcgganacactgtccctcacctgctctgtctctcggcgctaccatcgaagtagtagattacttacgtacgtgggcgtggactcccggcaccgggacccccggggagggccgtagggtacgttaggagttcggacctagtattacgtagttacgtacggtcgggacccttacctttacgttacgtaacggttccgtcgtaccgttacgaaacggttacggtacggtactaaccgaaccgtaagtcccgggaaccggtacccggaaccgtaccggtaaccgtaacgggtacccgttacgttaccccgttccgtacgggtaaccgtccgttaaccgtacccgttcggtaccggttaccggacccggtaccggttaaccgaccgggtaacccgttaaccggttccggtttttaaaccggtttcgttttaaccggttcggttacgtacgttaacggttacgttaaagtttaccggggttacgttaaccggggtagttaacccggttcgggtttaagggttccgttaaaccccggtaaggtttaccggggttaaccgttttcggtttttaacggtaacggttttacgggttaacccggggaaccgtacggttaccgggtaaacccggttaaccgg

SEQ ID NO: 95569 - DNA, 792 bp, Homo sapiens
  misc_feature: GYAE6OF02IWUV5.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcgctcccagatgggtcctgtcccagttgcacctgcaggacgtccgggacccaggtactttggtagaacgtcccgttcggaagacctaccgttcgtccccttacgacccgttgccttcttcgttcctccgtgggcccgtctaccgatccgagttaagtacgtaattacttacgtacggtcggggtcgtacggacgtcccggtacggaccccgggtacccccccggggtaaggggtccgtacgggtaggttcgggtacgtttggactaacggttactacgtagtttaacgtacggtaccggtacccttaccgtttacctacggtaacgttccgtaccgtactacggtaaacgacgttacgtaacgtaccgtaaccgacgttacggacccggtaccgaaacgtaccgtaacccggtaacggtacccttaacgtttacccctacccggttaagaacggttcctaaccggttacccgttacgttacggaccggtaacccgcccgtaacgacggtaccgtccggtttctttaacggttcttcgtgttgtaccgtagtaattacgttacggtggtcgggtactaggtcgttacgtcgtaccggttacgtacggtacgtttcgtttaggtacgtttacgggtaccgggtaacgtacgtacggtacgtaaccgg

SEQ ID NO: 95570 - DNA, 796 bp, Homo sapiens
  misc_feature: GYAE6OF02FY7K2.51.36.D03.1.454.CMB.1.raw
  modified_base (167)..(167): a, c, t, g, unknown or other
  misc_feature (167)..(167): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctctggtggcggctcccagatgggtcctgtcccagttcgcacctgcaggngtccggcccaggacttggtagaacgtccgttcggagacactcgtccctcgacctgctctgtctcgtggccgtactccatcgtagtagtagtacttaattaccgtagtcggggcgttacgggtaacgtcccggtaccgaccgggaccccccccgggggaagggggtccgtagggtacggttgggtaacgttcgggactaggttacgtacgtaacgttagtacgtacgggtaacccttaccgtttcgttacgtaacgtcccggtcgtaccgtacgtaaacgtcggtacgtacgtaccgtaaccctagttcggaacccggaccggtaaccgtacccggttaaccggaacggtcccgtaacgtttccccgttaccgtaacggtacgttccgtaaccgtaccctaccggtccgtaccgacccggtaccacgtaccgaccgttaccggtttctttaccgtttacgtttcgtacgtcgtaaccgtagttaacttaagttaccggtaggttcgggtagtacgttaggttcggtaccgttaccggttaacggttaccggttaacgttttaccggttttagttaacggtttacgggttaccggggtaacggtaaccggtaccggtaacggttaacccgg

SEQ ID NO: 95571 - DNA, 600 bp, Homo sapiens
  misc_feature: GYAE6OF02F13KZ.51.36.D03.1.454.CMB.1.raw
  modified_base (366)..(366): a, c, t, g, unknown or other
  misc_feature (366)..(366): n is a, c, g, or t
  modified_base (519)..(519): a, c, t, g, unknown or other
  misc_feature (519)..(519): n is a, c, g, or t
tcagcgatcgtatacacgaccggtgctcgatttagctgcgtcacgatctctcttgggggctttctgagagtcgtggatctcatgtgcaagaaaatgaagcacctgtgttcttcctcctcctggtggcggctcccagatgggtcctgtcccagttgcacctgcaggagtccgggcccaggacttgtgaagccgttcggagacactgtccctcacctgctctgtctcgtggcgctccatcagtagtagatattactacgtggggctggtactccggcacggcccccccggggaagggcgtggagttgggagttggacagtatcgaagttactacgtgggacctaccttcttacgaacgtcgtctcctnaagacgtcgagtcacctatcggaccgccggactaccggtacgaaggacccgtacgttccgttccccaggtaacgcttacgacccttcgacgtcgtacccgccgcacgacctcgtctttgtactttcgtgtcgtactagtatatagtgtgggtntagtacggtggtcgtctaacgttacggtacgttacgtttagagtttacggtttcgggacgtaacgggtactagggtaacgg

SEQ ID NO: 95572 - DNA, 726 bp, Homo sapiens
  misc_feature: GYAE6OF02G6CKD.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtccctagttgcacctgcaggagtccgggacccaggtacttggtgaacgcccttcgggagacctacgtcgtcccctactaccgtgtcctcttcggtcctcgtgggccgcctccatcgagttagtacattattactacgtgggtctggacgtcccggcgtacccgggaccccccgggggtaagggcgtggtaagttcggagttggtccgtaaggtactacgtaggttactacggtacgggtaaccctcctttctacgtaacgttcgtcgtcctagtacgtacgtcgtagtaccaccgtagtaccgcccgtacggaaccgtaccgtaaccgaacggtaccctacgtttacccgtccgtaacgacgttcctcgtaacccgtgttaccggtcgtaacccggccgtacctaacggaccgtcggtttctttacggttactttcgttacgtcgtactagtaacgttagttaacggttgttacgggtcgtaacgtgggttcgtacccgtaaccggttacgtaaggttccgtttagtttttacggagttttaccgggtagggaccctaaggtacccggtagtaacccgg

SEQ ID NO: 95573 - DNA, 691 bp, Homo sapiens
  misc_feature: GYAE6OF02IIMXP.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactcgtccctcacctgctctgtctctggcgctccatcgagtagtagatattactacgtgggtctggatccggcgacggacccccggggagggcgtggagttggagttcggcagtatacgagttactacgtacggacctaccttctacagtccgtcgactacgaagagtcgacgtacaactactacggaccgacggaaccgtaccgtaccgaacggaccttacgttccgtaccccgtagaacgtctacgacccttcgtcggtacgaccggcccgtacgaacggtaaccgttccgttacttttacggttacttttcgtaggttcgacgttaagaactttagttaaagttcgggttagggtacgtaacggttcggttagggttaccggtaccgtttaaccggtacgggttacgtttccggtttttaaggttacgtttaacggggtttttccggggaaccgttaaacggggtcccgttaaacgggttaacccggg

SEQ ID NO: 95574 - DNA, 735 bp, Homo sapiens
  misc_feature: GYAE6OF02H9IPQ.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctctggtggcggctcccagatgggtcctgtcccagttgcacctgcaggagtccgggcccagggtactttgtagaagtccctttgggaagacactcgtcccctcacctgcctctgtctcgtggcgtcctcatcgagtagtagattattacgtacgtgggctggactccgggcgaaccgggccccccggggaaggggtacctgggtaacgtttcgggtaagtttcgggactaggttacttacgtagtttacgtaacgtccggggaaccttaccgtttctacgtaagtccgttacgtctacgtaagtacggtcgtacgtacaaccgtcgtacggacccggaccggaactacccggtaacccgtaacggtacctacggtttccctacccgttggaaacgtccgttacgtacccgttcgttacggtccggacccgaccgaccacggtaccgtaccggtttcgttttagtactttccgtagggtctacgttaaatagttaacttaaggttgggtacgggtataaccgttgggttacggttacgtcccttaacgggtagggttacctttcgtttaacgttcgtttacggttccgggacccgttaaaggcccgtaaggtaacccgg

SEQ ID NO: 95575 - DNA, 686 bp, Homo sapiens
  misc_feature: GYAE6OF02IRV65.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggacgtcgggcccaggtacttggtagaagccttccggagacactcgtccctcacctgctctgtctctggcgctccgatcgagtagagattattactacgtgggctggactccggcgaccggacccccggggaagggcttggagttcggtagttcgactaggtactacgtagttacgtacgtacggaccctaccttcgtacgtaagtccgtacgtcgttacgaaggtacgtacgtaacgtacaaccgtatacggacccgacggaccgtaaccgacgtaacggacccgtagtttcccgtaccgtagtaacgtcgttacggcctacgtcgtacggacccgtccgtacgaacgtccgtacgtctttagttacgtttcgtgtaccggtaccttaaggtaacttaagttaggttcggttagggacgtaaccgtgggtaccgtcgggttaaccttacgtaccgggtttacttacgtttttacgtaacgtttcgggttacggaaccgtaacgggtcaaacggttaaccgg

SEQ ID NO: 95576 - DNA, 658 bp, Homo sapiens
  misc_feature: GYAE6OF02FQ1CC.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtcccctcgacctgctctgtctctggcgctccatcagtacgtagatattactacgtggggctggatccggcaccggccccccgggaagggctggagttgggattggcagtatcgagttacgtacgtcggtaaccctaccttcgttacacggttccgtcgtaccgtacgtaaagtacgtacgacgtaccaaccgagtacggacccggtacggaacctaccgtaccgaacggtacccgtacgtttccctacccgtaggtaacgtcttaccggtacccttacgtcggtaccggtacccggccgtaccgacggtaccacggttaccttttgttactttcgtagtcgtacttagattacgttaagtcggttagggtatacgagttacggcgtacccgttaacgtacggtagttcgtttacgtagttacgtttcgggaccgtaagtaccggtacgtaacgg

SEQ ID NO: 95577 - DNA, 731 bp, Homo sapiens
  misc_feature: GYAE6OF02ID48U.51.36.D03.1.454.CMB.1.raw
  modified_base (397)..(397): a, c, t, g, unknown or other
  misc_feature (397)..(397): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggtacttggtagacgtccgtttcggacgaccacgtcgtccctactacctgcttcgtgtctcgtggcgctcatcagtagtagtatacttacgtacgtggggctaggacgtccggacgaccgggccccccggggaaggggtcctggtacgttgggtacgttcgggacagttatacgtaggtttacgtacgtcggaccttaccgtttactcgtacgtcgtcnctagtacgagtcagtaccacgagtacgccgtacggacctacggtacccgaacggaccttacgttcctaccgtaaggaactcgttaccgccgttacgtcggtacgacccggccgtacgacgtaccgtacgtttacgttttacgtttgttttccgtaggttacctaacgttaacgtacttaagttaacggttcgggtagggttactaaacggttcggggttacggttaacccgtcccgtttaaacgggtacgggtacgtttttaccgtttttagggtacgtttttacggggttacccggggaaccgtaacgggtacccgtaaggtttaaccccggg

SEQ ID NO: 95578 - DNA, 739 bp, Homo sapiens
  misc_feature: GYAE6OF02HLUUD.51.36.D03.1.454.CMB.1.raw
tcagcgatcgtatacacgaccggtgctcgatttagctgcgtcacgatctctcttggggggctttctgagagtcgtggatctcatgtgcaagaaaatgaagcactgtggttcttcctcctcctggtggcggctcccagatgggtcctgtcccagttcgcacctgcgaggagtccgggcccaggtacttgtagaagccgttcggagacactcgtccctcacctgcttctcgttctcgtcggcgcctccatacgtagtagtagtattactttacgtacggtggggtcgtacggtacgtcccgggacgtacccgggacccccggggaaggggtcgtaggtacgttgggagttcggacgtaagttactacgtaagttaactaccggtcggaccttaaccttcgttacgacggttccgcgtactacgaaggtcgtcgacgtaccacgtagtaccggaccgtaccggacaccgtaccgaacggtaccgtacgtttacccgtacccgtagtaacgtccgttacgtaacccgttcgtacggttacccggacccgtaccgacctaaggaccgttcgtttacgtttacggttacttttcggtacgttacgtaacttagtaattaagttaacggttggtaacgggtagtacggtagggtttacggtaccgttaccgttaccggtagggtacgttttacgtttaggttacgttagggtttacccggacgtaacggaccgttaacggtaccgg

SEQ ID NO: 95579 - DNA, 899 bp, Homo sapiens
  misc_feature: GYAE6OF02HUFNC.51.36.D03.1.454.CMB.1.raw
tcagcgatcgtatacacgaccggtgctcgatttagctgcgtcacgatcgtctcttgggggctttctgagagtcgtggatctcatgtgcaagaaaatgaagcacctgtgttcttcctcctctggtgcgctcccagagtcgggtcctgtccctagttgacctacctggcagggacggtccggggacccagggtactttggtacgaacgtcccgtttacgggaacgtaaccaccgttcggtcccccttaccaccccttggccttaccgtcggttcctccggttcgggacccgggtcccttaccaagttaccgtaaaggttacggttaagtaactttaactttaccggttaacggtcgggggtaccgttacggggtaccgttacccgggacccggtaaccccggggacccccccgggggtaaaggggtcccgttagggtaacgtttcggggtaacgtttacgggaccgtaaggttaacttaccgtaaggttttaacggtacggttaccggggtaacccctaccgttttaccgttaccgtaacgttccggtaccgacgttacgaacggtacgtcgaacgtacaccacgtacgacccgaccgacctaccgaccgtaacggcctacggttcctacccggtagacgtcgtacgtacctcgtacggaccgtaaccgccgtaacgtacggtacccgttaaccggttctttaccggttacgttttccgtcggttagtaccgttaaggttaacgttaaacgtttaacggtacgggtgggttaaccgtacggttagggtaccggttaccggtaacccgttaaggtacggttaccgttttacggttttacggtacggttttaaccgggttcccggggaaaccttaaccgggtaccggttaaccggtaacccgg

SEQ ID NO: 95580 - DNA, 766 bp, Homo sapiens
  misc_feature: GYAE6OF02GY8WF.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggactcccagatgggtcctgtcccagttgcacctgcaggaggtccgggcccaggacttggtgaagccgttcggagacactcgtccctcacctgcttctgtctcgtggccgctccatcgagtagtagattacgttacgtcgtgggctggacgtcggcaccggcccccggggagggtcgtaggtaggttggagttcggctaggtactacgtaagtttacgttacgtacgggtacccttaccttcgttactaacgtccgtcgtactacgaaggtacgtacgacgtaccaccgtacgtacggacccgaccggaaccgtaccggtaaccgaacggtaacccgttaacgtttccctccggttaacggaaccgttccgttaaccgtacccgttacgtacggtacccggacccggtaacccggaccgtaccgggtaaccgtccggtttacttttacggtttaccgttttcggttggttaccgtaacgttaagttattaaacgtttgggtacggtagggttaccgaggttcggggttacgggtaccgttacccggtttaacggtacgggttacttttacggtttttaagtacggttttacggggttaccggggacccgttaagggacccggttaacggttaacccgg

SEQ ID NO: 95581 - DNA, 736 bp, Homo sapiens
  misc_feature: GYAE6OF02I1AAG.51.36.D03.1.454.CMB.1.raw
  modified_base (212)..(212): a, c, t, g, unknown or other
  misc_feature (212)..(212): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatcgggtcctgtcccagttgacacctgcaggagtccggcccaggacttgtgaagccttggagacactcgtccctnacctgcttctgtctcgtggcgctccgatcagtagtagtattacttaacgacgtgggtctaggacgtccggacgaccggcccccggggaaggtcgtaggacgttggacgttcggacgtaaggttctacgtaagtttacgtaccggtacgggtaccctaaccgtttcgttaacgtaacggttcccgtaccggtccttaacggaaacggtacggttaccggtaacgttacccgaacccgttaaacgtccggtaacccggaccggtaaccgtaacccgggtaacccgtaaaacgggtacccttaccggttacccttaccccggtaacggtaaccgtccgttaccggaccgttcgtacggtaccgaacccggaccgacgacgaacccgtggttaccttgttacttgtagtacgtaccaagttaattacgtaagtggtacgggtacacgtggtaccggtcggtaaccttaaggtcggtaaccttgttttagagtttcggtaccgggacgtaacggtacgacgttaaccgg

SEQ ID NO: 95582 - DNA, 864 bp, Homo sapiens
  misc_feature: GYAE6OF02G7H91.51.36.D03.1.454.CMB.1.raw
  modified_base (227)..(227): a, c, t, g, unknown or other
  misc_feature (227)..(227): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggacttgtagaagtcccttgggagactactcgtcccctcgacctgcctntcgtctcgtgggccgctccatcgagtagtagtatacttacgtacggtcggggcgtggacgtccggccgaccgggaccccccggggaagggtcgtcgggtagttacggtagttcggacgtaaggtacgtcgttaacggttacgtaacgtccggggtaacccttaccgtttccgttaccgtaacggttccggtaccgtaccgtaacgaaacgggtacggttaccggtaacggttacccgaaccgtaacgtaccgggaaccccggtaccgggtaaacccgtacccgggtttaacccgaaacccgggtaaacccggttaccgtttacccgttaccccgtaggtaaacccggttccgttacccggaccgtttaccggtaccggtacccggacccggtacccggaccgtaaccggtaccggttaacccgttcggttttacgtttacggttttaccgttacggttcgggtaacttaacgggttaacttaaacgtttaaggtacggggtttacggggtaacgtaaccggttacgggttcgggttacggttacccgtaacggttaacggtaccggtttacgttttaaggtacggttttagggttaccggggtaaccggtaccggtaccggtaacgggtaacccggg

SEQ ID NO: 95583 - DNA, 720 bp, Homo sapiens
  misc_feature: GYAE6OF02FLZP5.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgccacctgcaggagtcgggcccaggacttgtgaagtccttcgggagacactcgtccctcacctgctctgtctcgtggcgtctccatcgagtagtagattacttaactacggtgggtctaggacgtcccgggcaccgggaccccccgggggaaggggtctagggtattgggtagtgggtactagttactacgtagtttacgtaccggtacgggtacccttacctttcgttaccgtaagttccgtccgtccgttaacgaacggtaacggttacgacgttaccaaccgtacgtacggaacccggaccggaaccgtacccggtaaccgaaacggtaccgtaacgtttccctacccgtagtaaaccggtcgtacgtaccgttcgtacggtccggtcccggacccgtacgaacgtaccggtacgtttctttaggtttactttaccgtaggttctacgtataactttaagtacggttggaggttacgtagtacggtaggttccgaacgttacggtacgtgtttacgttagtacggttaggttccgggtacgaacggtccgaaggttaaccgg

SEQ ID NO: 95584 - DNA, 706 bp, Homo sapiens
  misc_feature: GYAE6OF02HKBLC.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggacttgtgaagccttcggagacactgtccctcacctgctctgtctcgtggcgctccatcagtagtagatattactacgtggggctggactccggcacggccccccggggaagggctggtagttggattcggacagtactcgtagttataccgtgggtaccctacctttcttacgtaacgtcgttccgtctacgtaaacggtagtaccggagtaccaacgtacgtcgaaccccggtcggaaacctaccggtacccgaaacggtaccctacggtttaccctaccccgtagaaacggtccgtacgtacccgttcttcgggtaccgacccgggtacccgcgaaccggaaccgtaccgggttcttttacggttaacttttcgtacggttcgtaccttaaggtacgtttaaagttacgttgggttacgggtagtaccgtagggttggtaccggtaccttaacggtacgggtaacgtttcgttttaagacgttttacgggttcgggaccggaacggtccggtaacgtaaccggg

SEQ ID NO: 95585 - DNA, 761 bp, Homo sapiens
  misc_feature: GYAE6OF02JTJYD.51.36.D03.1.454.CMB.1.raw
  modified_base (202)..(202): a, c, t, g, unknown or other
  misc_feature (202)..(202): n is a, c, g, or t
  modified_base (286)..(286): a, c, t, g, unknown or other
  misc_feature (286)..(286): n is a, c, g, or t
  modified_base (679)..(679): a, c, t, g, unknown or other
  misc_feature (679)..(679): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcgctcccagatgggtcctgtcccagttgcacctgcaggagtccgggcccaggtacttgtgaagtccttcgggaanaccactcgtcccctcaccctgccttctcgtcttcgtcggcgtcctaccatccgtaagtacgtagtattattacgtacgtcgggngtacggacgtccggccgacccgggaccccccggggaaggggtccgtgggtaacgtttcggggtagttacgggcgtaggttactaccgtagttaccgtacgtaccgggaacccttaccgttaccttacgtaacggttccgtccgtaccgtacggtaaggtaccggttacggtaccggtacctaccgtaacgtacggaaccccggtacgggaccctaccggttacgaaacccgggtaccaccggttttaccctaccccggtaggtaaccgtccgttaccggtacccgttcgttaccggtacccggacccggcccgtaccgtaccgaccggtacccgtttaccgttcgttaccgtttacgtgttacgtcgtaagtaactttagtaagttggtcgtntacggtgttacggtcgtaccgttaacgttcggtacgtttagttacgttagttcggttacgaacggtacggtacgacggtacg

SEQ ID NO: 95586 - DNA, 660 bp, Homo sapiens
  misc_feature: GYAE6OF02JO6RX.51.36.D03.1.454.CMB.1.raw
  modified_base (401)..(401): a, c, t, g, unknown or other
  misc_feature (401)..(401): n is a, c, g, or t
  modified_base (613)..(613): a, c, t, g, unknown or other
  misc_feature (613)..(613): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcgctcccagatgggtcctgtcccagttcgccaccgtgcgaggagtccgggcccaaggtacttgtagaacgtccgttcggagacactcggtcccctcacctgcctctcgtctcgtcgggccgacctccaatcgtaagtacgtagtacttattactacgtggggctggactccgcgaccggacccccggggaggtctggtagtggtagttcggactagtacgtctagttactacgtcggtacctaccttctacgacgtccgtacgtctagtaacgngttacgacgtaccactcgtcgaccggtcggtactaccgtacgaacgtacctacgttcccaccgtagacgtacgttccgaccttgtacggtaccgacccgcccgacgtaacgtcccgtaacgtttcgtttacgtttacgtttcgtacggttacctcgtaaattattaacgtacggttggtggtacgtgtggtcgtaccgtacgtacggtacgngttttcgtagttacgttacggtcggaccgtaggacgtacggtaaccg

SEQ ID NO: 95587 - DNA, 906 bp, Homo sapiens
  misc_feature: GYAE6OF02GUAE3.51.36.D03.1.454.CMB.1.raw
  modified_base (252)..(252): a, c, t, g, unknown or other
  misc_feature (252)..(252): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcgctccagatgggtcctgtcccagttgccaccgtgccgagggacgtccgggccctagggtacttggtggaacgtccgttcgggacgactaccgtgtccatccacctgccttcgtcgtccgttcgngggtccggaccttccagttccgtaagttaagaagtaacttaattaccgtaacggtggggtcctagggtacgtcccgggcgacccgggggaccccccggggaaggggtccgttagggtagtttcggggacgtttcgggaccgtaaggttactacgttaaggtttacgtaaccgttcggggtaaccctaaccctttacgttaccgtaacggttcccggtcgaccttaacgaacggtacgtcggtaacgttccgtaaaccgtagttaccgggaccccggaacggtaccctaaaccgggtacccggtaaaccgggtaccttaccgggtttacccccgtaacccggttagggtaaacccggttacccgttaccggttaacccggttcccgtacccggggtttaacccggaccccggggttaccccgaaccgggaacccggtaacccgggtttaaccggtttccgttttaaccggttttaaccgtttccgggttacgtttaacccgttgttaaacgttaccgttaaaggttactttaagggtcgggtaagttaccgaagggtttccgtacggtaacgttacccggtaacgggtttaccgttacggttttacgaacggttttacgggttaccgggaccttaagggacccggttaaccgggg

SEQ ID NO: 95588 - DNA, 819 bp, Homo sapiens
  misc_feature: GYAE6OF02IY1QD.51.36.D03.1.454.CMB.1.raw
  modified_base (222)..(222): a, c, t, g, unknown or other
  misc_feature (222)..(222): n is a, c, g, or t
tcagcgatcgtatacacgaccggtgctcgatttagctgcgtcacgatctctcttgggggctttctgagagtcgtggatctcatgtgcaaagaaaatgaagcacctgtggttcttcctcctcctggtggcggctcccagagtgggtcctgtcccagttgccacctgccgagggtaggtccgggaccctagggtacctttggtagaacgtccgtttacgggaanacctacgttaccgtcccctccgaaccctggccttcttcgtccttcgtacgggccgtcctaccgattacgtagtaacggtagtaattaacttacgtacggtagggtcgtggtacgtcccggcgacccgggacccccggggtaagggcgttacggagttcggtaggtttcggacgtaggttacgttacgtaagtttaacgttacggtcgggtaacccttaccgtttcttacgtaacgttccgtacggtctaacgtaacggtacggttacggtacgtaccgtaacctaagtacccggtacccgggaaccggtaacccgtaccgttaacccggaacggtaacccgttacgttacctacccgtagtaaccgtccgtacgtacccttggtaccgtccgaccggtccgaccgtacggtccgtaaccggttccttttagttacttttacgtcggtacgtagttaacggtattaacggtttaagtcggttagggtacgtaggtacggttacggttaccgtaccgtaaaccggttcggtacgttttggtttaacgttacggtttaacggtttccgggaaccggaacgggttacgtaccggtaaccgg

SEQ ID NO: 95589 - DNA, 1004 bp, Homo sapiens
  misc_feature: GYAE6OF02J0OO0.51.36.D03.1.454.CMB.1.raw
  modified_base (204)..(204): a, c, t, g, unknown or other
  misc_feature (204)..(204): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggacgtcgggcccaggaccttgtgaacgtccgttacgganacactcgtacccctcacctggctctacgtctcgtggcgtctacatcgagttagtagatacttacgtacgtggggtctggacgtccggaccgaccgggacccccggggaagggtccgtaggtagttgggtagttcggacgtacggtactacgtaaggtttactaccggtacgggtaacccttaccgtttacgtaaccggtaacggttccggttaccggtaccgttaaccgtaaacgggtacggttacccggtaacggttaacccgaaaccgttaacgtaccggggtaaccccggtaaaccgggtaacccggtaaaccccgggttaccccgtaaaaccggggtaacccgtttaacccggttttacccccgttaaacccggttaaccgggtaaaccggttacccgttaaccggttaaccccgtttcggttaaccgggtaccccgggtaacccccgggacccggttaaccggaaacccgggtttaacccgggtaacccgggttttacggtttttaaccgggtttaaccgtttttacccggttaccgggttaacgggtttaaacccgttaaaggggttaaactttaaaccgggtttaacggttttcggggttaaaccggggttaacgtaaaccggttttacgggtcgggttttaaacccggtaccccggttttaaaccgggttaacccgggtttaacgggttttaaccggtttttaaggttaaccccggggttttaacgggttaacccccggggttaacgggtaaacccgggttacccgggttaaacccggggttaaaccccggg

SEQ ID NO: 95590 - DNA, 761 bp, Homo sapiens
  misc_feature: GYAE6OF02HR7ZJ.51.36.D03.1.454.CMB.1.raw
  modified_base (608)..(608): a, c, t, g, unknown or other
  misc_feature (608)..(608): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcgctcccagagtgggtcctgtccctagttgccacctgacaggagtcgggccaggtcttggtagaacgccttcggagactctcgtccctcacctgctctgtctcgtgggccgtctccatcgagttagtagattactttaacgtacgtggggctggtacgtccggtcgaccgggccccccggggaaggggtccgtaggttagttcggggtattccggggactaacggttacttacgtaaggtttacgttaaccggttaccggggaacccctttacccgtttacgttttaccaaacgggttccgttaccgccgttaacgaaacggttccggtacggtaactaccgaacccacgttaccgaacccggtacggacccgtaacggtaacccggtaacggacccttacggtttcccgtacccgtagacggttcctacgtaccttcggtacggtcccgaccggccgaccaccggtaccgtaccggtttnttttacggttactttcgtaggtacgtcttagtaattaacgttagtcggtaggtacgtagtagggttcgtacgttaccgtacggttacggtcgtttacgtttagtacggtttaacgggttcgggaccgttaaggaccggtaaggttaacccggg

SEQ ID NO: 95591 - DNA, 783 bp, Homo sapiens
  misc_feature: GYAE6OF02H43LG.51.36.D03.1.454.CMB.1.raw
tcagcgatcgtatacacgaccggtgctcgatttagctgcgtcacgatctctcttggggctttctgagagtcgtggatctcatgtgacaaagaaaatgaagcacctgtggttcttcctcctcgtggtggcgcctccagtagttgggtcctcgtccctagttgccacctgcgaggacggtccggacccaggtacttgtagaacgtccttcggaagacacgtcgtccctcacctgcctcgtgtctcgtggccgccttcactcgagtagtagtattacttacgtacgtcgggtctaggtacgtccggacgtaccccgggcccccggggaagggtcgtggtaggtttacggtagttacggagtacgttaacttcgtaaggtttactacggtaccgggtacccttcgtttactacgtaacgtccgtccgacgtacgtaaacgtgtaccggtaacgtaccgaccgacgtaccggaacccgaccgggtacccaaccggtaacccgaaacgttaccgtaaccgttcccgtaacccgttaggaaccgtccgtaaccgtacgttccgtaccggtacggtaccccgcggttaccgaacgtacccggttcgttaaccgttttcgttacgtttcccgttaggtaccggttaatttacggaactttaagtaaccggtgggtagggtacgtaccggtgggttaaccgtcggtaaaccgtttcccggaaggttttaccgtttaggtttacgttagggtttaccgggttaaccggaacgttaacggtccgtaaggtaaccg

SEQ ID NO: 95592 - DNA, 688 bp, Homo sapiens
  misc_feature: GYAE6OF02GVGU2.51.36.D03.1.454.CMB.1.raw
  modified_base (168)..(168): a, c, t, g, unknown or other
  misc_feature (168)..(168): n is a, c, g, or t
  modified_base (610)..(610): a, c, t, g, unknown or other
  misc_feature (610)..(610): n is a, c, g, or t
tcagcgatcgtatacacgaccggtgctcgatttagctgcgtcacgatctctcttgggggctttctgagagtcgtggatctcatgtgacaagaaaatgaagcacctgtggttcttcctcctcgtggtggcggctcccagatgggtcctgtcccagttgcacctgcaggngtccgggccaggtacttgtagaagtccttggagacactcgtcccctcacctgctctcgtctcgtggccgctccatcgagtacgtagattattacgtacgtgggctggacgtccggcgaccggcccccggggagggctgggagttggagttggctagtactacgtaacgttactacggtcggaaccttccgttactaccgtaagtccgtaccgtacttacgaacgtacggtaccgtacgtaccgaccgtacgtaccggaaccggaccgaccgtacccgtaaccgaaccggtacctaaccgtttccctaccgtaacggtaccgtaccgtcgtaccccgttggtacccggtccggtaacccgccggaccgtaacggtaccgttcgggttcttttaggttacctttcgtagttcgtattacgtaagttaagtaggttggtaaggtnacggtggttcgtaccgtacgttacgtaggtcgtttagttagtaaggttcggttacgggcgtaacggtcgtacgtacgg

SEQ ID NO: 95593 - DNA, 736 bp, Homo sapiens
  misc_feature: GYAE6OF02IAO4M.51.36.D03.1.454.CMB.1.raw
  modified_base (199)..(199): a, c, t, g, unknown or other
  misc_feature (199)..(199): n is a, c, g, or t
tcagcgatcgtatacacgaccggtgctcgatttagctgcgtcacgatctctcgttggggctttctgagagtcgtggatctcatgtgcaagaaaatgaagcacctgtgttctcctcctctgtggcgctcccagatcgggtcctgtccagttgccacgtgcaggacgtcgggcccaggtacttgagaacgtcgttacgganacacgtcgtccctcaccttgcttcttgtctcgtggcgtctccgtatcagtacgtagtatacttacgtaagtcgggtctggactccggacgaccggacccccgggaagggtcctaggtaattggtaacgtttggacgtaacgttacgttacgtaaggtttaacgtacggtacggtaaccctaccgtttcgttacgaacgtcgtaacgtcgtacgaaagtcggttacagttacaaccgagtacggacccgaccggtaaccaaccgttaccgaaaacggtacctacggtttccctacccgtagtaacgttcgtccgtaacgttcgttacggacgaacccggccgttacgaagtaccgaacgttagttacgttactttcggtattacgtacgttaaataacgttagttaaccggttggtacgggtacgttaaggtccggtaagggtttaccgtaccgtaaacggttacggtacgttttacgttttaggtaacttacggggtttacggtaaccgaaacgggttaccgaaggttaaacccggg

SEQ ID NO: 95594 - DNA, 787 bp, Homo sapiens
  misc_feature: GYAE6OF02IX3DC.51.36.D03.1.454.CMB.1.raw
  modified_base (624)..(624): a, c, t, g, unknown or other
  misc_feature (624)..(624): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatggtcctgtcccagttcgccacctgcgaggcggtccgggcccgaggtacgttggtagaacgtccgttacggacgtacacgttccgtcccctccacctcgtccttctcgttcctcggtgggcccgtacctaccgtatacgtagtacgtaagtaattaacttacgttacggtggggtcgtacggacgtccggaccgtacccgggacccccggggagggcgtaggtcggttagggtcgttacggacgtacgttactacgtagtttacgtacggtaccgggtaaccttaccgtttcttacggtacggttccggtaccgtacgtacgtaaggtacgtacgtacgtaccgtaaccgtacgtaccggaacccggccggaaaccgtacccgtaacggtaacgtacccgttcgttaccgtacccgtaggtaccgtcgtccggaccttcgtccggtaaccggcccgaccgacgtaccggtaccgtacccgggtttnttttaccgttacgtttcgtacggttcgtacgttagtaccttaagtacgtgggttaggtactaacggtcgttacggtaccgtaccgttaacggaccgggttactttacgttacggttaagtttaccgggttacgggacgtaccggttaacggacgttaacccgg

SEQ ID NO: 95595 - DNA, 817 bp, Homo sapiens
  misc_feature: GYAE6OF02I4OJ3.51.36.D03.1.454.CMB.1.raw
tcagcgatcgtatacacgaccggtgctcgatttagctgcgtcacgatctctcttgggggctttctgagagtcgtggatctcatgtgcaagaaatgaagcacctgtggttcttcctcctcctggtggcggctcccagtatgggtcctgtcccagttgcacctgcagggagtccgggcccaggactttggtacgaagtcccttcgggaagtaccacgttcgtccccttacaccttgccttctcgtcctcgtcgggccgtactccatcgagtagtagattacttacgtacgtggggccttaggactccgggtaccaccggtaccccccgggggaagggtccgttaggtatttccgggagtttcggaccgtaggtactacgtagtttactacggttcggacccttacgtttacctcgtaaacggttccggttacgtacctactaaacggtacggttaccgaacggtttaccacccgttaagtaccgggtaccccgtacgggaaaccgtacccgtttaaccgaaacgggtaacccttacgggttttccctaacccggtagtaaccggttcgttacccggtaaccgttaccggttacgggttaccggaaccccgtcggacccctaacgggtacccggttaacggttacctttttcggttaacgttttaccggtacggtttcgtaaccgttaaggtactttaaaggtttaacgttcgggttacgggttaccaacgggtggttaccgggtaccggtcgttaacggtaacgttacgttacgttttacgtagttacggttcggaaccgtaaggtccgaggtaaccgg

SEQ ID NO: 95596 - DNA, 718 bp, Homo sapiens
  misc_feature: GYAE6OF02GVPW0.51.36.D03.1.454.CMB.1.raw
  modified_base (185)..(185): a, c, t, g, unknown or other
  misc_feature (185)..(185): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggccggctcccagatgggtcctgtcccagttgcacctgcaggagtcggcccaggacttgngagccttggagacactcgtccctcacctgctctgtctcgtcggcgtcctccatcgagtagtagtattacttacgtacgtcgggcgtaggtacgtccggccgacccgggccccccggggtaacgggtcgtagggacgttgggagttcgggacgtaggtactacgttaggtacgttaacgtcggggaaacccttccttaccgttacgtaagtccgttacgtccgtagaacgtacgtacgtagtacccgactacgacggtacccggacggaccgtaccggtacccgaaccgtaaccgtaccgttccctaccgtacgaacgtccgcgttaccgtcctacggtccgacccgcccggtacaaccggccgtacgttcgtttacgttcttctacggttgtacgttagtaattacgtaagttgggtaagtacgtacgtaggttaggtacgtaacccgttaaccggttacgggtacgtttacgtttaacgtacggttttagggttaccgggaacccgtaggtacccgtaaccgggttaaccgg

SEQ ID NO: 95597 - DNA, 721 bp, Homo sapiens
  misc_feature: GYAE6OF02GOTFE.51.36.D03.1.454.CMB.1.raw
tcagcgatcgtatacacgaccggtgctcgatttagctgcgtcacgagtcgtctcttgggggctttctgacgagtcgtggattctcgatgtgcaagaaaatgaagcacctgtggttcttcctcctcctggtggcgtctcccgagagtgggtcctgtcccagttgcaccttagcaggagtcggcccaggtacttgagaagtccgttaggagacgacttgtccctcaccgtggccttcgtgtctcgtggccgtctccatccgagtagtagattaattacgtacgtagggtctggaactccggcgacggccccccggggaagggcctagggacgttacgggagtttcggacgtaaggttagtcgtaagttacgtacgtcgggacctaccgtttcgtacgtaacggttccgtcgctacgtaagtacgtcgtagtcacgtagtcgaccgtcggacacgtaccaacggtacctacgttcctccgtagtacgctacgtacctcgtcgtccgaccgtaccgagaccgtaactccggtctttacgtacgttccgtagttacgaccgttaagtacgttaaagttaccgttggttagggtaacgtacgtacgggtttacgggtacggtaacccgttaaacggttacgggtaacccgtttttcgtttaggtaaccggttttacggtttaacggggtaacccctaagggttaccccgtaacggggttaacccggg

SEQ ID NO: 95598 - DNA, 796 bp, Homo sapiens
  misc_feature: GYAE6OF02IK61I.51.36.D03.1.454.CMB.1.raw
tcagcgatcgtatacacgaccggtgctcgatttagctgcgtcacgatctctcttgggggctttctgagagtcgtggatctcatgtgcaagaaaatgaagcacctgtggttctcctcctcctggtggcggctcccagatgggtcctgtcccagttgccacctgcaggaggtccgggcccaggtacttggtgaagtccttggagaccacttcgtccctcacctgccttctcgtctcgtggccggtctccatcagtagtagtattacttacgtacggtgggctaggacgtcccggcgacccgggaccccccggggaggggtccgttagggtagttgggtacgttcggacgtaagttacgtacgttaacggtttacgttaccggtaccgggacccttaaccgtttccgttacgtaacggtccgtaccgtacctacgtaaacggtacggtaccgagtacccaaccgtacgtaccggaacccggtaccggaacccgtaacccggtaacccgaaaccgggttacccgttaacggtttacccctacccggtaacggtaacgtaccgttaccggtacccgttcgttacgggacccgtacccggtacccgtacggtaaccgaaccggttaccgttcgttttacgttacgtttcgtacggttctaactaggttaattaagttaagtgggtagtacgtacggtacggtttaggtaccgttaccggttaacgtacggttacgtttagttttaaggttacggtttacggggtttaccgggaacggtaacggtaccggtacggtaacccgg

SEQ ID NO: 95599 - DNA, 798 bp, Homo sapiens
  misc_feature: GYAE6OF02J0O4V.51.36.D03.1.454.CMB.1.raw
  modified_base (166)..(166): a, c, t, g, unknown or other
  misc_feature (166)..(166): n is a, c, g, or t
tcagcgatcgtatacacgaccggtgctcgatttagctgcgtcacgatctctcttgggggctttctgagagtcgtggatctcatgtgcaagaaaatgaagcactgtggttcttcctcctcctggtggcggctcccagatgggtcctgtcccagttgcacctgcaggngtccgggaccaggacttgtgagccttcggagacacgtgtcccctcgacctgcttctcgtactctcgggccgactccaatcgtaagtagtagattattacctacgtgggctacggacgtccggacaccgggaccccccggggtaaggggctacggtaaggttacggtacgttcggaccgtaaggttactacgtacgttattaaccggtcggggaacccttaccgtttcttacgtaacggttccgttaccgacgtacgaaaggtacgtacgtacgtaccgtaccgtaagtcggacccggtaccgaaccgtaacccggtaccgtaaacggggaaccctacgtttaacccgtccccggttagtaaccgtacccgttacgtaacccgttcgtaccggttaccgacccgggtccccgttaaccggaacgttacccggaaccgttttaccggttttaggttaaacctttttcggaacgggtttcgtaccggtaacgttacgttaaataaacgggtttcgtaaaggggttccgaacgttcggtaggttaaccgccgttaaaccggttcggtaaacgttccgttttaggacgtttaacggtttaccggggacccttaacggggtacgtaccggtaacccgg

SEQ ID NO: 95600 - DNA, 856 bp, Homo sapiens
  misc_feature: GYAE6OF02JKSXI.51.36.D03.1.454.CMB.1.raw
tcagcgatcgtatacacgaccggtgctcgatttagctgcgtcacgatctctcttgggggctttctgagagtcgtggatctcatgtgcaagaaatgaagcacctgtggttcttcctcctctggtggcgctcccagatgggtcctgtcccagttgcacctgcaggacggtccgggcccaggtactttggtagaacgtccttcggagactacctcgtcccctacaccgtgctctgtctcgtcggccgtcctccatcagttagtagtacttattaccgttacggtgggtctaggacgtccggacgaccccgggacccccggggtaagggtcctggtacggttcggtagttcggacgttacgtacttacggtaaggttccgttacggtaccgggtacccttacctttacgttaaccgtaagggttccggtacctacgttaccggtaaggtaccggtacgaccgttaccacgtacgccgggtaacccggaccggtacgtaaccggtaccgaaccggtaccgtacccgtttaccctccgtaaacgtacccggttaccgtaccggtaaccccgtttcggtaccgggtaccccggtaacccgggtcccggtacccgttaaaccgggaccccggtttaaccggttttacggtttttccggtttaagtttttccggttcgtacggttaaccttaacggggttaactttaagttaaccggggttcgggtttaccgggttaagttcgggtacgggtttccggtaccgttcccggtaagggttttaacggtccgtttttaaggttttacggaacggtttttcgggggttaccgggtaacccggtacgggttacgttaacggttaacccgg

SEQ ID NO: 95601 - DNA, 740 bp, Homo sapiens
  misc_feature: GYAE6OF02G9QO8.51.36.D03.1.454.CMB.1.raw
  modified_base (552)..(552): a, c, t, g, unknown or other
  misc_feature (552)..(552): n is a, c, g, or t
tcagcgatcgtatacacgaccggtgctcgatttagctgcgtcacgatctctcttgggggctttctgagagtcgtggatctcatgtgacaaagaaaatgaagcacctgtggttcttcctcctctggtggcggctcccagatgggtcctcgtccctagttgccaccgtgcgagggacggtccgggcccagggtacttggtagaacgtccgttacggaagacctacgttccgtcccctcaccttgccttcgttcgtcctcgtcgggtccgtcctccatacgaagttaagtaagtaacttacttaccgtacggtgggtcgtacggtaccgtcccggaccggaccccggggacccccggggggaaggggtcgttaggtacggttagggtacgtacgggactaaggtactacgttaagttacgtacggtaccggtaccttaccgttacttacgtagttccggtaccgacgtacgaaggtcgtacgtactccaacgtagaccgtacccggacggaaccgtaaccgacgaacgtaccttccgtttaccgaccgagtaccncgttacgcttgtcggaccgccgacgagacggtccgttacgttcgtttacgtgtttccgtgtcgtaacttaaggtattaagtcgggttggtagggtactacgggtggttccggtaccggtaaccgttacgggacgttatttccgtaaggttagtttccgggtaggaccggtaaggaccgtacgtaacgg

SEQ ID NO: 95602 - DNA, 724 bp, Homo sapiens
  misc_feature: GYAE6OF02F9XIS.51.36.D03.1.454.CMB.1.raw
tcagcgatcgtatacacgaccggtgctcgatttagctgcgtcacgatctctcttgggggctttctgagagtcgtggatctcatgtgcaagaaaatgaatcacctgtggttcttcctcctcctggtggcggctcccagatgggtcctgtcccagttgcacctgcaggagtcgggcccaggacttgtgaagccttcggagacacgtcgtccctcacctgcttctgtctcgtggcgctccatcaggtagtagattattactacgtgggtctggacgtccggcgaccggccccccggggaagggccgtaggtagttgggagttcggactaggttacgtcgtaaggtttactacgtcgggtaacctaccgtttcgttacgtaagttccggtcgtactacgaagtcgttacgtacgtaccaaccgtagtacggacccgaccggtaccgaccggtaacccgaacggtaccctacgtttcctacccgtacggtaacgtcgtaccgtaccgttcgtacggtccgacccggtcccgtacgaacggtacccgtaacggtttccgttttagttaccgttttccgtagttacgtacgttagtaattaacgttaagttgggttacgggtagtacggttaggttacggttacggtacccgttaacgtaccgggtaatttaccggtttagttacgttacgggtttccgggaccgttaacgggtaccgtaacggttaacgg

SEQ ID NO: 95603 - DNA, 790 bp, Homo sapiens
  misc_feature: GYAE6OF02JU7K2.51.36.D03.1.454.CMB.1.raw
  modified_base (207)..(207): a, c, t, g, unknown or other
  misc_feature (207)..(207): n is a, c, g, or t
  modified_base (340)..(340): a, c, t, g, unknown or other
  misc_feature (340)..(340): n is a, c, g, or t
  modified_base (662)..(662): a, c, t, g, unknown or other
  misc_feature (662)..(662): n is a, c, g, or t
tcagcgatcgtatacacgaccggtgctcgatttagctgcgtcacgatctctcttggggctttctgagagtcgtggatctcatgtgcaagaaatgaagcactgtgttcttcctctctggtgcgctccagatcgggtcctgtcccagttgcaccgtgacgagggacgtccgggccctaggtaccttggtacgaacggtcccttcggaanaacctcgttcgtcccctcgaccttgttcctcgtcgttactcggcggtcctcctactcgagtagtaaggacttattacgttacctggggtcgtacggttacgaccggcgaccgtcccccggggaaaccgggggngtcggtaggttaggtaggttaccggacggtacgtaacgttacccgttaggttaactaccggggttacggaacccctttaacggtttccctaaaggtaacggtttcccggtaactccgtaacgaaaggtttccggacgttacgtaccccgaaacttagggtacccgaccggcgtaaaccgtcccgtaaacgggtaccgaacgttcgttacccctccggtaagacctacgtacgtcctttacggacggtaccgtacccggaccttacgaaccgtaccggaccgtttgtttaacgtttcccgttagtaggtacgtacggtttaanaccgtaagttacgtggtacggtactacggtggtacgtcgttaacccgtaagggttaccgaggttttccttaaggttacgttttacggggaacccgtaagtaaccggtacgtaacggttccgtacccgg

SEQ ID NO: 95604 - DNA, 685 bp, Homo sapiens
  misc_feature: GYAE6OF02H11L4.51.36.D03.1.454.CMB.1.raw
  modified_base (386)..(386): a, c, t, g, unknown or other
  misc_feature (386)..(386): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtccgggcccaggacttgtgaagccttcggagacactcgtccctcacctgctctgtctcgtggcgcctcatcagtagtagattattacgtacgtgggtctggacgtccggacgaccgggccccccgggaggggtctggtagttggagttcggctagttatcgtagtttactacgtcgggtaccctaccttcgttacgtaacgtcgtacgtctacaaggngtcgatcaacctagtcgaccgcggaacctaccgtaccgaacgcctacgttcctaccgtagaacgcgttacgacccttcgtacggtccgacccggtccgacgtaacggacccgtacggtttcgtttacgtttaactttccgttggtacgtacgttaaagaactttaacgttaagtcgggttagggtcgtaacgtacgggttggtaccgtacccgttaacggtacgggttaacgtttccgttttaggtacggttttacggttaccggggaaccgtaacgggtaccgtaagggttaacccgg

SEQ ID NO: 95605 - DNA, 691 bp, Homo sapiens
  misc_feature: GYAE6OF02FHE1D.51.36.D03.1.454.CMB.1.raw
tcagcgatcgtatacacgaccggtgctcgatttagctgcgtcacgagtctctcttgggggctttctgagagtcgtggatctcatgtgcaagaaatgaagcacctgtggttcttcctcctcctggtggcggctcccagatgggtcctgtcccagttgcacctagcgaggagtccgggccctaggacttgtgaagtccttcggagacactcgtccctcacctgctctgtctcgtggcgctcatcgagtagtagtatattactacgtcgggtctggtacgtccggcgtaccggaccccccgggggaggggtcctggtagttcggttagtcggactagttactcgtaagttacgtaccgtacgggtacccttaccgtttccgttaagtaacggttccgtcggtctacggaacgtcggtacgacgttccaaccgtataccggaccgaccggtacctaccgaccgaacggtacctcgttacccgtcctaggaaccgtcgtacgaccttcgtcgtaccggacccggtccgacgtacgtacccgtacggtttctttacgtttacgttttccgtaggttacgttacgtagtaactttaagtaacgttgggtaggtacctaggtacggtggtaccgtaaccgtacggtacggtagtttcttaggtacgttacggttcgggacctagggactaggtaaccgg

SEQ ID NO: 95606 - DNA, 779 bp, Homo sapiens
  misc_feature: GYAE6OF02FWQE0.51.36.D03.1.454.CMB.1.raw
  modified_base (114)..(114): a, c, t, g, unknown or other
  misc_feature (114)..(114): n is a, c, g, or t
  modified_base (720)..(720): a, c, t, g, unknown or other
  misc_feature (720)..(720): n is a, c, g, or t
tcagcgatcgtatacacgaccggtgctcgatttagctgcgtcacgatctctcttggggctttctgagagtcgtggatctcatgtgcaagaaaatgaagcacctgtgttcttccncctcctggtggcgctcccagatgggtcctgtcccagttgcacctgacaggagtccgggcccaggtacttggtgaaagtccttcggagcactcgtcctccacctgctctgtcctcgtggcggcctccatacctagtacgtaagaacttattaccgtacttcggggctgggtaacgtccgggaccgtaccggaccccccccggggtaagggggctcggtaaggttcggtaattgggtacctagtaactcaacgttttataaccgttacggggacccttaacccctttccgttactaaggtccgtaccgcttacgaacggaagttccggaatacccaacaccgtcgaaacccgccgggtaaactacccggaccgaaacggacccgttaacgtccctcccgttagaaacgttctaaaccggttccgtaaccttcggtaccggtacccgaccggtcccgaaggtaacccgtaaccgggttcgttttacgttttaaacctttttcggcgggtttacgtaccgttaaacgtaacgtttaaacgttacgttacggggttggttaccggacgttgggtcggtacgttaccccgtagtaaccccggggtaagtttnttttaacggtacggttaacggttttccggggaaccgtcggtacggtaaccggtaaccgg

SEQ ID NO: 95607 - DNA, 773 bp, Homo sapiens
  misc_feature: GYAE6OF02IPPGO.51.36.D03.1.454.CMB.1.raw
  modified_base (363)..(363): a, c, t, g, unknown or other
  misc_feature (363)..(363): n is a, c, g, or t
tcagcgatcgtatacacgaccggtgctcgatttagctgcgtcacgatctctcttgggggtctttctgagagtcgtggatctcatgtgcaaagaaaatgaagcacctgtgttcttcctcctcctggtggcggctccagatgggtctcgtcctagttgcacctgcaggcggtccggccaggtactgtagaacgccgttcggagacactcgtccctcacctgtctacgttcgtctcgtgggaccggcctacctatcgtacgtaaggtagtaactacgttaccgtacggtggggcccgttaggaccggtccggaccggacccggggacccccccgggggtaagggtcggtacggtaggtttacgggnggttacgggacaacgttactacggtaagtttaactacgggtaccggtaacccttaccttcttacggtaaacgttcgtacgtcctaaggaaggtcgtaacgggtctaaccctacgtaacgtccggtaaccggaccggtaacctaccggtccaaacgggtacccgtacgttcccgtaaccgtagaccgtcgtaccgtaacttcgtccgtaccggacccgacggaccaacgtaccgttacggttcgttaaacggtttcttacgttcggttaccgtcgttaacgttaagttacttaggggttcgtaaggggttcgagttaccgggttggtacccgtaagggttacccgttagttaccggtttagttcgtttaggttacggtaccgggtaacacgggttaccgacgttaaccggg

SEQ ID NO: 95608 - DNA, 908 bp, Homo sapiens
  misc_feature: GYAE6OF02JLDES.51.36.D03.1.454.CMB.1.raw
  modified_base (804)..(804): a, c, t, g, unknown or other
  misc_feature (804)..(804): n is a, c, g, or t
tcagcgatcgtatacacgaccggtgctcgatttagctgcgtcacgatctctcttgggggctttctgagagtcgtggatctcatgtgcaagaaatgaagcacctgtggttcttcctcctctggtggcggctcccagtagtcgggtcctgtccctagttcgccaccgtgcgaggacggtccgggaccccagggtacctttggcgtaaacgtcccgtttacggggaactacctaccgttccgtacccccctcgtaccccgttggtcccttccgttacggttcccgtccggttacggggcccggtacccttacccgtaagttaccgtaaggttaaggttaacgtaacgttaaccgtttaacctacgggtcggggtacttacgggtaccgtccgggacccgaccccggggtaccccccgggggtaaggggtccgttagggtacgtttcggtaaggtttcggacctaacggttaactccgttaacggttaccgttaccggtacccggggttaaccccttaaccgttttccgttaaccggtaagttcccgtaccgtacgttaaccggaaacggttcgttaacgaccgtaccgtaccgtacgtaccgggacccgtacgggtaacccgaccgttaacccggaacggtacccgttacggttcccctaccgaccggttaacgtccgttaccgtaacccgttcggtaaacgtccccggaccgtcgaacctaccggtacgtacccggtttactttacgttaccctttggtacgtccgacttacggttaattaaaccggtgttaacgggtccggttanaacggtgggttacccgacgttaacccggttagtacgggttaccttttaggttacgttaacggttcgggttaccggaacgtaacgggtaccgtaccgggtaaccc

SEQ ID NO: 95609 - DNA, 776 bp, Homo sapiens
  misc_feature: GYAE6OF02FIPI7.51.36.D03.1.454.CMB.1.raw
  modified_base (69)..(69): a, c, t, g, unknown or other
  misc_feature (69)..(69): n is a, c, g, or t
  modified_base (280)..(280): a, c, t, g, unknown or other
  misc_feature (280)..(280): n is a, c, g, or t
tcagcgatcgtatacacgaccggtgctcgatttagctgcgtcacgatctctcttgggggctttctgagngtcgtggatctcatgtgcaaagaaaatgaagcaccgtgttggttccttcctcctcctggtggcggctcccagattgggtcctcgtcccagttgaccaccgtcgccgaagggtacggtcccgggaccccgtaagggtacttgtggaaaccgtcccttacggagactcttcgtcccctcacctcgcttcgtcgtctcgtcggcgtacctcctntacgtagtaagtagtacttaacttacctacgggttcgggacgtcggtaaccgtccccgggaacgcccggggtaccccccgggggagggtccggtaggtggtttggtacggtaggcctagtcgtagtaacgttacgcgttacgggccctacgtttcctacgtacggtccgttactaccgtagaacgtgacgtacgcctagtaactcgaccggttacgccgtaaccgtaccgtacgtaccgttactccgttaccgtacgtaacggcctaccggtacccgttccgttacggacccgggttacccgcggttaccgtaacggtaaccgttcgttctttaccggtttacgtttcgtacgtccgtaacgttagaacctttaaaggtagtttaggagggtttaagacggttacgggtacggtaccggtcccgtaacggtttccgtaacggttcgtttaagtacggtttagttaccgggaaccgtacgggacgtacgggtaccgg

SEQ ID NO: 95610 - DNA, 839 bp, Homo sapiens
  misc_feature: GYAE6OF02HHH7J.51.36.D03.1.454.CMB.1.raw
tcagcgatcgtatacacgaccggtgctcgatttagctgcgtcacgatctctcttggggctttctgagagtcgtggatctcatgtgcaagaaaatgaagctacctgtgttcttcctcctctggtggcgctccagatgggtcctgtcccagttcgccacctgctaggacgtccgggcccaggtacttggtcgaaacgtcccgttacggagacctaccgtcgtcccctacaccgtcgcctcgttcggttcctacggtgggcccgtacctacccgattccgaaggttaacgtaacgtacttaacttaaccgtacggtcgggtactacgggtaccgttccccgggacgtaaccccgggggccccccggggtaaaggggtccttagggttaaccgttgggtactttacgggacctaggttactcgttaagttacgtacggtaccggtaccttaccgtttacgttacgaacggttccgtaccggtacgttacgtaaggtacggttccggtaacgtacctaaccgtagttccgggaaacccgtcggtaacccgttaccgggtacccaaacggggtaccctacggtttccccgtaccgtttaaggacccgttcctaccggtaccttcggtttaccggccggaacccgttcggacgtaaccgttaccgttccgttagttttaccgggttaattccggtagttaccgtagtaaacttaacgttaagtttacggttagggtacgttccgtaaggtccgggttacgtaccttaacccgggtgttaccgggttactttacgtttaagtcgggtttacggtaccggaagttaaccgggaccttaacggttccgg

SEQ ID NO: 95611 - DNA, 612 bp, Homo sapiens
  misc_feature: GYAE6OF02GFD3Z.51.36.D03.1.454.CMB.1.raw
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctcgtggcgctccatcagtagtagtatattactacgtggggctggacgtccggcgaccggaccccccggggaaggggcgtaggtagttggagttggcgtagtatcgtagtttagtacgtcgggacctaccgtttctacgacgttcgtcgactagaagtagtcgatcacagtcgacgcgacacgacgaacggactcgttccnccgtagacnctcgccgtntcgcgccnccggntacgacgtcgttctttgttactttcgtgtcgtcgttaagtacttaagtaaggttggttaggggtctacggtggttacggtcggtaaccggttaacgttacgggtacgttttcgtttagtagtttacggttaccggggactaacggcggtacggtaacgg

SEQ ID NO: 95612 - DNA, 756 bp, Homo sapiens
  misc_feature: GYAE6OF02G6X87.51.36.D03.1.454.CMB.1.raw
  modified_base (186)..(186): a, c, t, g, unknown or other
  misc_feature (186)..(186): n is a, c, g, or t
  modified_base (332)..(332): a, c, t, g, unknown or other
  misc_feature (332)..(332): n is a, c, g, or t
tcagcgatcgtatacacgaccggtgctcgatttagctgcgtcacgatctctcttgggggctttctgagagtcgtggatctcatgtgcaagaaaatgaagcacctgtggttcttcctcctcctggtggcggctcccagtatgggtcctgtcccagttgcacctgcaggagtcgggcccaggacttgngaagccttcggagacactgtccctcacctgcctctgtctcgtggcgtcctccatccgagtagtagattattaccgtacgtgggctggacgtccggctaccggccccccgggaagggtccgtaggtacgttggacgttggctaagtntacgtagttactacgtacgggaccctaccgttcgttaccgaacgttccgtcgtaccgtacgtaaggacggtcgtacgtaccgaacgtagtacggacccggtaccggactaacccggtaccgtaaacgggtacccgtacggtttacccgtacccgttacgaaacggtccctacggtaaccctttccggtaacggtccgacccggacccggttacccgaacggtacccgtaaccggttccgtttttaaggttaccgtttttaccggtacggttacggtaccgttaaacggtacgtttaaagtaaacggtttcggttcggttaacgtacccgttaaggttcgggtacggttaccctttaggtaacggttcgttccgttttaagtacgtttcggttacgggtaacccgtaggtaccgacggtaaccgg

SEQ ID NO: 95613 - DNA, 724 bp, Homo sapiens
  misc_feature: GYAE6OF02G2D6U.51.36.D03.1.454.CMB.1.raw
tcagcgatcgtatacacgaccggtgctcgatttagctgcgtcacgatctctcttgggggctttctgagagtcgtggatctcatgtgacaaagaaaatgaagcacctgtggttcttcctcctcctggtggcggctcccagatgggtcctgtcccagttgccacctgcgaggagtccggcccaggtcttgtagaagtccgttcggacgaccactcgtccctcaccgtgctctgtcgtcgtcggccgtcctccatactagttagtagtattacgttacgtacggtgggtctacgggacgtcccggaccgacccgggacccccggggtagggccgtaggtgtgggtacgttggaccagtacgttcgtaagttacgtacgtcggtaccttaccgttcttaccgtagtccgtacgctacgaacggtacgtacgtacgtccgacctacgtacgaccggacggtaccgacgtaccgaacgtaccgtcgttacgtaccgagtactcgttacgacgttcgtcggtaccctccggtaccgaccgtaacggtcgtacccggttatttacgtactttcggtacgtcgtaactacggttaacttaagtacggttaggtagggtacgtaacggttgggtacggttaccggtaaccgttaccggttaacggttcgttacgttttacggttaacggttcgggttacccgggtaactacgggttacgaccggttaaaccggg

SEQ ID NO: 95614 - DNA, 911 bp, Homo sapiens
  misc_feature: GYAE6OF02I2LZB.51.36.D03.1.454.CMB.1.raw
  modified_base (214)..(214): a, c, t, g, unknown or other
  misc_feature (214)..(214): n is a, c, g, or t
  modified_base (814)..(814): a, c, t, g, unknown or other
  misc_feature (814)..(814): n is a, c, g, or t
tcagcgatcgtatacacgaccggtgctcgatttagctgcgtcacgatctctcgttggggctttctgagagtcgtggatctcatgtgcaagaaatgaagcacctgtgttcttcctcctcctggtggcgctcccagatgggtcctgtcccagttcgctacctgacgaggcggtccgggcccagggtacctttggtacgaacgtcccgttacggganacctacgttcgtcccctcgacccgttgtccttctcggtacctcggtcgggaccgtcctacccagtaccgaaggttagttaacgaactttaacgtttaaccgtaccggtggggtacgttacgggaaccgtccccgggacccgtaccccggggacccccccggggtaaagggtccgtttacgggtaaggtttcgggaacggttacggtaccgtaacgttaaccgtacggttaacggtttaaccgttaacgggtaccgggtacccctttaaccggttttacgttaacggtaaccggtttaccggtcccgtaccggttaaaccgttaacgggtacgttaaccgtacggttaccgtaaccgttaacgttacccggacccggttaaccgaaccggtaacccggtttaacccgaaaccggggttacccctaaccggtttaccccgtacccgtaacggtaaccgtaccgttaccgtaacccgttcgttaccggaacccggtcccggaacccgtacgtaacggttaacccgtcccggttttacttttacggttacctttccggtacgtacgtaccgttaagtaaccttagtaaccgtggtaacgggtanccggtgtaccggttacgtaacggacgtttaccgggttattaccggttttaagaccgttgggttaccggaccgtaacgggtaccgtaggttaacccgg

SEQ ID NO: 95615 - DNA, 183 bp, Homo sapiens
  misc_feature: GYAE6OF01DDQ4G.52.89.I01.1.454.CMB.1.raw
  modified_base (170)..(183): a, c, t, g, unknown or other
  misc_feature (170)..(183): n is a, c, g, or t
tcagcgcagtacgacacgaccggtgctcgatttagtatgctagtatcgcgggggtgttcggcggagggaccaaactgaccgtcctaggtcagcccaaggctgcccccacggtcactctgttcccaccctcctctataccgatcgctgagcgggctggcaaggcgcatagnnnnnnnnnnnnnn

SEQ ID NO: 95616 - DNA, 174 bp, Homo sapiens
  misc_feature: GYAE6OF01DN5FG.52.89.I01.1.454.CMB.1.raw
  modified_base (170)..(174): a, c, t, g, unknown or other
  misc_feature (170)..(174): n is a, c, g, or t
tcagcgcagtacgacacgaccggtgctcgatttagtatgctagtatcgcgggggggtgttcggcggagggaccaaactgaccgtcctaggtcagcccaaggctgcccccacggtcactctgttcccgccctctctatacgatcgctgagcgggctggcaaggcgcatagnnnnn

SEQ ID NO: 95617 - DNA, 173 bp, Homo sapiens
  misc_feature: GYAE6OF01EY3JD.52.89.I01.1.454.CMB.1.raw
  modified_base (170)..(173): a, c, t, g, unknown or other
  misc_feature (170)..(173): n is a, c, g, or t
tcagcgcagtacgacacgaccggtgctcgatttagtatgctagtatcgcgggggggtgttcggcggagggaccaaactgaccgtcctaggtcagcccaaggctgcccccaggtcactctgttcccaccctcctctatacgatcgctgagcgggctggcaaggcgcatagnnnn

SEQ ID NO: 95618 - DNA, 167 bp, Homo sapiens
  misc_feature: GYAE6OF02GLQTZ.52.89.I01.1.454.CMB.1.raw
  modified_base (167)..(167): a, c, t, g, unknown or other
  misc_feature (167)..(167): n is a, c, g, or t
tcagcgcagtacgacacgaccggtgctcgatttagtatgctagtatcgcggggtgttcggcggagggaccaaactgaccgtcctagttcagcccaaggctgccccacggtcactctgttcccaccctcctctatacgatcgctgagcgggctggcaaggcgcatagn

SEQ ID NO: 95619 - DNA, 167 bp, Homo sapiens
  misc_feature: GYAE6OF02IXT7D.52.89.I01.1.454.CMB.1.raw
  modified_base (166)..(167): a, c, t, g, unknown or other
  misc_feature (166)..(167): n is a, c, g, or t
tcagcgcagtacgacacgaccggtgctcgatttagtatgctagtatcgcggggtgttcggcggaggaccaaactgaccgtcctaggtcagcccaaggctgccccacggtcactctgttcccgccctcctctatacgatcgctgagcgggctggcaaggcgcatagnn

SEQ ID NO: 95620 - DNA, 171 bp, Homo sapiens
  misc_feature: GYAE6OF02GPEA4.52.89.I01.1.454.CMB.1.raw
  modified_base (170)..(171): a, c, t, g, unknown or other
  misc_feature (170)..(171): n is a, c, g, or t
tcagcgcagtacgacacgaccggtgctcgatttagtatgctagtatcgcggggggtgttcggcggagggaccaaactgaccgtcctaggtcagcccaaggctgcccccacggtcactctgttcccaccctcctctatacgatcgctgagcgggctggcaaggcgcatagnn

SEQ ID NO: 95621 - DNA, 544 bp, Homo sapiens
  misc_feature: GYAE6OF01ALR21.10.85.H08.1.454.CMB.1.raw
tcagcatagtagtgcacgaccggtgctcgatttagtatcactcagtcgcgggtcccacctttggttttggagatggttttctcgatgggggctgggaggcctggtccagccggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctatgggttcggacctcgtggggccagggaaccctggtcaccgtctcatcagcctccaccagggcccatcgtcttcccctggccgccctgcctccaggacgccacctccgagacgcacagccggcccgtgggcctggcctgggtccaaggacctaccttcccactactatgcg

SEQ ID NO: 95622 - DNA, 530 bp, Homo sapiens
  misc_feature: GYAE6OF01B7NQZ.10.85.H08.1.454.CMB.1.raw
  modified_base (369)..(369): a, c, t, g, unknown or other
  misc_feature (369)..(369): n is a, c, g, or t
  modified_base (461)..(461): a, c, t, g, unknown or other
  misc_feature (461)..(461): n is a, c, g, or t
  modified_base (475)..(475): a, c, t, g, unknown or other
  misc_feature (475)..(475): n is a, c, g, or t
  modified_base (526)..(526): a, c, t, g, unknown or other
  misc_feature (526)..(526): n is a, c, g, or t
tcagcatagtagtgcacgaccggtgctcgatttagtatcactcagtcgcgggtcccacctttggttttggagatggttttctcgatgggggctgggaggcctggtccagccggggggtccctgagactctcctgtggagcgtccggattcgactttgatacttattggatgagctgggtccgccaggctccagggaaggggctggagtgggtggccaccataaaaggaagatggaagtgagaactactttgtgggctctgtgaagggccgattcaccatctccagagacaacgccaaagaagtcactgtatctgcaaatgaacatgtgagagtcgaggacacggctgtatatttctgtgcggagggganccggctatgggttcgacctgtggggccagggaaccctggccaccgtctcatcagcctccacacggcccatcgtctcccctgcgcctgctccnggacgcacctcgancgcacacgccgccgtcggctgccgtggtcaaggacctactacccactactntgcg

SEQ ID NO: 95623 - DNA, 532 bp, Homo sapiens
  misc_feature: GYAE6OF01BQLAZ.10.85.H08.1.454.CMB.1.raw
  modified_base (435)..(435): a, c, t, g, unknown or other
  misc_feature (435)..(435): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtctgggggaggcctggtccaggccggggggtccctgagactctcctgtggagcgtccggattcgactttgatacttattggatgagctgggtccgccaggctccgagggaagggctggagtgggtggccacataaaggagatggaagtgagaactactttgtgggctctgtgaaggccattcacatctcagagacaacgccaaagaagtcactgtatctgacaaatgaacgatgtgagagtcgaggacacggctgtatatttcngtgcgagggganccggntagtgggttcggacctcgtcggggccaggggaaccctggtccaccggtctcatcacgccctaccaccaacgggccctacg

SEQ ID NO: 95624 - DNA, 527 bp, Homo sapiens
  misc_feature: GYAE6OF01B6JAI.10.85.H08.1.454.CMB.1.raw
  modified_base (338)..(338): a, c, t, g, unknown or other
  misc_feature (338)..(338): n is a, c, g, or t
  modified_base (453)..(453): a, c, t, g, unknown or other
  misc_feature (453)..(453): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtgggggaggcctgggtccaggccgggggggtccctgagactctcctgtggagcgtccggattcgactttgatacttattggatgagctgggtccgccaggctccgaggggaagggctggagtgggtggccacataaaggaagatggaagtgagaactactttgnggctctgtgaagggccattcaccatctccagagacaacgccaaagaagtcactgtatctgacaaatgaacgatgtagagagtcgaggacacggctgtatatttctgtgcgagggngccggctagtgggttcgactcgtcgggccagggaccctggcaccggtctcatcacgccaccacagggcccctag

SEQ ID NO: 95625 - DNA, 650 bp, Homo sapiens
  misc_feature: GYAE6OF01CE3QY.10.85.H08.1.454.CMB.1.raw
  modified_base (240)..(240): a, c, t, g, unknown or other
  misc_feature (240)..(240): n is a, c, g, or t
  modified_base (317)..(317): a, c, t, g, unknown or other
  misc_feature (317)..(317): n is a, c, g, or t
tcagcatagtagtgcacgaccggtgctcgatttagtatcactcagtcgcgggaggagcagttcaacagcacgttccgtgtggtcagcgtcctcaccgtcgtgcaccaggactggctgaacggcaaggagtacaagtgcaaggtctccaacaaaggccctcccgaggccggggggtccctgagactctcctgtggagcgtccggattcgactttgatacttattggatgagcgtgggtccnccaggctccgaggggaaggggctgggagtggggtggccacaagtaaaaggaagatggaagtgaagaactactttggnggctctgtgaaggccgattcaccatctccagagacaacgccaaagaatcactgtactctagacaaaagtgaaacgatgtagagacgtcggaaggacgacgggcttagtaattacgtttcgtggtgacgggaggggtacgccggtatagtcgggttacggacccttcggtcgggggacccaacgggaaccccttgggtacctacccggttcgtaccagtccgacgtcccctaccgaaccccggtaaacggggccccctaaggttccccggttaccccctttccccccggacgggtccccgcccccgttaggccccttcccggaagggaccccgg

SEQ ID NO: 95626 - DNA, 579 bp, Homo sapiens
  misc_feature: GYAE6OF01AJNE6.10.85.H08.1.454.CMB.1.raw
  modified_base (366)..(366): a, c, t, g, unknown or other
  misc_feature (366)..(366): n is a, c, g, or t
tcagcatagtagtgcacgaccggtgctcgatttagtatcactcagtcgcgggtcccacctttggttttggagatggttttctcgatgggggctgggaggcctggtccagccggggggtccctgagactctcctgtggagcgtccggattcgactttgatacttattggatgagctgggtccgccaggctccagggaaggggctggagtgggtggccaccataaaggagatggaagtgagaactactttgtgggctctgtgaagggccgattcaccatctccagagacaacgccaagaagtcactgtatctgcaaatgaacgatgtgagagtcgaggacacggctgtatatttctgtgcgagggganccggctagtggttcgacctcgtggggccagggaccctggtcaccgtctcatcagcctccaccaacgggcccactccggtccttcccccgtcggtcgcccgtcgcctcccgaggacgccacccttcccgacgacgccgacacgccggcccgtcggggcctcggccgtcgggtccgaaacggaccttaccttaccccactaaccgtagtggtccg

SEQ ID NO: 95627 - DNA, 775 bp, Homo sapiens
  misc_feature: GYAE6OF01AZS6Q.10.85.H08.1.454.CMB.1.raw
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtggggggaggcctggtccgaggccgggggggtccctgagactctcctgtggagcgtccggattcgactttgatacttattggatgagctgggtccgccaggctccgaggggaaggggctgggaggtgggtggccaaccgaagtaaaagggaagagtagggaagtggaagaaacttacgttttggtgggtctcgtggtaggaaacggggccgaatttccgaaccagttcctacccgaaggaacgaaccaaaccggacccaaaaggaaacgttccaacgttaggtaacttccgtaggaacctaaaagttacggaaacggtagttaggtacggaaggtaacggtacgggaaagggtaacccgaccggggtcttaggtttaaactttacgtttttccgtgggttcgggaccggggtaagggggggacgtccccggggtactttaacgggttcggggtttacccgggacccgttcgggtaccggggggaccccgtaaacgggggtaaacccccgttggggttacccctaacccgggttcctaccgaacgttcccgaacggtcccccttaaccccgaaacccggaaaccgggggtccccctaacggg

SEQ ID NO: 95628 - DNA, 845 bp, Homo sapiens
  misc_feature: GYAE6OF01BXJZD.10.85.H08.1.454.CMB.1.raw
  modified_base (139)..(139): a, c, t, g, unknown or other
  misc_feature (139)..(139): n is a, c, g, or t
  modified_base (186)..(186): a, c, t, g, unknown or other
  misc_feature (186)..(186): n is a, c, g, or t
  modified_base (223)..(223): a, c, t, g, unknown or other
  misc_feature (223)..(223): n is a, c, g, or t
tcagcatagtagtgcacgaccggtgctcgatttagtatcactcagtcgcgggtcccaccttttggttttggagattggttttctcgagtgggggctgggaggcctggtccaggcccggggggtccctgagactctctgnggagcgtcggattcgactttgattacttatggatgagcgtgggtccnccaggcctccgaggggaaggggcgtgggaggttgggngaccaaccaagtaaaaggagatagggaagtgaacgtaacttacgttttggtcgggtcttcgtggtagggaaacggggcctaatttccaacctattcccgtaccgaaggaacgaaccgaaaccggaccaaaaggtaaacgtccaacgttagtaatcgtagaactaaaaagtggaaaacgagttggaggaagaggtccggaaagggaccgtaacggtcttaggttaattacgttttcggtggtggacggggaaggggacgcccgggtacgtttaaggttcggggtttaccggaccctttcgggtacgggggaacccgtaacggggtaacccccgtttgggtaccctaccggtttcctacgacttaccgaacgtccccgtaacccgaaccggtaaacccgggcccctaaggttcccccggtttccccgttttccccccgcgggtccccgtcccccgttaggccccgttaaccggacgggaccgaccccgttaacccgtaccggacggaagaccccggaacggaccggtccccgggccccgttggggccttacgggccccggttaggtaacccgtaaacggtaccccttacccggtttaaccccaactttacgtacgttcggacgg

SEQ ID NO: 95629 - DNA, 661 bp, Homo sapiens
  misc_feature: GYAE6OF01A6V2Y.10.85.H08.1.454.CMB.1.raw
  modified_base (501)..(501): a, c, t, g, unknown or other
  misc_feature (501)..(501): n is a, c, g, or t
tcagcatagtagtgcacgaccggtgctcgatttagtatcactcagtcgcgggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggccgtggtccgaggcccggggggtccctggagactctccgtgtggagcgtccggattcgactttgattacttattggatgagcgtgggtccgccgaggcctccgaggggagggcgtgggaggtgggtcgccacgaagtaaaggaagagtggaagtgagtaacttacgtttggtggtctcgtggtaggaagggccgtattccaacctatccctaccaagaacgaaccaaaccgaccaaaggaacgttccaacgttgtaactcgtagacctaaaagtcggaaacgtnttaggtagaagtacggtaccggaaggaccgaccgggtattacggtaatttacgttttccgtagggttcggacgggtagggggacgtccccgggtagtttaaggttccggggttacccggacccgttggggtaccgggggtacccaagggggtaacccccg

SEQ ID NO: 95630 - DNA, 810 bp, Homo sapiens
  misc_feature: GYAE6OF01EJLDQ.10.85.H08.1.454.CMB.1.raw
tcagcatagtagtgcacgaccggtgctcgatttagtatcactcagtcgcggggctcagagaggagccttagccctggactccaaggcctctccacttggtgatcagcactgagctgggttttccttgttgttatttagaaggtgtccaatgtgaggagcagctggtggagtcgtgggggagccgtggtccgagggccggggggtccctgacgactctcctgtggagcgtccggattcgactttgattacttattggatgagtcgtcgggtcccgccgaggcctccggaagggggaaggggcgtgggaggtggggtcggacccaacgaagtaaagggaagagtaggaagtgaagtaactttacgtttggtcgggtcttcgttaggtaggaacgggccgtattaccaacctagtcccgtaccgaaggtaaccgaaccaaaccggacccgaaaaggtaaacggttaccaaccgtttaggttaacttccgtaggaacctaaaagtacggaaaaccgtagttacgggtaggaacggtaacggtacgggaaacgggacccgtaacgggtctttaaggtttaacttttacgtttttccgtaggggttcggaccggggtaagggggccgtacccgggttacgtttacggttcggggtttaccccggggacccgtttaccggggaccgggggtaccccgtaaacgggggttaacccccgtttggggttaccccaacccgggtttcctaccgtaaccgttacccgaccggttccccctaaccccggaaacccgggtaaaccggggcccccttaaaccggg

SEQ ID NO: 95631 - DNA, 737 bp, Homo sapiens
  misc_feature: GYAE6OF01EV44N.10.85.H08.1.454.CMB.1.raw
tcagcatagtagtgcacgaccggtgctcgatttagtatcactcagtcgcgggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctggtccaggcccgggggggtccctggagactctcctggtggagcgtccggattcgactttgattacttattggatgagcgtgggtccgcaggctccgaggggagggctgggagtgggtcgccacgaagtaaaggagagtaggaagtgaagtaacttacgtttggtacgggtctcgttgggtacggaaacggggcccgtaatttacccgaacccgttaattccccgttacccgaaggaacggtaaacccaaaaccggacccaaaagggtaaacgtcccaacgtttacggtaacttccgtagaacctaaaagtcggaaacgagttggtaagaaggaacgttcggaaagggaccacgggtcttaaggttaacttacgtttttcgagggttaggggaccgggaaggggggggtacctccccggggttactttaaagggttcccgggggttttaccccggggaacccgttttaccggggtaccggggggggaccccctaaacgggggggttaaacccccccgg

SEQ ID NO: 95632 - DNA, 788 bp, Homo sapiens
  misc_feature: GYAE6OF01BGV70.10.85.H08.1.454.CMB.1.raw
  modified_base (442)..(442): a, c, t, g, unknown or other
  misc_feature (442)..(442): n is a, c, g, or t
tcagcatagtagtgcacgaccggtgctcgatttagtatcactcagtcgcgggggtctcagagaggagccttagccctggactccaaggcctctccacttggtgatcagcactgagcacagaggactcaccatggaattggggctgagtcttgggttttccttgttgttattttagaaggtgtccaatgtgaggagcagcgtggtggagtcgtgggggagccgtggtccgacgggcccgggggggtccctggacgtacctccgttccgtggtcggacggtccggtccggtattccgtactttgattacttagttggatggagtcgtcgggtcccgccgaggccgtaccggaaggggaacggggtcgtggggaggttcggggtcggacccaacgtaaagtaaaaggaagtagtaggaaagtagaacgtaaacgttacgtttggngggtctcgtaggtaggaacggtcctattccactactcctaccgaagaacgaaccaaccgaccaaagacgtcacgttgtactcgtagaacctaaagtacggaaacgtgtcggtaagaacggtacggtacgggaacggtaccgtacgggttacttacggtttaagtttaccgtttttcggaggggtttaccgggaccgggggttaaaggggggtacccggttccccggggttaacgttttaaacgggggtttccccgggggtttaaccccggggaaccccgttttaccggggggtaacccgggggggttaaacccccgggtaaacccgggggttttaaacccccccgg

SEQ ID NO: 95633 - DNA, 600 bp, Homo sapiens
  misc_feature: GYAE6OF01CQ6SW.10.85.H08.1.454.CMB.1.raw
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtggggggaggcctggtccaggccgggggggtccctggagactctcctgtggagcgtccggattcgactttgatacttattggatgagctgggtccgcaggctccgagggaaggggctggagtgggtggccaccagtaaaaggagagtagggaagtgagaacttacgtttgtgggctctggtgaagggccagttccaccatcctaccagacgacaaccgcaaagaagtcactgtatctgacaaatgaacgatgtagaagagtcgaaggacacgggctagtattatttctggtgcggaggggacgtccgggtactagttcgggttcggacccgttcgtcgggggcctagggggaaccccttcgggtacacccggttctaccgagttaccgacgtccccgtacccaacccggaacgggtccccctacgg

SEQ ID NO: 95634 - DNA, 826 bp, Homo sapiens
  misc_feature: GYAE6OF01EECA3.10.85.H08.1.454.CMB.1.raw
  modified_base (272)..(272): a, c, t, g, unknown or other
  misc_feature (272)..(272): n is a, c, g, or t
  modified_base (354)..(354): a, c, t, g, unknown or other
  misc_feature (354)..(354): n is a, c, g, or t
tcagcatagtagtgcacgaccggtgctcgatttagtatcactcagtcgcggggctcagagaggagccttagccctggactccaaggcctctccacttggtgatcagcactgagctgggtttccttgttgttattttagaaggtgtcaatgtgaggagcagctgggtggagtcgtggggggaggcctggtccgaggccgggggggtccctggagactctcctgtggagcgtccggattcgactttgattacttattggatgagcgtgggtccnccaggctccgaggggaagggctagggagtgggtggccaacgaagtaaagggagagtggaagtgaagtaacttacgttttggngggtcttcgtaggtaggaacggggccgtaatttccaacctatccctacgaaggaacgaaccgaaacgccaaaaggtaacgtaccgtacttaggtataccgtggaacctaaaagttgaaacggtataggtaggaacggtaggtaccgggaaagggtaccgaaccgggtctttaacgggtttaaatttactttttccggtagggttacgggaccggggtaagggggggtaccggtccccggggttactttaggggttaccgggggtttaccccgggtaacccgtttccgggggtaaccggggggtaccccggtaaaaccccggggggtaaaccccgttttccggggggttaacccctccccgggtttacccgttaccggtaaccgtttaccccggtaacccgggtaaccccccccgtttacccccggaaaaacccccggggttaaacgggggttccccccccttaaaccggggg

SEQ ID NO: 95635 - DNA, 764 bp, Homo sapiens
  misc_feature: GYAE6OF01CEU25.10.85.H08.1.454.CMB.1.raw
  modified_base (478)..(478): a, c, t, g, unknown or other
  misc_feature (478)..(478): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttatttagaggtgtcaatgtgaggagcagctggtggagtcgtgggggagcctggtccgagggcccgggggggtccctggacgactctcctgtggagcgtccggattcgtactttgattacttagttggatgagcgtcggggtccgccaggctccgaaggggaaggggctgggaggtcggggtcggaccaacgaagtaaaggaagagtagggaaagtggaagtaacttacgtttggtgggtctcgtggtaggaacgggcctattccaaccgtatcctaccgagaacgacaacgccaaaggactcaacgtgtaactcgtagaactaaaagtcggaaacgtagttacgggngtaaacgggtacggttacgggaaacgggtaccctaagggttccttaagggtttaaacttttacggtttttccggaggggttacggggacccggggtaaaggggggtacccgtacccgggtacgtttaacgggtttcccggggttaccccgggtaacccgttccggggttacggggggaacccccgttaacgggggttaacccccgttgggtacccgtaccccggtttcacgtaagtccccgacgttacccccgtcccgaaaaccgtcccggggcccttacccgggg

SEQ ID NO: 95636 - DNA, 845 bp, Homo sapiens
  misc_feature: GYAE6OF01BQ5NP.10.85.H08.1.454.CMB.1.raw
tcagcatagtagtgcacgaccggtgctcgatttagtatcactcagtcgcgggggtctcagagaggagccttagccctggactccaaggcctctccacttggtgatcagcactgagcacagaggactcaccatggaattggggctgagcttgggttttccttgttgtttatttagaaggtgtccaatgtgaggagcagcgtggtggagtcgtggggagccgtggtccgaggcccggggggtccctggagactcgtccgtggtggacgtcgtccggtattcgtactttgattacttagttggagtgagtcgtcgggtccgccgaggccgtccgaaggggaaggggcgtgggtagggtcgggtcggacccgaaccgtaaagtaaaaagggaacgtaagtagggaaaggtacgaaaggtaaaccgttaacgttttggtacgggtcgttccggtagggtacgggtaacgggtacccgtaacgttaccgaaccctacgttccctaacccgaaaggtaacccgaaacccgtaaaacccggaacccgtaaaaagggtaaaccgtttacctaaccggtttacgtttaacggttacccttaaacggaaacccgttaaaaaggttaccgggtaaaccgtaaggttgttaacgggaaacgggtaacgttaccggggaaacgggtacccgtaacccgggttcgttaaagtttaaggtttaccgtttttaggcgggttaccgggtaacgggggaaggggggtaccctacccccgggggttatttaaacgggttcggggtttaccccggtaccggttccggggtaacgggggtacccgtaaacccggggggttaaccccc

SEQ ID NO: 95637 - DNA, 627 bp, Homo sapiens
  misc_feature: GYAE6OF01A61U4.10.85.H08.1.454.CMB.1.raw
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
tcagcatagtagtgcacgaccggtgctcgatttagtatcactcagtcgcgggtcccacctttggttttggagatggttttctcgatgggggctgggaggcctggtccaggccgggggggtccctgagactctcctgtggagcgtccggattcgactttgatacttattggatgagctgggtccgcaggctccgagggaaggggctggagtgggtggccaccataaaggaagatggaagtgagaactactttgtgggctctggtgaagggccattcaccatctccagagacaacgccaagagtcactgtatctgacaaatgaacgatgtgagagtcgaggacacggctgtatattcngtgcggaggggnccggntagtcggttcgacctggtcggggcctacgggaccctggtccaccgtctcatcacgccctaccaccgaacggccctacgtccggtccttcccccgtggtccgccctcgcctccgacggacgtccacccgtaccgacgacgccgaacgcggcccgggcccgtcgggccttaccgggcccggttacgggtaccgtaaaaccgggaccctttaaccccgttacccccgtaacctttaaccgtaacgttcggtacccgg

SEQ ID NO: 95638 - DNA, 585 bp, Homo sapiens
  misc_feature: GYAE6OF01A1S26.10.85.H08.1.454.CMB.1.raw
  modified_base (252)..(252): a, c, t, g, unknown or other
  misc_feature (252)..(252): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
tcagcatagtagtgcacgaccggtgctcgatttagtatcactcagtcgcgggtcccacctttggttttggagatggttttctcgatgggggctgggaggcctggtccaggccggggggtccctgagactctcctgtggagcgtccggattcgactttgatacttattggatgagctgggtccgccaggctccagggaaggggctggagtgggtggccaccataaaggaagatggaagtgagaactactttgngggctctgtgaagggccattcaccatctccagagacaacgccaagaagtcactgtatctgcaaatgaacgatgtgagagtcgaggacacggctgtatatttctgtgcggagggganccggntagtggttcggacttgtcggggccaagggtaacccgtggtccaccgtctcactcagccctaccaaccgaacgggcccagtccggtccttcccccgtggcccgtcccgtcgccgtaccgacggacgtccacccgtccgaacgacgcacgacgccggcccgtgggctcgccgtggtaccgaacggtacctaccttacccaacttactgtcgtcg

SEQ ID NO: 95639 - DNA, 671 bp, Homo sapiens
  misc_feature: GYAE6OF01DXKUC.10.85.H08.1.454.CMB.1.raw
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtgggggaggcctggtccgaggcccgggggggtccctggagactctcctgtggagcgtccggattcgactttgatacttattggatgagcgtgggtccgccaggctccgaggggaaggggctgggaggtgggtcggccaaccgaagtaaaaggaagagtgggaagtgaagtaacttacgttttggtcgggtcttcgtgtaggaacgggccgtattccacctatcctaccgaagacgaacaacgccaaagaacgtcacttgtactctagacaaagtgaaacgtagtgtaggaaggtagtcggaaggacgacggtcttagttatttagtttcgtggtcggacgggagggggacgtcccgggtacttaggttcgggttccggacccgttcgggtcggggacccgtaacgggggtaccccttcgggtacccgtacccggttccgtaccgacgttaccgaccgtacccctacccgaaacccggaccggggtccccctaacggg

SEQ ID NO: 95640 - DNA, 681 bp, Homo sapiens
  misc_feature: GYAE6OF01B3HZ5.10.85.H08.1.454.CMB.1.raw
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtggggggaggcctggtccgaggccggggggtccctgagactctcctgtggagcgtccggattcgactttgattacttattggatgagcgtgggtccgccaggctccgaaggggaaggggctgggaggtggggtcggacccaaccgaagtaaaagggaagagtagggaaggtgaagtaactttacgtttggtgggctcgttggtaggaagggccgtaatttccacctactcctaccaaggaacgaacaaaccgaccaaaaggaacgtacaacgtgttaatccgtagaacaaaagttcggaaacgtatggtagaagaggtcggaacggacacgggtcttagttattattttcgtaggtcggacgggaggggacgtcccgggtatttaggttcggggttacccggaccgttcgggtcggggggacccaaccggggggtaaccccttgggtacccacccggttctaccgactcccgacgtcccctaccgaacccggacgggtcccctacgg

SEQ ID NO: 95641 - DNA, 717 bp, Homo sapiens
  misc_feature: GYAE6OF01BJ014.10.85.H08.1.454.CMB.1.raw
tcagcatagtagtgcacgaccggtgctcgatttagtatcactcagtcgcgggtcccaccttttggttttggagatggttttctcgatgggggctgggaggcctggtccaggccggggggtccctgagactctcctgtggagcgtccggattcgactttgatacttattggatgagctgggtccgccaggctccgagggaagggctggagtgggtgccacagtaaaggagatggaagtgagtaacttacgtttggtgggctcgtggtggaacgggtccgtaattccaaccattcctacccgaaggaacgaaccgaaaccggacccaaaaggaacggtcctaactggttaactcgtagaccaaaagtgaaacgtagtgtagagacggtacggaagacgacggtcttagtattagtttcgtggtcgacgggaggggtacgccgggtacttaggttcgggttcccggacgttcggacggggacccaagggggtaccccttgggtcccaccgttcgtacctacgtacgaccgccctaccgaaccgaacgggtccctacgttccggtcccttccccgtcggccctccgtcgcctaccggacgcgtccctaccgacgacgacgcgacgacgccccggtaccgtcgggccttcggacccgttgggaccgtaaaccggtaccccgtttacccgtacccccgtagttaaccgtacgtcggtacccgg

SEQ ID NO: 95642 - DNA, 769 bp, Homo sapiens
  misc_feature: GYAE6OF01DBMIN.10.85.H08.1.454.CMB.1.raw
  modified_base (410)..(410): a, c, t, g, unknown or other
  misc_feature (410)..(410): n is a, c, g, or t
  modified_base (437)..(437): a, c, t, g, unknown or other
  misc_feature (437)..(437): n is a, c, g, or t
  modified_base (757)..(757): a, c, t, g, unknown or other
  misc_feature (757)..(757): n is a, c, g, or t
tcagcatagtagtgcacgaccggtgctcgatttagtatcactcagtcgcgggtcccacctttggttttggagatggtttttctcgatgggggctgggaggcctggtccaggcccggggggtcctgagactctcctgtggagcgtccggattcgactttgattacttattggatgagcgtgggtccgccaggctcgagggagggctggagtgggtgccacagtaaaaggagagtggaagtgaagtaacttacgtttggtgggcctcgtggtagggaacgggccgtattccaacctatcctaccgaaggagaaaccaaccgaccgaaagaacgtccaacttgtaactctaggactaaagtgaacgtatggtagaggacgtagaacggtacacggtctagttacttatttcgnggttggacggaggggacgtacccggtntacgttcgggttaccggaccgtcggtacggggacccgtaacggggtacccgtcggtaccgtacccgttcctacactacccgtacgtacccgtacccgaaacccgtaccgggaccccttacggttccccggttaccccgtttccccccggtcgggtccccgtcccgttcgtacccgtacggtaccggaccgtacccgtacccgtacccgtaacggaccgacccgtaacgacccgggtcccggtacccggtccgggtccgcggtacccgttcgggtaaaccctaaaccgggtacccttaacccgttacccgaactttaccgngtccggtaccgg

SEQ ID NO: 95643 - DNA, 600 bp, Homo sapiens
  misc_feature: GYAE6OF01CCBRN.10.85.H08.1.454.CMB.1.raw
  modified_base (180)..(180): a, c, t, g, unknown or other
  misc_feature (180)..(180): n is a, c, g, or t
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (308)..(308): a, c, t, g, unknown or other
  misc_feature (308)..(308): n is a, c, g, or t
  modified_base (329)..(329): a, c, t, g, unknown or other
  misc_feature (329)..(329): n is a, c, g, or t
  modified_base (341)..(341): a, c, t, g, unknown or other
  misc_feature (341)..(341): n is a, c, g, or t
  modified_base (353)..(353): a, c, t, g, unknown or other
  misc_feature (353)..(353): n is a, c, g, or t
tcagcatagtagtgcacgaccggtgctcgatttagtatcactcagtcgcgggtcccacctttggttttggagatggttttctcgatgggggctgggaggcctggtccaggccggggggtcctgagactctcctgtggagcgtcggattcgactttgatacttatggatgagctgggtccncaggctcgagggagggctggagtgggtgccacataaagganatggaatgagtaactntttgnggctntgtgaagggcattcacatctcgagagacacgccaagagtcactgtatctgacaaatgaacntgtgagagtcgaggacacgtntgtatactttcngtgcgaggggancggatagtggtccgactcggtggggaccagggtacccgtggtacctaccgtcgtacagttccgaacgtccctaccgaaccgaacgggtccctagtcccggttacctttcccccggtgtccgtccccgtgtcctaccgacggacgtccaccgtcgaacgagccgacgacggcccgtaccgtggtccgtccggtaccgtcggtacgtaaacgggtaccttaccttcccaacgttacctagtcgtaccgg

SEQ ID NO: 95644 - DNA, 1161 bp, Homo sapiens
  misc_feature: GYAE6OF01DC8I0.10.85.H08.1.454.CMB.1.raw
tcagcatagtagtgcacgaccggtgctcgatttagtatcactcagtcgcggggctcagagaggagccttagccctggactccaaggcctctccacttggtgatcagcactgagcgtggtttctgttgttatttagagtgtcaatgtgagagcagctggtggagtcgtgggggagccgtggtccgacggccggggggtccctgagactctcctgtggagcgtccggtattcgtactttgattacttagttggatgagcgttcgggtccgaccgtacggccgttacccggaaggggggtaaacgggggtccgttaggggaaggggttcgggggtaccgggaccccctaaaccggaaaaggttaaaaacggggaaaggtaaggtaaggggtaaaggttaggtaaacggtaaaaccgttttccggtttttagggtcgggggtacctttccggtttagggtaacggggtaacgggggtaccccgttaaagttttaccccgaaacccgttaacttaccccgttaacccgtaaagggaaacccggaaacccgtaaaaccccgggaacccgtaaaaaaacgggaaacggttttaaccccgtaaaccgtttaaggtttaaacgtttacccggttaaacggaacccgttaaaaaaaaggggtttacggtaaaaacccggtttaaggtttagggtaaacggggtaaacgggttaaccgggtttaaccggggaaacgggaaacccccgggttaaccggggttaccgttttaaaggttttaacggttttaaacccgtttttttccgggttaaggggggtttaccggggaaccccgggggggtttaaacggggggggggtaacccgtttacccccgggggggtaacctttttaaaccgggggggtttttcccggggggttttaaccccccggggttaacccgggttccccggggggtttaaaccggggggaacccccccggtttaaaccggggggggttaaaacccccccggttttcgggggttaaacccccccgggtcccggtttttaccccggtaaacccgtaaacccgggtttaccccccggtaaaaccggtttcccccccccggtttaaacccccgaaaaccccccgggggttaaacgggggtttccccccccccttaaaacccccggggg

SEQ ID NO: 95645 - DNA, 740 bp, Homo sapiens
  misc_feature: GYAE6OF01CEOQ3.10.85.H08.1.454.CMB.1.raw
tcagcatagtagtgcacgaccggtgctcgatttagtatcactcagtcgcggggctcagagaggagccttagccctggactccaaggcctctccacttggtgatcagcactgagctgggttttcttgttgttatttagagtgtcaatgtgagagcagcgtggtggaggtcggtgggggacggtccgtggtacccgacggggtcccgggggggtccctggacgccttcctccgtggtggacgtccggtaccggtatttccggtacttttagactttactttagttggatggacgtcgtcgggtccgcgacggcgtccggaaggggacggggtcgtgggaggtggggtacgacctaacgaaagtaaaggaagtagtacggaagtagaagtaaacgttagtttggcgggtcttcgttaggtacggaacgggtaccgtactttaccaaccgtagttccctaccgaaaggaacgaaccgaaaccgaccgaaaggtactacgtactagttacgtactacgaactaaagtacggaaacgtagtaggtagaaagtggtaacggaggtaccgacgtctagttaagtttctttcggtggtcggacggggaacggggtcgaccggtacgttaggttccgggtcggtaccgtcgggtccggggaccgtaaccgggtaccgtcggtaccctaccggtcgaccgttacgccgtaccgaccccgtacccgacccggtaaccggtccccgtacccgg

SEQ ID NO: 95646 - DNA, 605 bp, Homo sapiens
  misc_feature: GYAE6OF01EG2CS.10.85.H08.1.454.CMB.1.raw
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtgggggaggcctggtccaggccgggggggtccctgagactctcctgtggagcgtccggattcgactttgatacttattggatgagctgggtccgccaggctccgaggggagggctggagtgggtggccacataaaggaagatgggaagtgagaacttactttggtgggctcgtggtgaagggccgtattccaaccatcctaccagaacgacaacgccaaagaagtcactgtatctagacaaagtgaaacgatgtagagagtcgaaggtacacggtcttagtaatttatttcgtggtcggcgggaaggggacgccgggtcttagttcggggttaccgccgtcggtcggggacccgaacggggtaaccccgtgggttacccacccggtctacgacttccgaccgtccctacccgaaccgaagggcccctacgg

SEQ ID NO: 95647 - DNA, 915 bp, Homo sapiens
  misc_feature: GYAE6OF01CNG9U.10.85.H08.1.454.CMB.1.raw
  modified_base (452)..(452): a, c, t, g, unknown or other
  misc_feature (452)..(452): n is a, c, g, or t
tcagcatagtagtgcacgaccggtgctcgatttagtatcactcagtcgcgggtccctacctttggttttggagattggttttctcgagtgggggctgggaggcctggtccaggccgggggtcctgagactctctgtggagcgtcggattcgactttgatacttatggatgagcgtggtccgcaggctcgagggaggctggagtgggcgccaacagtaaaggagagtggaatgaagtaacttacgtttggcggtctcgtggtacggaacgggcctacttccaacgtattccgacgagaacgaaccgaaaccgaccaaaaggtaacgtcctaacgttgtaactccgtaaggaaactaaaagttacggaaaacgtagttaggttacggaaggtaacgggttaacggaacggaaaccgaccggtacgttttaagtaactttttaccgttttagggnggttacggggaacccgggggtaacgggggtaaccgtcccgggtttaacgttaacggttttcgggggttaacccccgggtaaccgtcgggggttacccgggggtaaacccgtaaaccgggggttaaccccgttcggggttacccaaccgggtttccctaacggtaccgttaccccgaaccgggttaccctaaaccccggtaacccgggtaaacccgggtcccctttacggtttacccccggttccccgtttcccccggttagggcccccgttacccgtcgtaacccggtaccggaacgggtaccccgtaccgttaacccgacgggtaacgtaccgacccggttaacggacgggtcccggtcccgggttcggtcccggttaaccggccggtttaacgggaaaccgttaaaccgtacccgtttaaccccttaccgggtaacctttacggttagtccggtaaccggg

SEQ ID NO: 95648 - DNA, 704 bp, Homo sapiens
  misc_feature: GYAE6OF01D0Q24.10.85.H08.1.454.CMB.1.raw
  modified_base (407)..(407): a, c, t, g, unknown or other
  misc_feature (407)..(407): n is a, c, g, or t
  modified_base (495)..(495): a, c, t, g, unknown or other
  misc_feature (495)..(495): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtgggggagccctggtccgagggcccggggggtccctgagacctctcctgtggacgcgtccggattcgtactttgattacttagttggatgagcgtcgggtcccgccgaggcctccgagggggaacggggctgggaggtgggtcggacccaaccgaagtaaaaggaagagtagggaagtgaacgtaacttacgtttggcgggctcgtggtaggaacgggcctatcacctatccncgagacgacaacgaccaagaacgtcagtgtactcgagaacaaagtgaacgtagttacggagaggacggtacgaacggacaccgggttnttagttatttctttcggtggtcgggacgggacgggggaccgtccggtacgttacggttccgggttccggacccgttccgggtaccgggggacccgtaaaccgggggttaccccgttacgggtaccccgtaacccggttcctaccgtacccgtaccgacccgttaccccccaccggtaaacccccgggaccgggtcccccttaacccggg

SEQ ID NO: 95649 - DNA, 732 bp, Homo sapiens
  misc_feature: GYAE6OF01B78BR.10.85.H08.1.454.CMB.1.raw
  modified_base (342)..(342): a, c, t, g, unknown or other
  misc_feature (342)..(342): n is a, c, g, or t
tcagcatagtagtgcacgaccggtgctcgatttagtatcactcagtcgcgggtcccacctttggttttggagatggttttctcgatgggggctgggaggcctggtccaggcccgggggggtccctgagactctcctgtggagcgtccggattcgactttgatacttattggatgagctgggtccgccaggctccgaggggaaggggctgggagtgggtcggccaccaagtaaaggaagatgggaagtgaagtaacttactttggtgggctcgtgtggaacgggccattccacatctccagacgacaacgccaagtaagtcactgtatctgacaaatgaacgntgtagagagtacgaggacacggctagtattatttctggtgcggaggggcgccggcttaggtgggttccggacctcggtacggggaccgtaacggggtacccgtgggtccaccggttctactacgtcacgtccctaccgaacccgaaccgggccctagtccccggttacccttcccccgtacgggccccgtccccgttacggcccgtacccgaacgggaccgtacccgtaaccccggttacgaccggacgtacccgaaccggcccgggaccccgggtccccggtcgggggtacccttcggggtacccccggttgggttaaaccccggtaaaccgggttaccctttaaccccgtacccccgttaaaccgtacccgttaagtccggtaccggg

SEQ ID NO: 95650 - DNA, 700 bp, Homo sapiens
  misc_feature: GYAE6OF01AWPPK.10.85.H08.1.454.CMB.1.raw
  modified_base (540)..(540): a, c, t, g, unknown or other
  misc_feature (540)..(540): n is a, c, g, or t
  modified_base (655)..(655): a, c, t, g, unknown or other
  misc_feature (655)..(655): n is a, c, g, or t
tcagcatagtagtgcacgaccggtgctcgatttagtatcactcagtcgcggggctcagagaggagccttagccctggactccaaggcctctccacttggtgatcagcactgagcttgggttttccttgttgtttattttagaaggtgtccaatgtgaggagcagctggtggagtcgtgggggaggcctggtccgagggcccggggggtccctggagactctcctgtggagcgtccggattcgtactttgattacttagttggatggacgtcgtcggggtcccgccgaggccgtaccggaagggggaacggggcgtggggaggtcggggtcggacccaaccgtaagtaaaagggaagtagtagggaaggtggaagtaacttagttttggtcgggtcttcgtgggtaggaacgggtccgtattccaacctagtcctacgaaggacgaaccgaaccgaccgtaaagaacgtccacgttagtaactcgtagaacaaagtcgaaacgtagtcggtagaggtaggtacgaagggaaccgtacggtnttaggttaacgtttatttccgtggtacgggagggtacggggtaccgtccggtgttaacgtcggggttaccgccgtcgggtacggaccgtaccgggtacctggtaccaccggttcncgtagtccgaccgtccctaacccgaccggtaaccggcccttacgg

SEQ ID NO: 95651 - DNA, 771 bp, Homo sapiens
  misc_feature: GYAE6OF01DZ4ZL.10.85.H08.1.454.CMB.1.raw
  modified_base (501)..(501): a, c, t, g, unknown or other
  misc_feature (501)..(501): n is a, c, g, or t
tcagcatagtagtgcacgaccggtgctcgatttagtatcactcagtcgcggggctcagagaggagccttagccctggactccaaggcctctccacttggtcgatcagcactgagctgggtttccttgttgttatttagagtgtccaatgtgaggagcagctggtggagtcgtgggggagcctggtccgacgggccggggggtcctgagactctccgtggtaggacgcgtccggtattcgtactttgattacttagttggatggagacgttcgggtcccgaccgtaggtcctaccggaaggggaagggctgggacgtggggtcgacctaaccgaagtaaacggagtagtaggaagtagaagtaacttacgtttggtacgggtctacgtaggtaggaacgggtcctacttaccgaacctaacgttccgtacccgaaggaaacgtaaccgaaaccggaccgtaaagggtaaacgttccgtaaagttacgttaactccggttaanaaaccgtaaaagttcggaaacgtagttggaagaacggtacgggtaacggaacgggtaccgtacgggttactttaaggttaactttacggttttccgagggaacggtaaccgggggacggggtaccgtacccggtacgttaagggtttccggggtacccgaaccgtttcggggaacgggccccgtaaacggggttacccctgggtaaacccctcgttcaacgtcgtacccgaccgtacccgacccgaaaccggtcgggtccccttaccggg

SEQ ID NO: 95652 - DNA, 830 bp, Homo sapiens
  misc_feature: GYAE6OF01BGB22.10.85.H08.1.454.CMB.1.raw
  modified_base (288)..(288): a, c, t, g, unknown or other
  misc_feature (288)..(288): n is a, c, g, or t
  modified_base (644)..(644): a, c, t, g, unknown or other
  misc_feature (644)..(644): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaaggtcgtccaatgtgaggagcagctggtggaggtcgtgggggagcctggtccgagggcccgggggggtccctgacgactcctcctggtggacgtcggtaccggtattcgtactttgattacgttattggatggagtccgtgggtcccnccgaggcctccgaaggggacgggctgggaggtggggtcgacccacgaagtaaacggggagtagtggaaaggttggaagtaaccgtttacgttttacgggcggggtaccttcggttggtaaccgggtaaggggtccccggtaactttacccgaaaccccgtattacccgttacccggaaaggaaccgaacccgaaaacccggccccgtaaaaggaaaccgttcccaaacccggttgttaaacctcccggtaacgtacgaaaagttccgggaaacctaggttaccgtacggggaaatacgggttaaccggaaacgggtaccccgagggttactacggtttagttaacggttttttcgngggttaccgggaccgggagggggtaccgtacccgggtaccgttaagggttcccggggtaccgggtacccttcgggtcccgggggaccaacccgggggttaaccccgtggtaaccccgtacggtccgtacgacccggttaccgacgttccccctacgaaccccgggttaacgggcccccttaacggg

SEQ ID NO: 95653 - DNA, 681 bp, Homo sapiens
  misc_feature: GYAE6OF01DNQ2K.10.85.H08.1.454.CMB.1.raw
  modified_base (518)..(518): a, c, t, g, unknown or other
  misc_feature (518)..(518): n is a, c, g, or t
  modified_base (557)..(557): a, c, t, g, unknown or other
  misc_feature (557)..(557): n is a, c, g, or t
  modified_base (576)..(576): a, c, t, g, unknown or other
  misc_feature (576)..(576): n is a, c, g, or t
tcagcatagtagtgcacgaccggtgctcgatttagtatcactcagtcgcgggggtctcagagaggagccttagccctggactcaaggcctctccacttggtgatcagcactgagcacagaggactcaccatggaagttgggctgagcgttgggttttcttgttgttatttagaggtgtcaatgtgaggagcagcgtgggtggagtcggtgggggacgccgttgggtccgacgggtcccggggggttcctggacgtaccgttctccgtggtcggagtccggtaccggtagtttcgtacgttttagtatttacttagttaggataggacgtcgttcgggtaccgccgagggccgtacggaaggggacgggtcgtgggacggtgggtccgaccgtaacaaaggtaaggaagtagtaggtaagtagaaagtacttagtttaggtggcttacgtggtacggaacggccttaagtcacagttccacgagacgaacaacgcaaagtactcgaactgtactacganaacgtaaagtggaaacgtgtggtaaggaacgttaacggnggtaacgtacccaggggtnttacgttaacttgtttcggaggttcggacgggaacggggcggttaggcccgttagttacggggttcccacccgtgggtacccgggaccgtaaaccggggtacccg

SEQ ID NO: 95654 - DNA, 775 bp, Homo sapiens
  misc_feature: GYAE6OF01DODG9.10.85.H08.1.454.CMB.1.raw
tcagcatagtagtgcacgaccggtgctcgatttagtatcactcagtcgcgggggtctcagagaggagccttagccctggactcccaaggccctctccacttggtgatcagcactgagcacagaggactcaaccatggaaattggggctgagtcgttggtttttccttgtttgttatttttagaaggtgtcaagtgtgaggagcagcgtggtggagtcgtgggggacgccgtgggtccgacgggtcccgggggggtccctggacgaccgtcctccgtggtggagccgtccggattcgtacgtttgaattacttagttggatgacgtcgtcgggtccgccgaggccgtaccggaaggggaagggcgtgggacggttgggtcgacccaaccgaaagtaaaagggaacgtagtaggaaagtaggaaacgtaactttacgtttggtcgggtccttacggtggtacggaacgggtaccgtaattacccgaacctacgtttaccgacccgaaaggtaaccgaaacccgtaaaccggacctaaaaggtaaacgttcctaacgtttggttaacttcgtaacgaactaaacgttggaaaaccgttgtacggttaggaacggtaacgggtaccgggaaaggaacccgtacgggttctttaacggtttaaactttcgttttccgttgggtaccgggtaacgggtacgggggtaccgtcccgggtatttacgggttcgggtttacccggtaccgttggggaccgggcccgttaaccggggtaaccccg

SEQ ID NO: 95655 - DNA, 854 bp, Homo sapiens
  misc_feature: GYAE6OF01D24ZD.10.85.H08.1.454.CMB.1.raw
tcagcatagtagtgcacgaccggtgctcgatttagtatcactcagtcgccgggtcccacctttggttttggagatggttttctcgagtgggggctgggaggcctggtccaggccggggggtccctgagactctcctgtggagcgtccggattcgactttgattacttatggatgagctcgggtccgccaggctccgaggggaaggggctggaggtgggtcggccaacagtaaaggaagatagggaaaggtgaacgtaaacttacgtttggtcggggtccttcgttggtacggaaacggggcccgtaattccacctaagttcctaccgaaggaacgaacaaacccgccaaaagggtaaacttccaacgttagtacttcgtaggtaaccaaaagttcggaaaacgtgttggtaacggaggacggttacggaaacgggtacgaccgggttctagttttaaacgttgtttttcgagggtacgggtacgggaaaggggggcgtccgggtactttaggtccggggttaccgggtaccctcgggtaccggggggaacccgaaacgggggttaccccggtacggttacccgtacccggttactaccgtactaccgtacgccccgtaacccgtaccccggaacgggtccccgtaacgttcccggtccccgtttcccccggtacgggtcccccgtcccgttaccgtcccgttaccggaacgggtacccgtacccgtaccccgttacccggacgaccggaccaaccgggacggcccgggtcccggtacggggtccgtaccggtccggttcggtaaccggtaacgtacccgttacccgtacccctaacgttaacttgtcggtacgg

SEQ ID NO: 95656 - DNA, 889 bp, Homo sapiens
  misc_feature: GYAE6OF01D275H.10.85.H08.1.454.CMB.1.raw
  modified_base (180)..(180): a, c, t, g, unknown or other
  misc_feature (180)..(180): n is a, c, g, or t
  modified_base (272)..(272): a, c, t, g, unknown or other
  misc_feature (272)..(272): n is a, c, g, or t
tcagcatagtagtgcacgaccggtgctcgatttagtatcactcagtcgcgggtcccactttggtttggagatggttttctcgagtggggctgggaggcctggtccaggccgggggtcctgagactctctgtggagcgtcggattcgactttgatacttagttggatgagtcgtgggtccncaggtctaccgaggggagggtctaggtaggttgggtcgaccaacgaagtaaaaggaagtagtggaaagtgaagtaaaccgtttaggtttggngggtccttacgtggtagggaaacgggtcctaattccgaacctacgttaccgtaccgaaggtaaccgtaaacccgaaaccggtaacccaaaaggtaaacggttcctaacgttcggttaacttcccgtaagtaaaccgtaaaaagttacggaaaacggttagttggtagggaaaggtaggtacggaacggtaaccgaggtctttaagtttacgttagttttcgtaggggttacgggaacggggtacgggggaccgtacccggtttagtaacgggttttccgggtaaccccgggtacccttacgggggttccgggggaaaccccggtaaccggggttaaccccgttacgggtaccccttacccggttactacccgtaacgtcccgtaaaccgtccccgttaacccggaaacccggtaccgggtacccgttaaccgtccccggtttcccctcccgttacggtcccgtcccgtagtccgtacgacggtccaaccgtccgtaccgaagcccgacgtacgtaccgggtccgtccgggttacggccgttacggtacggttacgtaaccgggtaacttaaccccggtttcccctaaccggttaaccttaccgtactcggtaacggg

SEQ ID NO: 95657 - DNA, 862 bp, Homo sapiens
  misc_feature: GYAE6OF01BVBL4.10.85.H08.1.454.CMB.1.raw
  modified_base (184)..(184): a, c, t, g, unknown or other
  misc_feature (184)..(184): n is a, c, g, or t
tcagcatagtagtgcacgaccggtgctcgatttagtatcactcagtcgcgggggtctcagagaggagccttagccctggactccaaggcctctccacttggtgatcagcactgagcacagaggactcaccagtggaagttgggctgagtcgttgggttttcttgtttagttattttagaaggtntaccaatggtgaggagcagtcgtgggtggagtcggtgggggacgccgtggtccggacgggtcccggggggttcctggacgtacctcgtccgtggtcggcggtccgtccggtacttcgtacgtttgactttacgttagttggtactggtacgtcggtttcggggcccgaccgtacgggtcccgttaccgggaaggggggtaacggggccggttaggggtacgggttcgggggtacgaaccccgtaaaccgtaaaggtaaaacgggaagtaggtaggtaaacggttaggaaacggttaaccgtttaggttttcggggtcgggtcctttaccggttagggtaaaccggggtaaccggggtaccttaacgtttacccgaaccctttaggtcccctaacgaagggtaacaacccggtaacccggtaacgtaaaacggtacgttaccgtaaacgttggttaacctcggttaacgaacttaaacggtacggaaacgtaggttcggttaaggacgggtacgtacgggacgtaacgtcggtagtttagttaacgtttacgtttccgggtaagggtacgggacggggtacggggtacccggtacggttacgtttaaccgggtccggggtttacccgacccgggtttagggggtacccgggtacccggggtaaccccgggttacccggg

SEQ ID NO: 95658 - DNA, 799 bp, Homo sapiens
  misc_feature: GYAE6OF01ASPSH.10.85.H08.1.454.CMB.1.raw
  modified_base (186)..(186): a, c, t, g, unknown or other
  misc_feature (186)..(186): n is a, c, g, or t
  modified_base (253)..(253): a, c, t, g, unknown or other
  misc_feature (253)..(253): n is a, c, g, or t
  modified_base (353)..(353): a, c, t, g, unknown or other
  misc_feature (353)..(353): n is a, c, g, or t
tcagcatagtagtgcacgaccggtgctcgatttagtatcactcagtcgcgggtcccaccttttggttttggagatggttttctcgatgggggctggggaggcctggtccaggccgggggggtccctgagactctcctgtggagcgtccggattcgactttgatacttattggatgagctgggtccnccaggctcgagggagggctggagtgggtggccacgataaaggagatggaagtgagaacttactttgngggctctggtgaagggccgattccaccatctccagacgacaacgccaagaacgtcactgtatctcgacaaatgaacgtatggtagagagtacgagggacncggtcttagtattagtttcgtggtcgacgggagggggacgtcccggattacggttcgggtttacccggaccgttcggtacggggggacccctacgggggttaaaccccgttcgggtacccgtacccggttcctacgtacctaccgaccgtccccgttaccccgaaacccggaacccggggtcccctaacggtccccggtttaccccgtttccccccggtcgggtccccgtccccgttcgtcccgtacccggacgggtaccgacccgtaccccgtacccggtaacggaccggaccctaaccggaccgggtcccgggaccccggttcgggggtccccgttcccggggtacccggttccgggggttaaccccgaaacgggggttacccctttaaacccccggtttaccccctaaaccgttttaccgttaaccggttccggtaacccggg

SEQ ID NO: 95659 - DNA, 785 bp, Homo sapiens
  misc_feature: GYAE6OF01ER4HQ.10.85.H08.1.454.CMB.1.raw
tcagcatagtagtgcacgaccggtgctcgatttagtatcactcagtcgcgggaggagcagttcaacagcacgttccgtgtggtcagcgtcctcaccgtcgtgcaccaggactggctgaacggcaaggagtacaagtgacaaggtctccaaacaaaggccctacccgaggtccggggggtcctgacgactctccgtgtggagcgtccggattcgactttgatacttattggatgagcgtggtcgccaggcctcgagggacggggtctaggaggtgggtcgacccaaccgtaagtaaaaggaagtagtagggaaacgtagtaacgtaactttacgtttgggtacggggaccttaggttaggtacgggaaagggcccttaacgttacccaactagttacctaccgtaaagaaccggtaaaccaacggtaccgaaaattaacggtacctacgtaacgttaatcctaaggaactaaaatcggttaaagacttgggtaagaacgggtacggttacggaacggtacgaacgggtacttaaggttaattacgtttaacgtcggttagggacgggtaaggggacgtaccggacgtttacgtacgggttaaccggtccgttacgggtacccggggtaccggaacgggtaacccgtcggtaccggtaccgttacgtacgtaccgttacaccgtacccctaaacccgaacccggtaacggtacccccgtacggttcccggttaccccttccccggtacgtacccgcccgtaacccgtcgttaacccgacggtacccg

SEQ ID NO: 95660 - DNA, 890 bp, Homo sapiens
  misc_feature: GYAE6OF01DH1I6.10.85.H08.1.454.CMB.1.raw
  modified_base (189)..(189): a, c, t, g, unknown or other
  misc_feature (189)..(189): n is a, c, g, or t
  modified_base (215)..(215): a, c, t, g, unknown or other
  misc_feature (215)..(215): n is a, c, g, or t
tcagcatagtagtgcacgaccggtgctcgatttagtatcactcagtcgcgggtcccacctttggttttggagatggtttttctcgagtgggggctggggaggcctggtccaggcccgggggggtccctgagactctcctgtggagcgtccggattcgactttgattacttattggatgagctgggtccncagctcgagggagggctggagtgggngccaacataaaggagagtggaagtgaagtaacttcgttggtgggctcgtggtaggacgggccgtattccaactatcctacgaagaacgaaccaacgaccaaaaggtacgtacctaacgttgtaactcgtaacgaactaaaagtcggaaacgtattggtagtaacggaggtaaccggaaggtaaccggccggtactttaggttaatttacgttttcgtcgggtacggtaacgggggaaggggtaccggtcccgggttacttacgggttaccggggtttcccgggtaacccgttccggggtaccggggggaccccgtaaaccgggggttacccggtcgggttacccgtaccccggtttacctacgtaacgtcccgtaaccgtaccccgtaacccggaaccccgggtaacccgggtccccgttaaccggttcccccggtttcccccgttaccccccggttacccgggtcccccgttcccgttaccggtccccgtaacccgggaccggacccggtaccccgtaccccgttaccggaaccggtaacgcccgaaccggtaccgggtccccgggtcccggtacgggtcccgtaccggttaaccccgggttcggtaaacccggtaaccggttaaccccgtacccctttaacccgtaccctttaaccgtacgtcggtacccggg

SEQ ID NO: 95661 - DNA, 807 bp, Homo sapiens
  misc_feature: GYAE6OF01E3ATF.10.85.H08.1.454.CMB.1.raw
  modified_base (400)..(400): a, c, t, g, unknown or other
  misc_feature (400)..(400): n is a, c, g, or t
tcagcatagtagtgcacgaccggtgctcgatttagtatcactcagtcgcggggctcagagaggagccttagccctggactccaaggcctctccacttggtgatcagcactgagctgggtttccttgttgttattttagagtgtccaatgtgaggagcagctggtggagtcgtggggagcctggtccaggccggggggtccctggacgactctcctgtggacgcgtccggattcgactttgattacttattcggatgacgtcgtggggtcccgcgagggtcctaccggaggggaaacgggggctaggggagtcgggggtcgaccccgtaacccgaagtaaaaacgggaagtaagtaggggaaacggttaggaaacggtaaaccttaacgttttttacgggnggggtaccctttacgttacggggttacgggtaaaccggggtcccgtaaacttttacccggaacccgtaaacgtttcccgtaacccgaaaaggtaacggaaacccgtaaacccggtaccccaaaaagggtaaacgttcctaaacgtagttaccttaccgtacgggaaactaaaacgttagaaacgtattacggtaaggtaggtaacggtaccgggaggaaccgtacggtacgttagtaatttaccgtttcgacggtggtacgggacggggactccggggtacttacgggtacggttcggtaaccccgttggccgggacccgaacgggtacccggtgtacccgtacccggttccgttaccaagtaccctacgaccccttacccgaacccggtacggcccccttaccggg

SEQ ID NO: 95662 - DNA, 789 bp, Homo sapiens
  misc_feature: GYAE6OF01D2U1C.10.85.H08.1.454.CMB.1.raw
  modified_base (433)..(433): a, c, t, g, unknown or other
  misc_feature (433)..(433): n is a, c, g, or t
  modified_base (509)..(509): a, c, t, g, unknown or other
  misc_feature (509)..(509): n is a, c, g, or t
tcagcatagtagtgcacgaccggtgctcgatttagtatcactcagtcgcggggctcagagaggagccttagccctggactccaaggcctctccacttggtgatcagcactgagctgggtttccttgttgttatttagaaggtgtccaatgtgaggagcagcgtggtggagtcgtggggggagcctgggtccgagggtcccgggggggtccctggacgacctctccgtggtggagtccggtccggtattccgtacttttgaattacttattggatgagcgttcgggtcccgaccgaggcctaccggaagggggaacggggctggggaggtcggggtcggaccccaacgtaagtaaaagggaaggacgtaggggaagtgtaagtaaccttgtttaggtgggtctcgtaggtacggaacgggccgtataccaaccngtcctaccgaagtaacgaactaaccggccaaaaggtagtacctacgtagtatcgtacgaactaaagtggaaacgtnttagggtaagtaaggacggtaacgggacgggaaccgtacggtattaggtttaatttcgtttacgtgggtacgggaccggggaggggtaccgtacgggttcttacgggttccggggttaccggacccgttcggggtaccggggaacccgggtaacccggggttaacccgttcggggttaacccccgtaaccggttccctaacggtaccccttaacccgggacccgttaccccccacccgggaacccccggggtaaacccgggtccccccttaaacccgggg

SEQ ID NO: 95663 - DNA, 134 bp, Homo sapiens
  misc_feature: GYAE6OF02JAT4E.10.85.H08.1.454.CMB.1.raw
  modified_base (134)..(134): a, c, t, g, unknown or other
  misc_feature (134)..(134): n is a, c, g, or t
tcagcatagtagtgcacgaccggtgctcgatttagtatcactcagtcgcggggctcagagaggagccttagccctggactccaaggcctctccacttggtgatcagcactgagcgggctggcaaggcgcatagn

SEQ ID NO: 95664 - DNA, 548 bp, Homo sapiens
  misc_feature: GYAE6OF02IRIKB.10.85.H08.1.454.CMB.1.raw
  modified_base (369)..(369): a, c, t, g, unknown or other
  misc_feature (369)..(369): n is a, c, g, or t
  modified_base (398)..(398): a, c, t, g, unknown or other
  misc_feature (398)..(398): n is a, c, g, or t
  modified_base (433)..(433): a, c, t, g, unknown or other
  misc_feature (433)..(433): n is a, c, g, or t
  modified_base (468)..(468): a, c, t, g, unknown or other
  misc_feature (468)..(468): n is a, c, g, or t
tcagcatagtagtgcacgaccggtgctcgatttagtatcactcagtcgcgggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccaggccgggggggtccctgagactctcctgtggagcgtccggatttcgactttgatacttattggatgagctgggtccgcaggctccgaggggaagggctggagtgggtgccacagtaaaggagatggaagtgaagactagtttgnggctctgtgagggcattcacatctcaganacaacgccaagatcactgtatctgacaaatgaacntgtagagagtcgagacaggcttagtattatttcgngtggcgggtaaggggcgccgggtcgttaagtcggggtttacccggaccttcgggtacgggggcccaaggggtaacccccg

SEQ ID NO: 95665 - DNA, 598 bp, Homo sapiens
  misc_feature: GYAE6OF02J3KQF.10.85.H08.1.454.CMB.1.raw
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
  modified_base (497)..(497): a, c, t, g, unknown or other
  misc_feature (497)..(497): n is a, c, g, or t
tcagcatagtagtgcacgaccggtgctcgatttagtatcactcagtcgcgggtcccacctttggttttggagatggttttctcgatgggggctgggaggcctggtccagccggggggtccctgagactctcctgtggagcgtccggattcgactttgatacttattggatgagctgggtccgccaggctccgagggaagggctggagtgggtggccaccataaaggaagatggaatgagaactacgtttgtgggctctggtgaagggccattcacatctccagagacaacgccaagagtcactgtatctgcaaatgaacgatgtgagagtcgaggacacggctagtacttattcgtgtgcggaggggacgccggatagtggtccgaccgtcgtcgggggacctacggggaaccctggtcaccgtctacactcacgcctaccgaccgaacgggcccagtccggtccttccccgnggccncccgtgcctcgacggtacnccgtaccgtcggacgacgccacgacggcccggtcccgtgggtcctcggacccgtgggttaccaaacggtccctaccgtaccccactacctagtcgtaccgg

SEQ ID NO: 95666 - DNA, 554 bp, Homo sapiens
  misc_feature: GYAE6OF02IYAG5.10.85.H08.1.454.CMB.1.raw
  modified_base (449)..(449): a, c, t, g, unknown or other
  misc_feature (449)..(449): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtgggggaggcctggtccaggccgggggggtcctgagctctcctgtggagcgtccggattcgactttgatacttattggatgagctgggtccgccaggctccgagggagggctggagtgggtggccaccgataaaggagatggaagtgagaactactttgtgggctctgtgaagggccgattcaccatctccagagacaacgcaagagtcactgtatctgacaaatgaacgatgagagagtcgaggacacgctgtatatttctggtgcggaggggngccggtatagttgggttaccgaccgttcgtcgggggccacggggtacccgttgggacctaccggttctcatccacgtccctacccgaccgaacgggcccctacgg

SEQ ID NO: 95667 - DNA, 532 bp, Homo sapiens
  misc_feature: GYAE6OF02FN422.10.85.H08.1.454.CMB.1.raw
  modified_base (331)..(331): a, c, t, g, unknown or other
  misc_feature (331)..(331): n is a, c, g, or t
  modified_base (454)..(454): a, c, t, g, unknown or other
  misc_feature (454)..(454): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtctgggggaggcctggtccagccggggggtccctgagactctcctgtggagcgtccggattcgactttgatacttattggatgagctgggtccgccaggctccagggaagggctggagtgggtggccacataaaggagatggaagtgagaactactttgngggctctggtgaagggccgattcaccatctccagagacaacgccaaagaagtcactgtatctgcaaatgaacgatgtgagagtcgaggacacggctgtatatttctgtgcgaggggagccggntagtggttcggacctcgtggggccagggaccctgggtccaccgtctaccatcgacgccctccaccgacgggccctacg

SEQ ID NO: 95668 - DNA, 531 bp, Homo sapiens
  misc_feature: GYAE6OF02IWX3Y.10.85.H08.1.454.CMB.1.raw
  modified_base (334)..(334): a, c, t, g, unknown or other
  misc_feature (334)..(334): n is a, c, g, or t
  modified_base (437)..(437): a, c, t, g, unknown or other
  misc_feature (437)..(437): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtctgggggagcctggtccaggccggggggtccctgagactctcctgtggagcgtccggattcgactttgatacttattggatgagctgggtccgccaggctccgagggaaggggctgggagtgggtggccacataaaggagatggaagtgagaactactttgngggctctgtgaagggccattcacatctcagagacaacgccaaagagtcactgtatctgacaaatgaacgatgtgagagtcgaggacacggctgtattatttcngtgcggaggggngccggntagtgggttcggacgtgcggggccagggacccgtggtaccaccgtctcatcacgccctccaccgacgggccctacg

SEQ ID NO: 95669 - DNA, 605 bp, Homo sapiens
  misc_feature: GYAE6OF02HKQJ4.10.85.H08.1.454.CMB.1.raw
  modified_base (347)..(347): a, c, t, g, unknown or other
  misc_feature (347)..(347): n is a, c, g, or t
  modified_base (465)..(465): a, c, t, g, unknown or other
  misc_feature (465)..(465): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtggggggaggcctggtccaggccgggggggtccctgagactctcctgtggagcgtccggattcgactttgatacttattggatgagctgggtccgccaggctccgaggggaaggggctggaggtgggtggccacaagtaaaggaagagtgggaagtgagaacttacgtttggngggctcgtggtggaagggccgattcaccatctccagagacaacgcaaagaagtcactgtatctagacaaatgaacgatgtagaagagtcgaaggacacggcttagtaattattttcgnggtggacggagggggtacgccgggtacttagttcggggttcccggaaccgttcgggtcgggggacccaacgggggtaacccctgggtacccaccggtctcgatccgacggtccctacccgaaccgacgggtcccctacgg

SEQ ID NO: 95670 - DNA, 556 bp, Homo sapiens
  misc_feature: GYAE6OF02IVNF6.10.85.H08.1.454.CMB.1.raw
tcagcatagtagtgcacgaccggtgctcgatttagtatcactcagtcgcgggaggagcagttcaacagcacgttccgtgtggtcagcgtcctcaccgtcgtgcaccaggactggctgaacggcaaggagtacaagtgcaaggtctccaacaaaggcctcccagccggggggtccctgagactctcctgtggagcgtccggattcgactttgatacttattggatgagctgggtccgccaggctccagggaaggggctggagtgggtggccaccataaaggaagatggaagtgagaactactttgtgggctctgtgaagggccgattcacatctccagagacaacgccaagaagtcactgtatctgcaaatgaacatgtgagagtcgaggacacggctgtattatttctgtgcggaggggagccggctagtggttcggtacttcgtggggtccgacggggtacccgtggtccgaccgtctcatcgacgcctaccaccgaacgggcccactccggtccttcccccgtcggcccgtcccgtcgccgtcccgaggtaccg

SEQ ID NO: 95671 - DNA, 651 bp, Homo sapiens
  misc_feature: GYAE6OF02H62ZS.10.85.H08.1.454.CMB.1.raw
  modified_base (298)..(298): a, c, t, g, unknown or other
  misc_feature (298)..(298): n is a, c, g, or t
  modified_base (499)..(499): a, c, t, g, unknown or other
  misc_feature (499)..(499): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttatttagaaggtgtccaatgtgaggagcagctggtggagtcgtggggggaggcctggtccgaggccggggggtccctgagactctccgtgtggagcgtccggattcgactttgatacttattggatgagcgtgggtccgcaggctcgaggggaaggctggagtgggngccaacaagtaaaggaagagtggaaagtgaagtaacttacgtttggtgggcttcgtggtaggaaacggggcctaattccaacctatcctaccgaagaacgaacaaaccgtccaaaagaacgtcaacgtgtaactctagaacaaaagtgaaacgatggtagagacggtcgaaggtacacggtactagttaacttattttagnggttagggaccggtaagggggacgtcccgggtattaaggttcgggttccggaacccgttggtacgggggaccctaaggggtaccccgtggtacccgaccgtacctcgaagttccgaactccccgtacccaaaccggacgggtcccctaacgg

SEQ ID NO: 95672 - DNA, 562 bp, Homo sapiens
  misc_feature: GYAE6OF02GTG6P.10.85.H08.1.454.CMB.1.raw
  modified_base (485)..(485): a, c, t, g, unknown or other
  misc_feature (485)..(485): n is a, c, g, or t
  modified_base (491)..(491): a, c, t, g, unknown or other
  misc_feature (491)..(491): n is a, c, g, or t
  modified_base (537)..(537): a, c, t, g, unknown or other
  misc_feature (537)..(537): n is a, c, g, or t
tcagcatagtagtgcacgaccggtgctcgatttagtatcactcagtcgcggggctcagagaggagccttagccctggactccaaggccctctccacttggtgatcagcactgagctgggttttccttgttgttattttagaaggtgtccaatgtgaggagcagctggtggagtcgtgggggaggcctggtccaggccggggggtccctgagactctcctgtggagcgtccggattcgactttgattacttattgggatgagctgggtccgccaggcctccgaaggggaaggggctgggaggtggggtcggcccaccaagtaaaaggaagagtagggaagtgaagaacttactttggtgggctcgtggtaggaaggggccattccaccatcctcagacgacaacgccaaagaacgtcactgtatctgacaaatgaacgatgtgagagtcgaaggacgacggctgtattatttctgtgcggaggggngccggntagtggttcgactgcgggccagggaccctggcctaccgtctcatcncgccctaccaccgacgggccctacg

SEQ ID NO: 95673 - DNA, 557 bp, Homo sapiens
  misc_feature: GYAE6OF02IRO4P.10.85.H08.1.454.CMB.1.raw
  modified_base (435)..(435): a, c, t, g, unknown or other
  misc_feature (435)..(435): n is a, c, g, or t
  modified_base (456)..(456): a, c, t, g, unknown or other
  misc_feature (456)..(456): n is a, c, g, or t
  modified_base (467)..(467): a, c, t, g, unknown or other
  misc_feature (467)..(467): n is a, c, g, or t
  modified_base (485)..(485): a, c, t, g, unknown or other
  misc_feature (485)..(485): n is a, c, g, or t
  modified_base (529)..(529): a, c, t, g, unknown or other
  misc_feature (529)..(529): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtctggggggaggcctggtccaggccgggggggtccctgagactctcctgtggagcgtccggattcgactttgatacttattggatgagctgggtccgccaggctccgaggggaaggggctgggagtgggtggccaacagtaaaaggagagtggaagtgaagaacttactttggtgggcttcgtggtagaacggggccgtaatttcgaacctatcctacagagacaaacgccaaagaagtcactagtatctgacaaatgaaacgntgtgagagtcgaggacacggntgtattatttngtgcggagggagccggtntagttcggtcggactcgcgggccagggaccctggtacaccgtcncatcacgccctaccgacacggccctacg

SEQ ID NO: 95674 - DNA, 569 bp, Homo sapiens
  misc_feature: GYAE6OF02G90IB.10.85.H08.1.454.CMB.1.raw
tcagcatagtagtgcacgaccggtgctcgatttagtatcactcagtcgcgggtcccacctttggttttggagatggttttctcgatgggggctgggaggcctggtccagccgggggggtccctgagactctcctgtggagcgtccggattcgactttgatacttattggatgagctgggtccgccaggctccagggaaggggctggagtgggtggccacataaaggagatggaagtgagaactactttgtggctctgtgaagggccgattcaccatctccagagacaacgccaaagaagtcactgtatctgcaaatgaacgatgtgagagtcgaggacacggctgtatatttctgtgcgaggggagccggctagtggtcgacctgtggggccagggacctggtcaccgtctcatcacgcctccaaccgaacggcccagtccggtaccttccccgtggccgccctgcctccgagcgccacctccgagacgcacgacggccggcccgtcggggcctccggccgtcgggtaccaagggacccttaccgttccccaccttacttagcgtaccg

SEQ ID NO: 95675 - DNA, 551 bp, Homo sapiens
  misc_feature: GYAE6OF02GGGZH.10.85.H08.1.454.CMB.1.raw
tcagcatagtagtgcacgaccggtgctcgatttagtatcactcagtcgcgggtcccacctttggttttggagatggttttctcgatgggggctgggaggcctggtccagccggggggtccctgagactctcctgtggagcgtccggattcgactttgatacttattggatgagctgggtccgccaggctccagggaaggggctggagtgggtggccaccataaaaggaagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccgggctagtgggttcggaccttcgtgggggcccagggaaccctggtcaccgtctcatcagcctccaccaagggcccatccggtccttcccccgtggtcgccctgcctccacggcgccacctccgagacgcacagccggccctgggctgcctggtcaaggactaccgttcccactactatgcg

SEQ ID NO: 95676 - DNA, 835 bp, Homo sapiens
  misc_feature: GYAE6OF02H2ZG1.10.85.H08.1.454.CMB.1.raw
  modified_base (249)..(249): a, c, t, g, unknown or other
  misc_feature (249)..(249): n is a, c, g, or t
tcagcatagtagtgcacgaccggtgctcgatttagtatcactcagtcgcgggtcccacctttggttttggagatggttttctcgatgggggctgggaggcctggtccaggcccgggggggtccctgagactctcctgtggagcgtcggattcgactttgatacttattggatgagctgggtccgccaggctcgagggagggctggagtgggtgccacataaaggagatggaagtgagaactactttggngggcttcgtggtggaagggccgattcacctatctcagagacaacgccaagagtcactgtatctagacaaatgaacgatgtgaggagtcggaaggactacgggtctaggtattactttcgtaggtcggacgggaaggggggacgtcccgggtagttaagttcgggggtttacccggaacccgtttcggggttacgggggggacccctaaacggggggtaacccccgtttcggggttacccgtaaccccggtttccttacccgtaacgttaccgaaccgtccccgttacccgaaacccggaaaccgggggtaccccttaacggtttcccccggggttaccccgttttcccccggttcgggttccggtccccgttcggtacccttacccggaaccggggtaccgtacccgtaaccccgttcccgggacgaaccggtaccgaacccggtacgggtaccccggggtccccggttccgggggcccgttccgggtaccccggttacgggtttaaccccggaaacgggttaaccccgtttaccccgtttaacccccgttaacccgtttaaccgttaccgttccggttaacccgg

SEQ ID NO: 95677 - DNA, 542 bp, Homo sapiens
  misc_feature: GYAE6OF02HL0ZC.10.85.H08.1.454.CMB.1.raw
  modified_base (414)..(414): a, c, t, g, unknown or other
  misc_feature (414)..(414): n is a, c, g, or t
  modified_base (448)..(448): a, c, t, g, unknown or other
  misc_feature (448)..(448): n is a, c, g, or t
  modified_base (460)..(460): a, c, t, g, unknown or other
  misc_feature (460)..(460): n is a, c, g, or t
  modified_base (466)..(466): a, c, t, g, unknown or other
  misc_feature (466)..(466): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtgggggaggcctggtccaggccggggggtccctgagactctcctgtggagcgtccggattcgactttgatacttattggatgagctgggtccgcaggctccgagggaaggggctgggagtgggtggccaccagtaaaaggagagtggaagtgaagaacttactttgtgggctctgtgaagggccattcacatctccagagacaacgccaaagaagtcactgtatctgacaaatgaaacgntgtagagagtcgaggacacggctagtatatttcngtgcggaggggngccggnttagtcggttcgaccgtcgtggggccagggaccctggtccacgtctacatcacgcctaccgacacgggccctacgg

SEQ ID NO: 95678 - DNA, 712 bp, Homo sapiens
  misc_feature: GYAE6OF02HBKCV.10.85.H08.1.454.CMB.1.raw
  modified_base (560)..(560): a, c, t, g, unknown or other
  misc_feature (560)..(560): n is a, c, g, or t
tcagcatagtagtgcacgaccggtgctcgatttagtatcactcagtcgcgggggtcgtcagagaggagccttagccctggactccaaggcctctccacttggtgatcagcactgagcacagaggactcaccatggaattgggctgagcgtgggttttccttgttgtttatttagaaggtgtcctaatgtgaggagcagctggtggagtcgtgggggaggccgtggtccgacgggccgggggggtccctgacggaccgtccgtccgtggtggacgtccggtccggtattcgtacgttttgaattacgtttagttggtaagttgaggtcgtcggggtcccgaccgaggtcctccggaaggggaaggggtctagggacgggttggggtcgggaccaaccgaagtaaacgggaagtagtaggaaggtgaacgaacttacggtttggtcgggcttcgtaggtacggaagggtccgtattacgacctacgttcacccgaagacgaacgaaaccggaccaaagaacgtacacgttaaggtactcgtagaacaaaacgtgaaaccgtnagggttagaagtacgtacggaaggtaaccgacgggtatacggttaatttaacgtttcaggttcggaacgggaggggttaccggacccggttatacgggttacgggtttcccggaaccgtttcgggacggggtccggaaccgggttaacccgg

SEQ ID NO: 95679 - DNA, 634 bp, Homo sapiens
  misc_feature: GYAE6OF02J1TET.10.85.H08.1.454.CMB.1.raw
  modified_base (354)..(354): a, c, t, g, unknown or other
  misc_feature (354)..(354): n is a, c, g, or t
  modified_base (424)..(424): a, c, t, g, unknown or other
  misc_feature (424)..(424): n is a, c, g, or t
  modified_base (472)..(472): a, c, t, g, unknown or other
  misc_feature (472)..(472): n is a, c, g, or t
  modified_base (577)..(577): a, c, t, g, unknown or other
  misc_feature (577)..(577): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtgggggaggcctgggtccaggcccgggggggtccctggagactctcctgtggagcgtccggattcgactttgatacttattggatgagcgtgggtccgccaggctccgaggggaggggctgggagtggggtggccaccgagtaaagggagagtaggaagtgaagtaacttacgtttgggnggtctcgtggtaggaacgggccgtattccacgtatcctacaggacgaacaacgcaaagacgtcactgtanctagacaaagtcggaaacgtgtagtagagagtcggaagaacgacggtntagttattacgttcgtggcggtacgggagggcggacccggtagttaggttccgggttaccgtaccgtcgggtcggggacccgaacgggtacccggtggttacccnccggtctaccgacgtaccgcgaccccgttaccgaaccggtacccgggccctaccggg

SEQ ID NO: 95680 - DNA, 703 bp, Homo sapiens
  misc_feature: GYAE6OF02H1SQH.10.85.H08.1.454.CMB.1.raw
tcagcatagtagtgcacgaccggtgctcgatttagtatcactcagtcgcgggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggagcctggtccaggccgggggggtccctgagactctcctgtggagcgtccggattcgacttgatactattggatgagctgggtccgcgaggcctccgaaggggagggctggaggtgggtcggccacgaagtaaaggaagagtaggaagtgaagtaaacttacgttttggtggggcttcgttaggtaggaaggggtcccgaagttttcccaacctactaccttaccgaacgaacgaaccgaaaccggaccaaaacggaaacgtaccgtaacgttagttaacgtacgtacgtacgtaaaagtaggaaaaccgtaagtacggttaaggaacggaacgtaccgggaacggaaccgtaacgggacgttaagttaacttaacgtttacgttaggtaggtagggtaacggggtacgttacccggtaaccccccggaagggtaaacgggtcggttaacgggtttaaccgtaacgttttacggtttacggttaacccgg

SEQ ID NO: 95681 - DNA, 602 bp, Homo sapiens
  misc_feature: GYAE6OF02JL9MI.10.85.H08.1.454.CMB.1.raw
  modified_base (383)..(383): a, c, t, g, unknown or other
  misc_feature (383)..(383): n is a, c, g, or t
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
tcagcatagtagtgcacgaccggtgctcgatttagtatcactcagtcgcgggggtctcagagaggagccttagccctggactccaaggcctctccacttggtgatcagcactgagcacagaggactcaccatggaattggggctgagctggttttccttgttgttattttagagtgtcaatgtgaggagcagctggtggagtcgtgggggaggcctggtccaggccggggggtccctgagactctcctgtggagcgtccggattcgactttgatacttatggattgagtcgtgggtccgccgaggcctaccggagggacggggctgggagtggggtgaccaacaagtaaaaggaagagtaggaagtgacgtaacttagtttgnggtctgtgtaggaaggccatcacatccgnagagacaacgcgaaanacgtcaactgtactcgagacaaagcgaacgattgacgaagaggtccgaagggactacggtcgttagtactttaagttcgttaaggtcgggaacgggaagggtacgtcccgaggtttaacgtcgggggttaaccggcccgttcgggtacccggggaccgtaaccggggtaccccg

SEQ ID NO: 95682 - DNA, 587 bp, Homo sapiens
  misc_feature: GYAE6OF02GDYQY.10.85.H08.1.454.CMB.1.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (358)..(358): a, c, t, g, unknown or other
  misc_feature (358)..(358): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (475)..(475): a, c, t, g, unknown or other
  misc_feature (475)..(475): n is a, c, g, or t
  modified_base (482)..(482): a, c, t, g, unknown or other
  misc_feature (482)..(482): n is a, c, g, or t
tcagcatagtagtgcacgaccggtgctcgatttagtatcactcagtcgcgggtcccacctttggttttggagatggttttctcgatgggggctgggaggcctggtccagccgggggggtccctgagactctcctgtggagcgtccggattcgactttgatacttattggatgagctgggtccgccaggctccaggggaagggctggagtgggtgccaccataaaggaagatggaagtgagaactactttgnggctntgtgaagggccattcaccatctccagagacaacgccaagagtcactgtatctgacaaatgaacgatggtagagagtcgaaggacacggctagtattatttcngtgcggaggggacnccggntagtgggttccgacctggtggggccagggaccctggtacctaccgtctcactcacgccctaccaaccgacgggccctacgtccggttcccttccccgnggtcccnccctcgcctccgaggaccgcctaccgtccgagacgaccacgacggccggcccgtcgggcctcgccgtggaccgaaggtccctaccttacccactactagtcgtcg

SEQ ID NO: 95683 - DNA, 519 bp, Homo sapiens
  misc_feature: GYAE6OF02IFP9A.10.85.H08.1.454.CMB.1.raw
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (356)..(356): a, c, t, g, unknown or other
  misc_feature (356)..(356): n is a, c, g, or t
  modified_base (387)..(387): a, c, t, g, unknown or other
  misc_feature (387)..(387): n is a, c, g, or t
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (463)..(463): a, c, t, g, unknown or other
  misc_feature (463)..(463): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtggggggaggcctggtccaggccgggggggtccctgagactctcctgtggagcgtccggattcgactttgatacttattggatgagctgggtccgcaggctccaggggaagggctggagtgggtgccacataaaggagatggaatgagaactatttgtgggctntgngaagggcattcacanctccagagacaacgccaagaagtcactgtanctgacaaatgaaacgntgtgagagtcgaggacacggntgtatnttctgtgcggaggganccggntatggtcgctgngggcacgggaccctggaccaccggctacatcacgtcctaccacgacgggcctacgg

SEQ ID NO: 95684 - DNA, 645 bp, Homo sapiens
  misc_feature: GYAE6OF02GW2OX.10.85.H08.1.454.CMB.1.raw
  modified_base (386)..(386): a, c, t, g, unknown or other
  misc_feature (386)..(386): n is a, c, g, or t
  modified_base (478)..(478): a, c, t, g, unknown or other
  misc_feature (478)..(478): n is a, c, g, or t
tcagcatagtagtgcacgaccggtgctcgatttagtatcactcagtcgcgggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtcgtgggggaggcctgggtccgaggcccggggggggtccctggagactctcctgtggagcgtccggattcgactttgatacttattggatgagctgggtcccgccgaggctccgaggggaaggggctgggagtgggtggccaccgagtaaaggaagagtggaagtgaagtaactatttggngggtctcgtggtggaacgggccgtattccgacctatccgtccaaggacgaaccaaacgccaaagtaacgtcactgttaactctgactaaagnggaacgtatgagagtacggtacggacgggaaccacgggcttaggttaacttagttttactgggtacgggacgggtaacgggggaccggtcccgggtacgtttaaggttcggggtttacccgggaaccgtttccgggtacggggggtaccccaagggggtaacccccg

SEQ ID NO: 95685 - DNA, 611 bp, Homo sapiens
  misc_feature: GYAE6OF02HK8PJ.10.85.H08.1.454.CMB.1.raw
  modified_base (292)..(292): a, c, t, g, unknown or other
  misc_feature (292)..(292): n is a, c, g, or t
  modified_base (569)..(569): a, c, t, g, unknown or other
  misc_feature (569)..(569): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttatttagaaggtgtccaatgtgaggagcagctggtggagtcgtgggggaggcctggtccgaggccgggggggtccctgagactctcctgtggagcgtccggattcgacttgatacttattggatgagctggtccgcaggctcgagggagggctggagtggngccacgaagtaaaggagagtaggaagtgagtaacttaatttggagggcttcgtgtaggaacgggcctaattccaacctatcctcaagacgacaacgacaaagatcatgtatctgacaaagtgaaacgtagtggtagaagtaggtacgaagggaccacggcttaggtattatttccgtggtggacgggtaaggggcgcccgggtacttaggttcggggttacccgaccgttcggacgggggtacccgaacggggtaccccgttgggtccgtacccgtntaccagttccgaccgccctaccgaaccgacgggccctaacgg

SEQ ID NO: 95686 - DNA, 556 bp, Homo sapiens
  misc_feature: GYAE6OF02FSI66.10.85.H08.1.454.CMB.1.raw
  modified_base (455)..(455): a, c, t, g, unknown or other
  misc_feature (455)..(455): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtgggggaggcctggtccaggccgggggggtccctgagactctcctgtggagcgtccggattcgactttgattacttattggatgagctgggtccgccaggctccgagggaagggctggagtgggtgccaccataaaggaagatggaagtgagtaactactttggtggctctgtgaagggccgattcacatctaccagagaacaacgccaaagaagtcactgtatctagacaaatgaaacgatgtagagagtcggaaggacacggtctagtaattatttcgngtggcggaggggacgcggactagtggttacggaccgtgtcgggcacgggtaccctggacctaccggtctacgatcacgccctaccacgaacgggccctacg

SEQ ID NO: 95687 - DNA, 652 bp, Homo sapiens
  misc_feature: GYAE6OF02JGGAB.10.85.H08.1.454.CMB.1.raw
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
tcagcatagtagtgcacgaccggtgctcgatttagtatcactcagtcgcggggctcagagaggagccttagccctggactccaaggcctctccacttggtgatcagcactgagctgggttttcttgttgttattttagaaggtgtccaatgtgaggagcagctggtggagtcgtgggggaggcctggtccaggccggggggtccctgagactctcctgtggagcgtccgattcgacttgatacttatggatgagctgggtccgccgaggctccgaggggaagggcgtggaggtgggtcggcccaaccgaagtaaaagggaagtagtaggaagtggaacgtaacgttacgtttggtgggcttcgtggtaggaacgggtccgattccgacctatcctacgagacgaccaacgaccaaagaacgtcacgtgtactcgngaacaaagtcgaaacgtntgtagagagtcgaggacgacggcttgtattctttcgtggtcggacgggagggacgtcccggtattaacgttcgggttaccgaccgtcgggttacggggacccgtaacggggtaccccgtttgggaccctaccggttccgtaccgtaagtacccgtaaccggtcccctacccgaaccgggaacccgggtcccctaacggg

SEQ ID NO: 95688 - DNA, 669 bp, Homo sapiens
  misc_feature: GYAE6OF02HXB7N.10.85.H08.1.454.CMB.1.raw
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (383)..(383): a, c, t, g, unknown or other
  misc_feature (383)..(383): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (536)..(536): a, c, t, g, unknown or other
  misc_feature (536)..(536): n is a, c, g, or t
  modified_base (612)..(612): a, c, t, g, unknown or other
  misc_feature (612)..(612): n is a, c, g, or t
  modified_base (635)..(635): a, c, t, g, unknown or other
  misc_feature (635)..(635): n is a, c, g, or t
  modified_base (640)..(640): a, c, t, g, unknown or other
  misc_feature (640)..(640): n is a, c, g, or t
tcagcatagtagtgcacgaccggtgctcgatttagtatcactcagtcgcggggctcagagaggagccttagccctggactccaaggcctctccaccttggtgatcagcactgagctgggtttccttgttgttattttagaaggtgtccaatgtgaggagcagctggtggagtcgtggggggacgggtcctgggtccgagggcccggggggggtcccctggacgactctcctgtgggagcggtccggattcgtacgtttgaatacttagttggatggagcgtcggggtccgcgtacggctaccggagggaacgggggctgggaggtgggtcggcaccagtaaaagganagtaggaagtgganaacgtacgtttgcggacttcgngtggaacgggcaacgttccactacgttccacgtacgaaacgacaaacccggacaaacgaaggttcaacgtgtaacttnacganaaaacgtgaaaccgtaagtggtacgaagtagacggaaggacgaaacgggctaggttaattattacgtggngaaccgggaggggaacgtccgggtaactgggttcggtaccgggtaccgttcggcggggtaccgacgggtaacccgngggttcccacggtcctaccgtanaccgngaccctacccgaacgacccggactaccgg

SEQ ID NO: 95689 - DNA, 644 bp, Homo sapiens
  misc_feature: GYAE6OF02JTM8O.10.85.H08.1.454.CMB.1.raw
  modified_base (522)..(522): a, c, t, g, unknown or other
  misc_feature (522)..(522): n is a, c, g, or t
  modified_base (531)..(531): a, c, t, g, unknown or other
  misc_feature (531)..(531): n is a, c, g, or t
  modified_base (583)..(583): a, c, t, g, unknown or other
  misc_feature (583)..(583): n is a, c, g, or t
tcagcatagtagtgcacgaccggtgctcgatttagtatcactcagtcgcgggggtctcagagaggagccttagccctggactccaaggcctctccacttagtgatcagcactgagcacagaggactcaccatggaattggggctgagctgggttttccttgttgttatttcaaaaggtcgtcactgtgaggttcaacgtggtggagactgggaggaggcgtaggatccaggccgtggggggtccctggagactctcctagtgacacgcctcgtgggttacacggctatacacgtaacgactacagttcgaccggtacggcccgcgacggcctaccggaggggaacggggctgggagtcgggtctcgtaagtactaggaaacacggagtcgcgtaacacgtaattactttaatcgtacgtacgtccgtaggaaacgggttcccggtactaccccgttctaccgacggacgtaacctaccgttaccaacaactagttacctttagacctttcgtaacactaacncgtcctaanaacttcgtacgtacgaacgttacgaccgaacgtaacccggtccaaccgtttnttaacgttgtacgcgtacgactacgtccgaaacgttccgcttactaacggcgttaccgggg

SEQ ID NO: 95690 - DNA, 628 bp, Homo sapiens
  misc_feature: GYAE6OF02HB59H.10.85.H08.1.454.CMB.1.raw
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (394)..(394): a, c, t, g, unknown or other
  misc_feature (394)..(394): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (432)..(432): a, c, t, g, unknown or other
  misc_feature (432)..(432): n is a, c, g, or t
  modified_base (450)..(450): a, c, t, g, unknown or other
  misc_feature (450)..(450): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaggtgtccaatgtgaggagcagctggtggagtcgtgggggaggcctggtcccgaggccgggggggtccctggacgactctcctgtggagcgtccggattcgtacttgattacttattggatgagctgggtccgcgaggctccgaggggaagggctggagtgggtcgccaccagtaaaggagagtggaagtgagactnttgnggctctgtaggaggctatcacntccacagacacaacgccaagactcactgtacnctgacaatgaacntagngaggacgtcggaggtacacgngttagtactttatttcgngtagggacgggaggggacgtcccgggtgttaacgttcgggttaccggtacccgtgggtaccgggggacccgaacggggtaacccccgttgggtaacccgtacccggttcttaccgacgttacccgtaaccggtcccccttaccccggaaaccggtaccccggggtccccttacccggg

SEQ ID NO: 95691 - DNA, 588 bp, Homo sapiens
  misc_feature: GYAE6OF02FQ0OK.10.85.H08.1.454.CMB.1.raw
  modified_base (449)..(449): a, c, t, g, unknown or other
  misc_feature (449)..(449): n is a, c, g, or t
  modified_base (461)..(461): a, c, t, g, unknown or other
  misc_feature (461)..(461): n is a, c, g, or t
  modified_base (504)..(504): a, c, t, g, unknown or other
  misc_feature (504)..(504): n is a, c, g, or t
tcagcatagtagtgcacgaccggtgctcgatttagtatcactcagtcgcgggggtctcagagaggagccttagccctggactccaaggcctctccacttggtgatcagcactgagcacagaggactcaccatggaattggggctgagctgggttttccttgttgttattttagaaggtgtccaatgtgaggagcagctggtggagtctgggggaggcctggtccagccgggggggtccctgagactctcctgtggagcgtccggattcgactttgatacttattggatgagctgggtccgccaggctccgagggaaggggctgggagtgggtggccaccaagtaaaggaagagtggaagtgaagaactacgtttggtgggctcgtgtggaaggggccgtattccacctatctccagacgacaacgccaaagaagtcactgtaatcgtanacaaatgaacgnttagtgaggagtcggaggacgacggctgttaattagttttcgnggttggaccgggagggggtacgcccgggtacgttagttcgggtttccggaaccgttggtacgggggcccgaaggggtaaccccg

SEQ ID NO: 95692 - DNA, 670 bp, Homo sapiens
  misc_feature: GYAE6OF02F29QL.10.85.H08.1.454.CMB.1.raw
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtgggggaggcctggtccaggccggggggtccctgagactctcctgtggagcgtccggattcgactttgattacttattggatgagcgtgggtccgccgaggctccgaggggaacggggcgtggaggtggggtggccaacaagtaaaggagagtaggaagtgagtaacttacgttggtggtctgtggtaggaacgggcctagtaccacctatcctaccgaggacgaacaaccgacaaaggaacgtcacgtagtactcgtacgactaaatcggaaacgattggacgagacggtacgacgggaccacggtcttagttacttaagtttcggcggttaggacggggtagggggaccgtccgggtattacgggtttcgggtaccggaccgttgggtccgggggtacccgtaaccgggtacccggttgggtaccctacccggttactaccgtacggtaccaccgttaccccaaccggaacccgacggggtccccttaaccggg

SEQ ID NO: 95693 - DNA, 720 bp, Homo sapiens
  misc_feature: GYAE6OF02JZHX5.10.85.H08.1.454.CMB.1.raw
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
tcagcatagtagtgcacgaccggtgctcgatttagtatcactcagtcgcgggtcccacctttggttttggagatggttttctcgatgggggctgggaggcctggtccaggcccggggggtccctgagactctcctgtggagccgtccggattcgactttgatacttatggatgagctcgggtccgccaggctccgaggggaaggggctgggagtggggtcggccaccgaagtaaaacgggagtacgtagggaagtggaagtaaccttacgtttggtgggccttcgtaggtggaaacggggcctattccgaaccattcctccaaggaacgaaccgaaaccgtcccgaaaagaaacgttccaacgttggtaacttcgtcgacaaaagtgaacgagtgtagagagtcggaagccacggctntattactttcnggtagcgggaggggacgccggtacgttaagtcggggttccgaccctgggccggggacccgtagggaccccgtggtacccgtccgtacgtcacgtcacgccctaccgaccgacgggccctacgtcccgttccgtaccccgtcggccgtcccttcggccctccgacggggacctccgtacccgaccggtacgaccgacgaccggaccggacccggtcccgtggtacccggtccggtaccgtccggtaccgtaccgaccgttacccggtaccctaccgtacgtacgtccgtcgg

SEQ ID NO: 95694 - DNA, 815 bp, Homo sapiens
  misc_feature: GYAE6OF02HUWGU.10.85.H08.1.454.CMB.1.raw
tcagcatagtagtgcacgaccggtgctcgatttagtatcactcagtcgcggggctcagagaggagccttagccctggactccaaggcctctccacttggtgatcagcactgagcttgggttttccttgttgttatttagaggtgtccaatgtgaggagcagctggtggagtcgtgggggaggccgtggtccgagggccgggggggtccctggacgactctcctggtggagcgtccggattcgtactttgattacttagttggatgagcgtgggtccgcgacggctaccggaggggaggggcgtgggaggtggggtcggacccaaccgaagtaaaagggaagtaggtaggggaagtggaacgtaacgttacgttttgggtgggtctcgttagggtagggaacgggccgtaatttccaacctagtccgtaccgaaaggaacgaaaccgaaaccggtaaccgaaaaaggtaacgtccgtaacgtttacgtaacttacgtagaaacctaaaagttcggaaaacgtagttagggtaaggaaggtaagggtaccgaaacggggaaccgtacgggtacttaaggtttaagtttacttttaccggttaggggtacgggtaccgggggtaaggggggacccgtaccggggttaccgtttaaagggtttccgggggtttaaccggcccggtttaggggtacccggggggtaccccggtaaccgggggttaacccccgttggggttaccccgtaacccggtttcctaccggtacgtcccgaccgtcccccgtaacccggaacccggtacccgggcccctaacgggg

SEQ ID NO: 95695 - DNA, 667 bp, Homo sapiens
  misc_feature: GYAE6OF02G2A5I.10.85.H08.1.454.CMB.1.raw
  modified_base (636)..(636): a, c, t, g, unknown or other
  misc_feature (636)..(636): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtgggggaggcctggtccaggccgggggggtccctggagactctcctgtggagcgtccggattcgactttgatacttattggatgagctgggtccgcgaggctccgagggaaggggctgggagtggggtcggccaccaagtaaaagggaagagtagggaaggtgaacgtaacttacgttttggtggggtcttcgtggtagggaacggggcccgtaatttccgaacctattcctaccgaaggacgaccgaaaccggacccaaaagtaacgtaccaacttagttatacgtagactaaaagttggaaaccgtagttggtaagagtaacggtacggaacggtacgacgggtcttagttaatttatttcgtaggtggtacgggaggggacgccgggtatagttcgggttaccggaccgttggcggggaccgacgggtaacccgttgggaccctacggtctacgagtcncgtaccctccgaacccgtacgggccctacgg

SEQ ID NO: 95696 - DNA, 729 bp, Homo sapiens
  misc_feature: GYAE6OF02GS2BK.10.85.H08.1.454.CMB.1.raw
tcagcatagtagtgcacgaccggtgctcgatttagtatcactcagtcgcgggggtctcagagaggagccttagccctggactccaaggcctctccacttggtgatcagcactgagcacagaggactcaccatggaattggggctgagctgggttttccttgttgttattttagaaggtgtccaatgtgaggagcagcgtggtggagtcgtgggggagcctggtccgaggccggggggtcctgagctctccgtgtggagccggtccggtattcgactttgattacttagttggatgagtcgtgggtcccgccgaggctaccgaggggaaggggcgtagggaggtggggtcggaccaaccgtaagtaaacggaagagtggaagtgaagtaacttacggtttgtcgggacttcgtaggtacggaacggggtcctaacgtttaccacccgtatccgtaccaaggtaacgaaccgaaccggacctaaacgggaaccgttacctaaacgtttggtaactttccgtacgtaacgtaaaacgttacgaaaccggatttacgggtaacggacgttaaggggcccggtaaggaccgtacgggtacttaaggtttagtttacgtttcgtacggtaggggtaccgggaagggggttacgacccggggttataccgggttttaggttcccccgggaaccgttttcgggacccgggggtacccggaaccggggtttaaccccg

SEQ ID NO: 95697 - DNA, 679 bp, Homo sapiens
  misc_feature: GYAE6OF02FNY9C.10.85.H08.1.454.CMB.1.raw
  modified_base (506)..(506): a, c, t, g, unknown or other
  misc_feature (506)..(506): n is a, c, g, or t
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtgggggagcctggtccaggccggggggtccctgagactctcctgtggagtcgtcggattcgtactttgatacttattggatgagtcgtgggtccgccaggcctcgagggaagggctggagtgggtgccaacaagtaaaggagagtaggaagtgaagtaacttagttggtcgggtctgtggtacggaacgggccgtaattccacctatcaccagacgaaccgaacgaccaaaggaacgttcactgtactctagacaaatcgaaacgagtgtagacggtagtaccggaagggacccgtacgggtactagttaacttagttttcgtggttacggnggggtaacggggtacgggaccggttacgttaaggttcggggttcccggtaaccgttacgggttcgggggacccgtaaccgggggtaacccgtcgggttacccgtaaccggttcgtacctacggtacccgacggtccccttaacccggacccgtaaccgggtcccctaaccggg

SEQ ID NO: 95698 - DNA, 708 bp, Homo sapiens
  misc_feature: GYAE6OF02I2XVG.10.85.H08.1.454.CMB.1.raw
  modified_base (259)..(259): a, c, t, g, unknown or other
  misc_feature (259)..(259): n is a, c, g, or t
  modified_base (586)..(586): a, c, t, g, unknown or other
  misc_feature (586)..(586): n is a, c, g, or t
tcagcatagtagtgcacgaccggtgctcgatttagtatcactcagtcgcgggtcccacctttggttttggagatggttttctcgatgggggctgggagcctggtccagccggggggtccctgagactctcctgtgagcgtccggattcgactttgatacttattggatgagctgggtccgccaggctccgaggggaagggctgggagtgggtcgccaaccagtaaaagggagatgggaatggacgtaacttactttggngggcctcgtggtggaacgggccctattccaaccattcctccagtaacgaaccaaccgaccaaagaacgtccaactggtaactctgacctaaatcgaacgatgtaggagacgtcggaaggaccacgggtctacgttagttacttttcgtggttaggacgggtaagggggacgtaccggacgtttaaggttccggggtttaccgacccgttcgggtaccggggggtccctaaccggggtaacccgtcgggttaaccacccgggttctaccgtatccgacgtccctacccgacccgaacgggcccttagtcccggttacccgttccccgnggcccctcccgtacgccttaccgacgtacgccctaccgtcgaagtacgccaacgcgccggccgtggcgtcgccgtacggtacgaccggtaccttaccgtaccctactacgtacgttcgacgg

SEQ ID NO: 95699 - DNA, 888 bp, Homo sapiens
  misc_feature: GYAE6OF02ITBMQ.10.85.H08.1.454.CMB.1.raw
tcagcatagtagtgcacgaccggtgctcgatttagtatcactcagtcgcggggctcagagaggagccttagccctggactccaaggcctctccacttggtgatcagcactgagcttgggttttccttgttgtttatttagaggtgtccaatgtgaggagcagctggtggagtcgtgggggacgccgtggtccgagggcccgggggggtccctaggacgaccttcttccgtggtggacgtccggtccggtattccggtactttgattacttagttggatgacgtcgtcgggtcccgccgaggtcctaccggaaggggaacggggtcgtaggggacgggttggggtcggaccctaaccgtaaaggtaaaacgggaagtaaggttagggaaaggtacggaaagtaaccgtttagtttcgggtcgggtacttcggttagggtacgggaacggggtcctaacgttacccaacctacgttaccgaccggtaaaggaaccgtaaccgaaaccggaaccgtaaaaggtaaacgtaccgtaacgtttacggtaacgtccgttaacggaaactaaaaggttacggaaagggtagttaaggtagggtaacggtaacggtaacgggaacgggtaaaccgtacgggttacgttaaacgttttacgttaacgttttccgggtagggtaacggggtaccgggggtaacgggggtaccggaccccgggttaaggtttaccgggtttccgggggttaacccggtacccggttacgggggtacccgggggtaccccgtaaaccggggttccccggttacggtaccccgttaccggttaccctacgtacctacccggaaccgtaccccgtaacccggtaacccggacccgggttcccttaacccggg

SEQ ID NO: 95700 - DNA, 709 bp, Homo sapiens
  misc_feature: GYAE6OF02F51K9.10.85.H08.1.454.CMB.1.raw
  modified_base (552)..(552): a, c, t, g, unknown or other
  misc_feature (552)..(552): n is a, c, g, or t
tcagcatagtagtgcacgaccggtgctcgatttagtatcactcagtcgcggggctcagagaggagccttagccctggactccaaggcctctccacttggtgatcagcactgagcgtgggttttccttgttgttatttagaagtgtccaatgtgaggagcagctggtggagtcgtggggggagccgtggtccgacgggccggggggtcctggagtcctctcgtggtggacgccgtccggtattccgtacgtttgacttacttagttaggagtgagtcgtcgggtcccgcgaggctaccggaggggacggggcgtgggaggtgggtcgaccgtaacaaggtaaaggaagagtaggaaggtagaagtaaactttcggtttggtgggtccttcgtggtacggtaacgggtcctacgttaccacctactccgtacgacgtaacgaaccaaccgacaaaaggtacgtacctacgttatacgtacgtacgaagtaaacgtcgaaagtagtgaggaacggtacggtacggacggtaaccgaggttcgttacgtaactttntttacggtacggttaggaaccgggtggggacccggtcggtacgttacggtttacggtcggtccggtcggtaccgggtaccgggtacggtaccccggtgtacccggtacctaccgtcgtacgtcgtaccgccctaaccgcccggtaccgcgttacccg

SEQ ID NO: 95701 - DNA, 648 bp, Homo sapiens
  misc_feature: GYAE6OF02HXEPT.10.85.H08.1.454.CMB.1.raw
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
tcagcatagtagtgcacgaccggtgctcgatttagtatcactcagtcgcgggtcccacctttggttttggagatggttttctcgatgggggctgggaggcctggtccagccgggggggtccctgagactctcctgtggagcgtccggattcgactttgatacttattggatgagctgggtccgccaggctccgagggagggctggagtgggtggccaccataaaaggaagatggaagtgagaactactttgtgggctcgtgtggaagggcgattcacatctccagagacaacgccaaagaacgtcacgtgtactctgactaaagtgaacgatgtgagagtcggagacacggnttgtattnttcgngtgcggagggngccgtagtacgttggtcgaccgtcggtcgggaccgacgggaacccgtcggcctaccgtctcactcgacgccctaccgaccgaccgggtaccacgttccggtcccgttacccccgtcgggccgtacccgtcgtcctaccgaacggtccgacctacccgtcggaacgacgaccgacgccggaccgtcccggtacgggccctaccggtacccgttacggtacccgtaacggtacccttaacccttaccccgtaacgttaccgtacgtcgtaccgg

SEQ ID NO: 95702 - DNA, 959 bp, Homo sapiens
  misc_feature: GYAE6OF02ISDL4.10.85.H08.1.454.CMB.1.raw
tcagcatagtagtgcacgaccggtgctcgatttagtatcactcagtcgcggggctcagagaggagccttagccctggactccaaggcctctccacttggtgatcagcactgagctgggttttccttgttgttattttagaaggtgtccaatgtgaggagcagctggtggagtcgtggggggaggtcctggtccgagggcccgggggggtccctgacgaccttctccgttggtggacggccggttccgggtattccggtacttttagaactttaaccttttagttaggatgggtaggtccgttcggggttccccgccggtaacgggtccgttacccgggaagggggggaaacgggggtccgtagggggtacggggttgggggtccggaccccgaaacccgtaaaaggttaaaaaacggggaaaggtaagttaaggggtaaaagggttcggaaacggttaaacccgtttacggtttttaggggtcggggttacctttccgggttagggttacgggaaaccgggggtccgttaactttaccccgaaaccttaacccgttcccgttaacccgaaacgggaacgtaaacccgtaaaacccggaacccgaaaaacgggtaaaccgtcccgtaaactttacggttaaccttaccgtaacgaaccgtaaaaaagttacgggtaaaaccgttagttacggtaggtaaacgggcgggttacggaagggaccgaacggttctttaacgtttaagtttactttcggttagggttacgggacggggttacggggaccggtccgggttactttaacggggtttcgggtttacccggtaccggttcgggttccggggaacccgggttaacccgggttaccccggttggttaccccgtcggttacccgtaccgtacgtaccccggacccgttccccctaacccggaacccggttaaccgggtcccctaacccggg

SEQ ID NO: 95703 - DNA, 756 bp, Homo sapiens
  misc_feature: GYAE6OF02IKAWX.10.85.H08.1.454.CMB.1.raw
  modified_base (304)..(304): a, c, t, g, unknown or other
  misc_feature (304)..(304): n is a, c, g, or t
  modified_base (655)..(655): a, c, t, g, unknown or other
  misc_feature (655)..(655): n is a, c, g, or t
tcagcatagtagtgcacgaccggtgctcgatttagtatcactcagtcgcggtcccacctttggttttggagatggttttctcgatgggggctgggaggcctggtccaggccggggggtccctgagactctcctgtggagcgtccggattcgactttgatacttattggatgagcgtgggtcccgccaggctccgaaggggaagggtctggaggtgggtcggcccaaccgaagtaaaaggagagtaggaagtgaagtaacttacgtttggcggtctcgtggtaggaacgggccgtattccaactntccgtacaggaacgaccgaaacgaccaaaggtactctacgttagtacttcgtacgaactaaaagtggaaacctagttgtacggaggtaacgtacggaacgggtaccaacgggtcttagtttattacgtttgtacggtaggcggggtaacgggggacgtcccggtagttaacggttcgggttcccgggaacccttgggaaccgggggtaacccggaaccgggttaacccgttccgggtacccgtaacccggttctaccgtagtccgtaccgcccctaccgaaaccgggacgtccccttacggttcccgtccccgtttcccgccgtcccgccgtaccgcccgacgtacgaccnccgtaaccgccgaacgaccgacgacgtccggaccgtccgtcggtctaccggccgtacggaaccgtaccgttccgtaacctcgtaaccctagtaccgcgtgg

SEQ ID NO: 95704 - DNA, 597 bp, Homo sapiens
  misc_feature: GYAE6OF02I4BQ4.10.85.H08.1.454.CMB.1.raw
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (385)..(385): a, c, t, g, unknown or other
  misc_feature (385)..(385): n is a, c, g, or t
  modified_base (489)..(489): a, c, t, g, unknown or other
  misc_feature (489)..(489): n is a, c, g, or t
tcagcatagtagtgcacgaccggtgctcgatttagtatcactcagtcgcggggctcagagaggagccttagccctggactccaaggcctctccacttggtgatcagcactgagctgggtttccttgttgttattttagaaggtgtccaatgtgaggagcagctggtgagtctgggggagcctggtccaggccgggggggtccctggacgacgtctcctgtggagcgtccggattcgactttgactacttattggatgagtcgtggtcccgcgaggcctaccgaaggggaagggctagggaggtcgggtcgacaaaccatccgaggcagttatttccgaagttacatatactacgcagaatcngtgaacggcnctcacntctcagngacgcacagaactcaagtgtgctgacaaatgaacgcgccgtagggacgcggaagacgacggacaaagctagttacgtgacgacgtaagtacgtctttaaacggnggttacggataacgttaagtacggtaaacacttaagtttcgttagttacggttttccggggaaccgttaacggggttaccctggggtacccttaccggttacttaccg

SEQ ID NO: 95705 - DNA, 769 bp, Homo sapiens
  misc_feature: GYAE6OF02H5S8O.10.85.H08.1.454.CMB.1.raw
  modified_base (266)..(266): a, c, t, g, unknown or other
  misc_feature (266)..(266): n is a, c, g, or t
  modified_base (314)..(314): a, c, t, g, unknown or other
  misc_feature (314)..(314): n is a, c, g, or t
  modified_base (360)..(360): a, c, t, g, unknown or other
  misc_feature (360)..(360): n is a, c, g, or t
tcagcatagtagtgcacgaccggtgctcgatttagtatcactcagtcgcgggtcccacctttggttttggagatggttttctcgatggggggctggggaggcctggtccaggccgggggggtccctgagactctcctgtggagcgtcggattcgactttgattacttattggatgagcgtgggtccgccaggcctccgaggggaaggggctgggagtgggtggccacataaaaggagatggaagtgaagaacttactttgtggctntgtgaagggcgatcacatctcagagacaacgcaaagagtcactgtatntgacaaaattgaacgtatggtacgaagagtcggaaggacaacgggnttaggtatttactttctaggtcggtacgggaagggggacgtcccgggtcttaagttcggggtttaccggaacccgttcgggtcggggggacccaaggggggtaaaccccgtcgggtaccgtacccgttcctacgtacgtacgcgtacccctaccgaaccgaaaccgggaccccgtagtttacccggtccctttcccccggtcgggtcccgtccccgtacgtcccgttacccgaacgggtaccgtacccgtaaccccgtcccgggaaacggtaacggaaccaacccggtaacggccccgggtacccccgggttggggtcccgttcggtccccgggttacggttaaccggaaaccgggtaacccttaaccccgtttaccccctaacgttaaaccgttcgttacggtaccgg

SEQ ID NO: 95706 - DNA, 973 bp, Homo sapiens
  misc_feature: GYAE6OF02G2QTC.10.85.H08.1.454.CMB.1.raw
  modified_base (212)..(212): a, c, t, g, unknown or other
  misc_feature (212)..(212): n is a, c, g, or t
tcagcatagtagtgcacgaccggtgctcgatttagtatcactcagtcgcgggtcccacctttggttttggagatggttttctcgatgggggctgggaggcctggtccagccgggggggtccctgagactctcctgtggagcgtccggattcgactttgatacttattggatgagctgggtccgcaggctccgagggaagggctggagtgggngccacataaaggagagtggaagtgaagtaacttacgtttggtgggcttacgttggtaggaacggggtcccgtattaccgaccctaagttcctacccgaaggaacgaaccgaaaccgacccgaaaaggtaacggtccaacgttagttactaccgtagaacctaaaagttacggaaaacgtacgttcggtaggaaggtacggttacggaacgggaacgaccgggtcgttagttacttagttttacgtggtcggacggggtacggggacggtccggtacttaaggttcgggttaccgtaccgttcgggtcggggaccgaacggggtaaccccgttgggtaaccccgtaccggttccgtacgtaaccgttaccgtaccgtaccccgttaacccggaaacccccggtaaaccggggtacccccgtttaaccggttccccccgggttttaacccccgtttccccccgggttaaccgggtccccccggttccccgtttaccggtccccccggtttaaaccggggacccgggaacccggttaacccccgtaaccgggttaccccggtaaaaccggtcccggtaacccggtaacccgaccccgggggtccccgggttccccggggttacgggtacccccgggttacccggtaaccccggggttagggttaaacccccgggtaaacccggttttacccccctttaaacccccggtttaacccccttaaacccggtttaacccggtttaccggtacccgggttaaccccggg

SEQ ID NO: 95707 - DNA, 779 bp, Homo sapiens
  misc_feature: GYAE6OF02I9BAE.10.85.H08.1.454.CMB.1.raw
  modified_base (260)..(260): a, c, t, g, unknown or other
  misc_feature (260)..(260): n is a, c, g, or t
tcagcatagtagtgcacgaccggtgctcgatttagtatcactcagtcgcggggctcagagaggagccttagccctggactccaaggcctctccacttggtgatcagccactgagctggtttccttgttgttatttagagtgtccaatgtgagagcagctggtggagtcgtgggggagccgtggtccaggccggggggggttccctggacgactcctccgtgtggagcgtccggtattcgactttgatacttatggatgancgtgggtccgcgaggcctcggaagggacggggtctgggagtggggtcggaccaacccgaagttaaagggagtacgtacgggaaggtgaacgttaaccttaacgttttgggaggggtcttaccgttggtaaggacgggtacccgtattacccgtacagttccctaccaaggtacgaaccgaaacccgacccaaagtaaacggtcctaacgttacggtactcgtttacgaactaaacgtgaaacgtagttggagaaggtaacggtacgaacgggtacctaacgggtaccgtaggttaactttccgttttgttacggtcggggtaacggacgggggttaacccggacggtttacgttacgttccggggttacccgtaacccggttacgggttacccggggtacccggtaacgggtaacccccggttcgggtaacccgttaccggtaacccgttcggtaacccttaccgggcccttacccggtaaccccgaacccggtaacccgggtcccctttaaccccggg

SEQ ID NO: 95708 - DNA, 812 bp, Homo sapiens
  misc_feature: GYAE6OF02IX4X2.10.85.H08.1.454.CMB.1.raw
  modified_base (250)..(250): a, c, t, g, unknown or other
  misc_feature (250)..(250): n is a, c, g, or t
tcagcatagtagtgcacgaccggtgctcgatttagtatcactcagtcgcgggggtctcagagagagccttagccctggactccaaggcctctccacttggtgatcagcactgagcacagaggactcaccatggaagttgggctggagcgttggtttctgttgtttatttagaagtgtcaagtgtgagagcagtcgtggtaggagtcggtgggggacggtcgtcgggtccgaggggcccggggggttccgngtaacgtaccgtcgtaccgtggtcggaggtccggttccggtacttcggtacgtttgacgttactttagtaggtatggtagtcggttacgggtcccggcgtacggtccgtaccggaacggggtacgggtcggtagggtcgggtggggtccggaccgaaccgtaaaggaaacggaacgtacggtaaaggaagttacggaaagttaaccggtttaaagtttcgggacggttcgttacggtaaggtcgggaaacgggtccggtatacccgtacctaacgttaccgtaactaacggaacgaacgtaacccgaacgtaaacgaagtcccgtaagtacgttaacgtactacggaaagtaaacgtacgacgttaggtacgggtacgtacggaacggtacggaaccggttacggaaccggtaccgtaagtttaccggttaacttttgggttagggttacccggtacgggggtaaccgggtacccggggtcggttaaccgttaccgggtttacgggtttcccggtaccggttaccgggtccgggggtaaccggtacccgggggttaccccgg

SEQ ID NO: 95709 - DNA, 892 bp, Homo sapiens
  misc_feature: GYAE6OF02JSCJK.10.85.H08.1.454.CMB.1.raw
  modified_base (376)..(376): a, c, t, g, unknown or other
  misc_feature (376)..(376): n is a, c, g, or t
tcagcatagtagtgcacgaccggtgctcgatttagtatcactcagtcgcgggggtctcagagaggagccttagccctggactccaaggcctctccacttggtgatcagcacgtgagcacagaggactccaccagtaggtaagttggggctgagtcgttcgggttttaccttgtttgtttagtttaggtaaggtgtacctagtgtaggaggacgcgagtcgtgggtggtacgtcgggtggggagtccgtacggtccggacgggtcccgggggtcctggacgccgttcgtccgtaggtcggtaccggtccggttcggtactttccgtacgtttgtaacttacgtttagtcggtagtgtacgcgttacgggccaccggngtcgtaccggaaggggtaccggtggtacgggcggtgggtaccgaccgtaacggtaaaggtaaagggtaacggtacggtaagggtagttaacggaaaccgttacggtttacggtttaggggtccggtaacttacgggtacgggtaacggaaccgggtacctacgtttaccgaccttaccgtaccttaacccggaacggtaacccacggtaaacctaacggaacggtaaacttccggtaaagttcgtaaacgttaccgtagtaaacggtaaaccgtacggaaggtccgttaacgggtagtaaaccggacggggttaaccggaaccgggtaacgttaaccggttaacgtttaggggtttaaaccttggggttttaccgaggggttacccgggtaaaaggggggtacccgggtacgttaacgggttaacccggtttaaccgggttaccgggtttacccgggttaaccccggttacgggggtaacccggggttaccccgggtaacccgggtttaccccggg

SEQ ID NO: 95710 - DNA, 725 bp, Homo sapiens
  misc_feature: GYAE6OF02GP0JG.10.85.H08.1.454.CMB.1.raw
  modified_base (327)..(327): a, c, t, g, unknown or other
  misc_feature (327)..(327): n is a, c, g, or t
tcagcatagtagtgcacgaccggtgctcgatttagtatcactcagtcgcgggtcccacctttggttttggagatggttttctcgagtgggggctgggaggcctggtccaggccggggggtcctgagactctcgtgtggagcgtccggattcgactttgatacttattggatgagcgtgggtccgccaggctccgagggagggctggagtggtgccacataaaggagatggagtgagactagttggtggctcgtgtgaaggcattcacatctccagacacaacgccaaaggacgtcactgtatcgtagactaaagtgaacgtagttgngaagacgtacgaggacacgggtctagtattacgtttcgtgtggacggagggggactccgggactttaggttcgggttaccggacccgttcgggtacgggggacccgtaaagggggtaccccttgggtaccctaaccgttccgtaacgacgttccgaccggtaccccgtaccgaaccggaccgggtacccttaacgttccccgggtttacccttcccccggtcgggcccgtccccgtagcccgttacccggaggtaccgcccgtaacccggtccgtaacggccgaccaccggtaccgggccgggtcccgttagggcccttccggacccggttacgggtacccgtaaacggttcccttacccggtttaccccaaccgtttaccgtacgtcggttacccgg

SEQ ID NO: 95711 - DNA, 670 bp, Homo sapiens
  misc_feature: GYAE6OF02G1QUB.10.85.H08.1.454.CMB.1.raw
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (249)..(249): a, c, t, g, unknown or other
  misc_feature (249)..(249): n is a, c, g, or t
tcagcatagtagtgcacgaccggtgctcgatttagtatcactcagtcgcgggggctctgcttcagctgtgagcgcagaaggcaggactcgggacaatcttcatcatgacctgcctcccctctcctcctccacccttctcattcactgcacgagggtcctgggcccagtcctgtattgacgcagcccgccctnagtcgtctcgccgggccccgganaggacgggtccaccatcgtcctgcgtaccggaancagcctacaattagttggaattggttaatggtcgtccgttaggtaccagtaccaacctcccgaaggaacctaccgaccccctaaactcctactatttaacaagaaaatcgtaaactaaccgaccgtacgaacggtctaccgtagaacctactttcacgtacgtcctaactagttcgtcggactacggtaccacgacccgtaccgtcggaccacgtacccgaccgtacctaccgaccgacggtacgggacgaccggaccgttacgttacgtaccgtcggaccggtaaccgtcggtactaccgaacgtacgtcgttaggacgttcgacgttcgggttcggttacgggacggtaacggtaaccgtaacggtccgtacccgtcgtaccggtaccgaccgaccgtacggtccgtacccgtccccgg

SEQ ID NO: 95712 - DNA, 939 bp, Homo sapiens
  misc_feature: GYAE6OF02IRNSU.10.85.H08.1.454.CMB.1.raw
  modified_base (425)..(425): a, c, t, g, unknown or other
  misc_feature (425)..(425): n is a, c, g, or t
tcagcatagtagtgcacgaccggtgctcgattttagtatcactcagtcgcgggtcccacctttggttttggagatggttttctcgagtgggggctggggaggcctggtccaggccgggggggtccctgagactctcctggtggagcgtccggattcgactttgattacttattggatgagcgtgggtccgccaggctccgaaggggagggctggagtgggtgccacaagtaaaggaagagtaggaagtgagtaacttactttggtgggtcttcgtgtaggaacggggccgtatttccaaccattcctaccaaggacgaacgaaaccgtaccgaaagtaaagtccaacttaggtaacttcgtgaactaaaagtggaaacgtagttcggtaggaggaaggttaccggaagggtaccgaaccggggtnttttaacggttaatttacgttttacgttgggttacgggacgggtaaggggggacggacccggtacgtttaacgggttggggtttacccggaaccgtttcgggaccgggggtacccgaaaccgggggttaccccggttacgggtacccgtacccggtttctacccgtaagtacccgtaaccggtcccctaacccgggaaaccccggtaaaccggggtaccccctaaccgggttttacccccgggtttcccccctttccccccggggtaccgggcccccgtccccggttacgggttcccctaaccgggacgggtaaccctacccgtaaccccggttacgggaacggtacccgccggaacccgtacccgggggccccgtacccggggtttaaccggggtcccgtaccggggttacccggttaccgggtaaacccgggttaaacccggtttaccccgtttaaacccccggtttccccttaaaacggttttaacccggttaccggttacggttacccgg

SEQ ID NO: 95713 - DNA, 723 bp, Homo sapiens
  misc_feature: GYAE6OF02FUCEQ.10.85.H08.1.454.CMB.1.raw
tcagcatagtagtgcacgaccggtgctcgatttagtatcactcagtcgcgggtcccacctttggttttggagatggttttctcgatgggggctgggaggcctggtccagccgggggggtccctgagactctcctgtggagcgtccggattcgactttgatacttattggatgagctgggtccgccaggctccgagggaaggggctggagtgggtggccaccataaaggaagatggaagtgagaactacgtttggtgggctctggtggaagggccgattcaccatcctccagacgacaacgaccaagagtcactgtactcgtgactaaatgaacgtatgtcggagagtcggaaggaccgacggtctagtattagtttctggtcggagggtaggggagcccggtgtacgttgggttaccggaccttcgggtcggggtaccgtaacgggtacccggttacggtaccgtacccgttcctacgtacgtcgtaccgtcccgtacccaacccggaaccggtcccgtaaaaccgttcccggttcccgttcccccgtccggtcccgtccccgtcgtcccgtaccggtacggaccgtacccgtacccgtacccgacgaccgccgtaccgaccggaccggtcccggtcgggtcgttccggtacccggtacggttaccgtaaccggtacccgttaacccgttacccctaaccgttaccttacgtacgtacccggg

SEQ ID NO: 95714 - DNA, 688 bp, Homo sapiens
  misc_feature: GYAE6OF02G32RO.34.11.A11.1.454.CMB.1.raw
  modified_base (205)..(205): a, c, t, g, unknown or other
  misc_feature (205)..(205): n is a, c, g, or t
tcagtacacgtgatcacgaccggtgctcgatttagctacgactgcaagggtaagggggaggaactgctcagttaggacccagagggaaccatggaagccccagctcagcttctcttcctcctgctactctggctcccagataccaccggaagtaattgtgttgacactagtctcgagccctacctgtcttgtctccaggggaagngccaccctctcctgcaggccagtcaggagtgttagcggtactacttagcctggtaccagcaacgaaccgtcggaccaggcctacccgagtacctcctacatttaactggtacgctaataccgtaaccgaacggggtccccgttggcctacgtccccaaggaccgtagggtttccaggtcggacgtagggttcgggtcgtacggggaactaggtacctttccgaccttctacccgaacctatcccaaccgtacgtacgtcggacgtccgtagtaagttacgttttcggactacggttacgttacgttacgtcgtacgtaacgtagttacggtcctaccgtaccgaccgtacgttacggtaccggttaccgggacccggtaacgggtaaccggtaagggtaggtaaacgtacgaaacgtacgtagtggtacgtcggacctaccgtacgtacgttacgttcttctacgtccttcccgacctactcg

SEQ ID NO: 95715 - DNA, 694 bp, Homo sapiens
  misc_feature: GYAE6OF02H0OG6.34.11.A11.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (345)..(345): a, c, t, g, unknown or other
  misc_feature (345)..(345): n is a, c, g, or t
  modified_base (359)..(359): a, c, t, g, unknown or other
  misc_feature (359)..(359): n is a, c, g, or t
  modified_base (404)..(404): a, c, t, g, unknown or other
  misc_feature (404)..(404): n is a, c, g, or t
  modified_base (458)..(458): a, c, t, g, unknown or other
  misc_feature (458)..(458): n is a, c, g, or t
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (568)..(568): a, c, t, g, unknown or other
  misc_feature (568)..(568): n is a, c, g, or t
  modified_base (649)..(649): a, c, t, g, unknown or other
  misc_feature (649)..(649): n is a, c, g, or t
tcagtacacgtgatcacgaccggtgctcgatttagctacgactgcgaagggtaaagggggaggaacgtgctcagttaggacccagagggaaccatggaagccccagctcagcttctcttcctcctgctactcgtggcctcccagtactaccaccggagaaattgtgttgacacagtcctcacgccacctgttcttcgtcnccgaagggaaancgccctaccctctcgtcgacgacgggcctagtacagtagtgttaggcgtactacgttacgtccgttaggacccagtaaccgaacgtaaccggccgacggacgtccctaaccggtcgtcccttacgtaccgttntaaccgtagttacncgttcgaaccttaaccgaaaccgcggtaccacgtccggtaccacncccgtacggtaacgtcggttaggcgtacggcgtcggtcgtcgaacgggtctacnctttcgaccngacccgtntaccgtgacggtacctaacggcctacggtaactaccgtaaacgttgttaacgtaaacctttattacgtactgtaaccgtcgttgtacgtacncgtaacgttactcccgggtactaccgtgcctaaccggtttcgaccggtaggactacgtcgaggttacgaacgtaacggtanacggcgtacgacgtcgtaacaccgtacgtttctaccgtgttaccc

SEQ ID NO: 95716 - DNA, 192 bp, Homo sapiens
  misc_feature: GYAE6OF01ECLOK.9.28.C06.1.454.CMB.1.raw
  modified_base (173)..(192): a, c, t, g, unknown or other
  misc_feature (173)..(192): n is a, c, g, or t
tcagtgatacgtctcacgaccggtgctcgatttagagctcacgtattgggtttgggggaagaggaagactgacggtcccccaggagttcaggtgctgggcacagcggccctgggctgcctggtcaaggactacttccagacgtatcactgagcgggctggcaaggcgcatagnnnnnnnnnnnnnnnnnnnn

SEQ ID NO: 95717 - DNA, 520 bp, Homo sapiens
  misc_feature: GYAE6OF01D4093.9.28.C06.1.454.CMB.1.raw
tcagtgatacgtctcacgaccggtgctcgatttagagctcacgtattgggtttggggggaagcctgagaacacttagccttcatgagtgtccccaccatggcctggaggatgcttctcctcggactccttgcttatggatcaggagtggattctcagactgtggtgacccaggagccatcgttctcagtgtcccctggagggacagtcacactcacttgtggcttgagctctggctcagtctctactttttactaccccacctggtaccagcagacccaggccaggctccacgtatgatcatctacagcacaaacactcgctcttctgggtccctgatcgcttctctggctccatcctgggaacaaagctgccctcaccatccgacggggcccaggcagatgatgaatctgtatttattactgtgttctatatatggatcgtggctagtttggattggttcgggcgggtagggaccaaggttcgacccgtctaggtccagcccaaggcctcggtcccccg

SEQ ID NO: 95718 - DNA, 581 bp, Homo sapiens
  misc_feature: GYAE6OF01CDCYT.9.28.C06.1.454.CMB.1.raw
tcagtgatacgtctcacgaccggtgctcgatttagagctcacgtattgggtttgggggggaagcctgagaacacttagccttcatgagtgtccccaccatggcctggaggatgcttctcctcggactccttgcttatggatcaggagtggattctcagactgtggtcgacccaggagccatcgttctcagtcgtcccgtggagggacagtcacactcacttgtggcttgagctctggctcagtcttcttacttttaccaccctactcggtaccagcacgacccaggccacgctccacgtatgactcatctaacacgacaaccaacactcgtctcttcgtcgggtaccctgactcgtcttcgtctcggcctcctataccgttagggaaactaacgcctacgccctacaccgtacgtccggaccggggcccagggcagaactgatagtactcgtagtaacttattatgttacgttactattagtagtcggtatcggttgactagtttggagttcggttagggacggtacggtagtacggtcggaccgtacgtggtaccacgtacccgagtccgtccgtccccg

SEQ ID NO: 95719 - DNA, 735 bp, Homo sapiens
  misc_feature: GYAE6OF01CISVD.9.28.C06.1.454.CMB.1.raw
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
tcagtgatacgtctcacgaccggtgctcgatttagagctcacgtattgggtttgggggggaagcctgagaacacttagccttcatgagtgtccccaccatggcctggaggatgcttctcctcggactccttgcttatggatcaggagtggattctcagactgtggtgacccaggagccatcgttctcagtcgtcccgtggagggacagtcacactcacttgtggcttgatctctggctcagtcttcttactttttaccaccccactcggtaccagccacgacccaggccaggcctaccacgtatgactcatctacagtaccaacaaacnccgtcnccttcgttcggtcgggtcctagactcgtcttcgtcgtcgtccttcgacttacggtaacggaaactacgacctccgaccccttccgaacgtaccgtcggggaaccccgggacgaggacaacggacgttagtacgtaacgtaacttacgtacgttaagttttaaccgtttcgttcgtttacgttttaacgtaaatttaggttaagggttacgttaccgggtttagggttaccggttacggttttaagggtttacgggtaccggtttccggggggttaccgggaaaccgggggttaacccggtaacgtttaaacggggtccccggtttacgggttacccgttaacgggtaaccgaccccgggtaacccggtaacgggttcccccgccccggtttccccccggg

SEQ ID NO: 95720 - DNA, 852 bp, Homo sapiens
  misc_feature: GYAE6OF01BA4E0.9.28.C06.1.454.CMB.1.raw
tcagtgatacgtctcacgaccggtgctcgatttagagctcacgtattgggtttgggggggaagcctgagaacacttagccttcatgagtgtccccaccatggcctggaggatgcttctcctcggactccttgcttatggatcaggagtggattctcagactgtggtgacccaggagccatcgttctcagtcgtccctggagggacagtcacactcacttgtgcttgagctctgctcagtctcttacttttacctaccccactgtaccagcacgacccaggccaggcctccagtatgactctatactaacgacgaccaacaaaacctcctaccgtccttccgtttaccgtccggggttcccctagtaccgtcgtacctttccgtccgtcggcctttacccgtacgtttacccggttaacggggtaaaacctaaacggtccctacccggacccccttaccgaaccccgtaacggttaccccggggaaccccgggggggtaccccaacgggtaacctaagggtaacgttaacgggttaacttaacggtaaacttttccggttaaaggtttaaccttttttaaacgttttaaccggtttcggtttttaacggtttaacctttaaagtttaaacgtttacgggttaaccgggtttaagttcccgggtttagggtaccgttttaagggttttacgggttaaggtttccgggggttaacccgggggtaaccgggggtaaacgggtaaccccggttaaaggtttcccgggtaaaccccgtttaccgggttaaaccgggtaccctaacccggggtaacccccggtaacgggttcccccgttcccccggggttaccccccgg

SEQ ID NO: 95721 - DNA, 694 bp, Homo sapiens
  misc_feature: GYAE6OF02GVSS6.9.28.C06.1.454.CMB.1.raw
tcagtgatacgtctcacgaccggtgctcgatttagagctcacgtattgggtttgggggggaagcctgagaacacttagccttcatgagtgtccccaccatggcctggaggatgcttctcctcggactccttgcttatggatcaggagtggattctcagactgtggtgacccaggagccatcgttctcagtgtcccctggaggacagtcacactcacttgtggcttgagctctggctcagtctcttacttttactaccccacctcgtaccagcacgaccccaggccaggctcccacgtatgactcatctacagcaacaaacactcgctcttcgtgggtccctgactcgcttcgtctcggctaccgtacttccgttacgggaaactaaacgtcctacggtcccctaccgaaccctacgttacccgggaaccccggggggccccgtaacgggaccgtaacggtacgtacggtaagtacggttaaacgttccgttaggttaactttaacgtttaccgttaggtttacgtttactttaagttagttaagttcggtacgttcgggttcggtaccttaggttttacgggtaagtttcgggttacgggtacggggtaacgggtaacccgttaacggtcgtaacccggttccgttaacggtaccgacgtaccccggtaaggtcccgtaccggttaccccccgg

SEQ ID NO: 95722 - DNA, 560 bp, Homo sapiens
  misc_feature: GYAE6OF02HB5YC.9.28.C06.1.454.CMB.1.raw
  modified_base (320)..(320): a, c, t, g, unknown or other
  misc_feature (320)..(320): n is a, c, g, or t
tcagtgatacgtctcacgaccggtgctcgatttagagctcacgtattgggtttgggggggaagcctgagaacacttagccttcatgagtgtccccaccatggcctggaggatgcttctcctcggactccttgcttatggatcaggagtggattctcagactgtggtgacccaggagccatcgttctcagtgtcccctggagggacagtcacactcacttgtggcttgagctctggctcagtctcttacttttactaccccacctgtaccagcacgaccccaggccaggctccacgtatgactcatctacagcaacaaacnctcgctcttcgtcgggtcctgactcgcttctctgctcatccttagggaacaacgctcgccctcaccatccgaccggggcccaggcagatgatagtaatcgtagtattattactgttgttactattatagttggacttcggtgacttagtttggagttggttcgggacggtacgggaccgttacggttacggaccgttccgttacggtaccgacggacccgaaggtcctcccggtcccccg

SEQ ID NO: 95723 - DNA, 174 bp, Homo sapiens
  misc_feature: GYAE6OF02GOB0C.9.28.C06.1.454.CMB.1.raw
  modified_base (174)..(174): a, c, t, g, unknown or other
  misc_feature (174)..(174): n is a, c, g, or t
tcagtgatacgtctcacgaccggtgctcgatttagagctcacgtattgggtttgggggaagaggaagactgacggtccccccaggagttcaggtgctgggcacagcggccctgggctgcctggtcaaggactacttccagacgtatcactgagcgggctggcaaggcgcatagn

SEQ ID NO: 95724 - DNA, 589 bp, Homo sapiens
  misc_feature: GYAE6OF02GP5YU.9.28.C06.1.454.CMB.1.raw
  modified_base (315)..(315): a, c, t, g, unknown or other
  misc_feature (315)..(315): n is a, c, g, or t
  modified_base (386)..(386): a, c, t, g, unknown or other
  misc_feature (386)..(386): n is a, c, g, or t
tcagtgatacgtctcacgaccggtgctcgatttagagctcacgtattgggtttgggggggaagcctgagaacacttagccttcatgagtgtccccaccatggcctggaggatgcttctcctcggactccttgcttatggatcaggagtggattctcagactgtggtgacccaggagccatcgttctcagtcgtccctggagggacagtcacactctacttgtggcttgagctctggctcagtctcttactttttacctaccccaccttggtaccagcacgaccccaggccaggcctcacgtatgatcatctacanacacaaacactcgctcttcgtcgggtcctgactcgtcttctctgtcctctactccgtaggaaacaacgtcncgtccctcaccacgtccggaccgggccaggcagatagatacgaactctagtattttacgtatttgttacgtttacttattagttagtcggtacttcggttagtacgtttagttggtattcggttcgggacgggtaggtaaccttaggtacgtaccgttccgtacggtccgaccgtacccggacggttcccgcccgtaccccgg

SEQ ID NO: 95725 - DNA, 763 bp, Homo sapiens
  misc_feature: GYAE6OF02I5H66.9.28.C06.1.454.CMB.1.raw
  modified_base (192)..(192): a, c, t, g, unknown or other
  misc_feature (192)..(192): n is a, c, g, or t
  modified_base (372)..(372): a, c, t, g, unknown or other
  misc_feature (372)..(372): n is a, c, g, or t
  modified_base (751)..(751): a, c, t, g, unknown or other
  misc_feature (751)..(751): n is a, c, g, or t
tcagtgatacgtctcacgaccggtgctcgatttagagctcacgtattggggttgggggggaagcctgagaacacttagccttcatgagtgtccccaccatggcctggaggatgcttctcctcggactccttgcttatggatcaggagtggattctcagactggtggtacgacccagggacgccattcgttcnctaggttccgttccccgtagggacgggtacacggtccaactactcctacgttggtcggtcttgacgccttcgtcgggaccttcgagttcctttcttaacctttttaccctaccccgtaccgttacggtaccagaccgaccgaacccccgtagcctaacgggtcctaacccgtacgttacngactcaactctacgaagaccaactaaaccgtctccgtcttcgttcgtcgggttaccctagtactccggttcttccgtcgtcggtccttacgttaccgtaccggtaacggaaactaacgtccgtcccgtccctacaacccggtacggtacccgggtaccccgggggaaccctagggacctaacggaacgtagtaaccgtggtaaaccgttacgttacggtttaacttaacgtttccgttaaggtcttttaacggatttaacgttacgggtgttaacggttcgttaagtctacggtttcggttacgttcgggtaccggagggtaccggtacgttaggtaaccctccggttaaggcgtacggtacccgacgaccggtttccncccgggttaccc

SEQ ID NO: 95726 - DNA, 782 bp, Homo sapiens
  misc_feature: GYAE6OF02IFAHJ.9.28.C06.1.454.CMB.1.raw
  modified_base (369)..(369): a, c, t, g, unknown or other
  misc_feature (369)..(369): n is a, c, g, or t
tcagtgatacgtctcacgaccggtgctcgatttagagctcacgtattgggtttgggggggaagcctgagaacacttagccttcatgagtgtccccaccatggcctggaggatgcttctcctcggactccttgcttatggattcaggagtggacttctcgagacttgtggtcgaacccgaggacgtccagttcggtttctacgagttccgtaccccgtgggtacgggaactaggtccaacgtcctactacgtttaggtcggtacctttaggacgtcttccgtcggctactagtccttacgttaccttttaccacccctctacggtaccagcgaaccgtaccccaaggtcccaggtcctaccgtacgttanacggtatcctaactacctacgacgtacaacgtaaactccgttacctcgttccgttccgggtacgggtaccccgttagtaccgttcgttcccttacgtccggttagtcccgttaccacggtttaccgttaacggggaacaacggttccaacccgtccctaacgacctacggtaccgggtacccgggacccgtaggccgtaagtcggaacgtacgtacgttaacgtcgttaacgttagtttaaccgtttacggttacgttaacgtttcgttaaacgttagttaggtacggttacgtacgttcgtaaacggtttacgtagttacggttacgggttaccgggtacggacgggtaacttacggtaccgttacgttccgacgtccgtaaccggcgtaaccgttcccgacgttaccccgg

SEQ ID NO: 95727 - DNA, 129 bp, Homo sapiens
  misc_feature: GYAE6OF01BA951.2.58.F03.1.454.CMB.1.raw
  modified_base (127)..(129): a, c, t, g, unknown or other
  misc_feature (127)..(129): n is a, c, g, or t
tcagacgctcgacacacgaccggtgctcgatttagtctgatcgagaagggaaaggggctggccctgacgtgtttctgttcccaccctcctctgtcgagcgtctgagcgggctggcaaggcgcatagnnn

SEQ ID NO: 95728 - DNA, 126 bp, Homo sapiens
  misc_feature: GYAE6OF01D9SC3.2.58.F03.1.454.CMB.1.raw
tcagacgctcgacacacgaccggtgctcgatttagtctgatcgagaagggaaaggggctggccctgacgtgtttctgttcccgccctcctctgtcgagcgtctgagcgggctggcaaggcgcatag

SEQ ID NO: 95729 - DNA, 217 bp, Homo sapiens
  misc_feature: GYAE6OF01DSHAS.38.20.B09.1.454.CMB.1.raw
  modified_base (215)..(217): a, c, t, g, unknown or other
  misc_feature (215)..(217): n is a, c, g, or t
tcagtcgatcacgtcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccacgtgatcgactgagcgggctggcaaggcgcatagnnn

SEQ ID NO: 95730 - DNA, 420 bp, Homo sapiens
  misc_feature: GYAE6OF01EY233.38.20.B09.1.454.CMB.1.raw
  modified_base (414)..(420): a, c, t, g, unknown or other
  misc_feature (414)..(420): n is a, c, g, or t
tcagtcgatcacgtcacgaccggtgctcgatttagtgtagtgtgaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctggggcacagcggcctggctgcctggtcaaggactacttccacgtgatcgactgagcgggctggcaaggcgcatagnnnnnnn

SEQ ID NO: 95731 - DNA, 217 bp, Homo sapiens; identical to SEQ ID NO: 95729
  misc_feature: GYAE6OF01DNXL4.38.20.B09.1.454.CMB.1.raw
  modified_base (215)..(217): a, c, t, g, unknown or other
  misc_feature (215)..(217): n is a, c, g, or t

SEQ ID NO: 95732 - DNA, 218 bp, Homo sapiens
  misc_feature: GYAE6OF01A352C.38.20.B09.1.454.CMB.1.raw
  modified_base (215)..(218): a, c, t, g, unknown or other
  misc_feature (215)..(218): n is a, c, g, or t
tcagtcgatcacgtcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccacgtgatcgactgagcgggctggcaaggcgcatagnnnn

SEQ ID NO: 95733 - DNA, 459 bp, Homo sapiens
  misc_feature: GYAE6OF01AZW0A.38.20.B09.1.454.CMB.1.raw
  modified_base (424)..(459): a, c, t, g, unknown or other
  misc_feature (424)..(459): n is a, c, g, or t
tcagtcgatcacgtcacgaccggtgctcgatttagtgtagtgtgaaggggctggagtaggggtctcagttattagtggtagtggtagtagcacagattaccgcagactccgtgaagggccggtttcaccatctccagagacaattccaagaacacactataacctgcaaaatgaagaccctgagagccgaggacacggccatatattactggtagtgaaaggggcacggggtgactcctgggggccagggaacccctggtcaccgtctcctcacgcctccacccaagggccccaatcggtcttcccccctgggccaccccgtcctcccaagagccacctctgggggcacagcggccctgggctgccctggtcaaggcctacttccacgtgatcgactggagcgggctgggcaaggcgcatacgnnnnnnnnnnnnnnnnnnnnnnnnnnnnnnnnnnnn

SEQ ID NO: 95734 - DNA, 524 bp, Homo sapiens
  misc_feature: GYAE6OF01D93Q1.38.20.B09.1.454.CMB.1.raw
  modified_base (496)..(524): a, c, t, g, unknown or other
  misc_feature (496)..(524): n is a, c, g, or t
tcagtcgatcacgtcacgaccggtgctcgatttagtgtagtgtgaagggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgacgtaaactttccttttgacttggtttattactcccctagtcgaccacgtggggccacggaaccctggtccaccgtctcctcacgccctcccaccgaacgggcccctagttccggtccctttccccccgtggacccctacccccttccctacccgtaaacgaccgccctacccgtgtcgggggccacgacggccggcccgtcgggcgtcgccgtcggtacgaacggtaccttacttccgacgtgactcgactggacggccgggtcgaggcgaaggccgcagtagcgannnnnnnnnnnnnnnnnnnnnnnnnnnnn

SEQ ID NO: 95735 - DNA, 488 bp, Homo sapiens
  misc_feature: GYAE6OF01DGKIP.38.20.B09.1.454.CMB.1.raw
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (280)..(280): a, c, t, g, unknown or other
  misc_feature (280)..(280): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (442)..(488): a, c, t, g, unknown or other
  misc_feature (442)..(488): n is a, c, g, or t
tcagtcgatcacgtcacgaccggtgctcgatttagtgtagtgtgaagggccggttcaccatctccagagacaattccaacagcacgctgtatttgcacatgaacagcctgagagccgaggacacggccatatattattgtgacgtaaacttttccttttgacttggtttaattactcccctagtcgaccagtggggccagggaaccctggtcacgtctctccncgtcnccaccaacggaccgcctacgttccggttcccctcccgtcggccctaccgtcncctacggaggaccacctaccgcgaagcaaccgacgcggcccgtaccggtggaccgtcgtccgttagggaaccgaaaggtccctttaccgaccgtagaggtaccgtccggacgtgggaaccgggtccggagtacggacggtaacgctaagatagctngtncgnnnnnnnnnnnnnnnnnnnnnnnnnnnnnnnnnnnnnnnnnnnnnnn

SEQ ID NO: 95736 - DNA, 532 bp, Homo sapiens
  misc_feature: GYAE6OF01DAT7D.38.20.B09.1.454.CMB.1.raw
  modified_base (506)..(532): a, c, t, g, unknown or other
  misc_feature (506)..(532): n is a, c, g, or t
tcagtcgatcacgtcacgaccggtgctcgatttagtgtagtgtgaaggggctggagtgggtctcagttattagtggtagtggtagtagcacagattacgcagactccgtgaagggccgttcaccatctccagagacaattccaacagcacgctgttatttgcacatagaacagcctgagacgaccggaggaccaccggccaatataattattgtgacgtaaactttccttttagacttggtttattacctcccttagtcgaccagtcggggacccgaagggaacccgttggtacctccgtctccgtcacgcctcccaaccgaacgggccctacgtccgttaccccttcccccgtgccctacccctccaccgaacgacgccacgtccgggtacggggaccaccgacggcccggccgtggctcgtcggtcgtacaacggtacctacctccacgttcgacgtcgtacgacggtacgggccggaccgtcgggaacaggtccagttagagnnnnnnnnnnnnnnnnnnnnnnnnnnn

SEQ ID NO: 95737 - DNA, 479 bp, Homo sapiens
  misc_feature: GYAE6OF01CFE45.38.20.B09.1.454.CMB.1.raw
  modified_base (307)..(307): a, c, t, g, unknown or other
  misc_feature (307)..(307): n is a, c, g, or t
  modified_base (444)..(479): a, c, t, g, unknown or other
  misc_feature (444)..(479): n is a, c, g, or t
tcagtcgatcacgtcacgaccggtgctcgatttagtgtagtgtgaagggccggttcaccatctccagagacaattccaacagcacgctgtatttgcacatgaacagcctgagagccgaggacacggccatatattattgtgcgtaaactttccttttgactggttattactcccctagtcgacctacgtcggggcctaacggggaacccttgggtacctacccggtctcctcacgtccctaccaccgaacggggccctagtccggttccttacccccgtgggcccgtcccctcgcctccgaagggcncccaccgtccggagacgaccaacgacggccggacccgtggggccttcggccgtgggtaacgaacgggtacttacctaccgaaccggtcgacttccgacgtggacgggccgggtcgtcgggacgacggcgcagtacgnnnnnnnnnnnnnnnnnnnnnnnnnnnnnnnnnnnn

SEQ ID NO: 95738 - DNA, 215 bp, Homo sapiens
  misc_feature: GYAE6OF02HTP23.38.20.B09.1.454.CMB.1.raw
  modified_base (213)..(215): a, c, t, g, unknown or other
  misc_feature (213)..(215): n is a, c, g, or t
tcagtcgatcacgtcacgaccggtgctcgatttagtgtagtgtgaagggtgccagggaaccctggtcaccgtctcctcagcctccaccaagggcccatcggtcttcccctggcaccctcctccaagagcacctctggggcacagcggccctgggctgcctggtcaaggactacttccacgtgatcgactgagcgggctggcaaggcgcatagnnn

SEQ ID NO: 95739 - DNA, 215 bp, Homo sapiens; identical to SEQ ID NO: 95738
  misc_feature: GYAE6OF02HOOAF.38.20.B09.1.454.CMB.1.raw
  modified_base (213)..(215): a, c, t, g, unknown or other
  misc_feature (213)..(215): n is a, c, g, or t

SEQ ID NO: 95740 - DNA, 254 bp, Homo sapiens
  misc_feature: GYAE6OF02FS7FS.38.20.B09.1.454.CMB.1.raw
  modified_base (222)..(254): a, c, t, g, unknown or other
  misc_feature (222)..(254): n is a, c, g, or t
tcagtcgatcacgtcacgaccggtgctcgatttagtgtagtgtgaagggtggccagggaacccgtggtcaccgtctcctcagcctccaccgaagggcccatcggtcttccccctggcacccctcctccaagagccacctctgggggtcacagcggccctgggctgcctggtcaaggactacttccacgtgatcgactgagcgggctggcaaggcgcaatagnnnnnnnnnnnnnnnnnnnnnnnnnnnnnnnnn

SEQ ID NO: 95741 - DNA, 224 bp, Homo sapiens
  misc_feature: GYAE6OF02IWJIM.38.20.B09.1.454.CMB.1.raw
  modified_base (212)..(224): a, c, t, g, unknown or other
  misc_feature (212)..(224): n is a, c, g, or t
tcagtcgatcacgtcacgaccggtgctcgatttagtgtagtgtgaaggtgccaggaacctggtcaccgtctcctcagcctccaccaaggcccatcggtcttcccctggccaccctcctccaacgacgccacctctggggcacagcggccctggctgcctggtcaaggactacttccacgtgatcgactgagcgggctggcaaggcgcatagnnnnnnnnnnnnn

SEQ ID NO: 95742 - DNA, 410 bp, Homo sapiens
  misc_feature: GYAE6OF02FP4EB.38.20.B09.1.454.CMB.1.raw
  modified_base (405)..(410): a, c, t, g, unknown or other
  misc_feature (405)..(410): n is a, c, g, or t
tcagtcgatcacgtcacgaccggtgctcgatttagtgtagtgtgaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattactgtgcgaaagatgtggggtggctggcccttgactcctggggccagggaaccctggtcaccgtctcctcagcctccaccaagggcccatcggtcttccccctggcaccctcctccaagagcacctctgggggcacagcgcctggctgcctggtcaaggactacttccacgtgatcgactgagcgggctggcaaggcgcatagnnnnnn

SEQ ID NO: 95743 - DNA, 426 bp, Homo sapiens
  misc_feature: GYAE6OF02FFPO2.38.20.B09.1.454.CMB.1.raw
  modified_base (304)..(304): a, c, t, g, unknown or other
  misc_feature (304)..(304): n is a, c, g, or t
  modified_base (417)..(426): a, c, t, g, unknown or other
  misc_feature (417)..(426): n is a, c, g, or t
tcagtcgatcacgtcacgaccggtgctcgatttagtgtagtgtgaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttcctttgactggttattatcccctagtgaccactggggccagggaaccctggtcaccgtctcctcagcctccaccaagggcccatcggtnttcccccctggcacccctcctccaagagcacctctgggggcacagcggccctgggctgcctggtcaaggactactccacgtgatcgactgagcgggctggcaaggcgcatagnnnnnnnnnn

SEQ ID NO: 95744 - DNA, 218 bp, Homo sapiens
  misc_feature: GYAE6OF02IM0GQ.38.20.B09.1.454.CMB.1.raw
  modified_base (215)..(218): a, c, t, g, unknown or other
  misc_feature (215)..(218): n is a, c, g, or t
tcagtcgatcacgtcacgaccggtgctcgatttagtgtagtgtgaagggtgccagggaaccctggtcaccgtctacctcagcctccaccaagggcccatcggtcttcccctggcaccctcctccaagagcacctctgggggcacagcggccctgggctgcctggtcaaggactacttccacgtgatcgactgagcgggctggcaaggcgcatagnnnn

SEQ ID NO: 95745 - DNA, 420 bp, Homo sapiens
  misc_feature: GYAE6OF02GPKMR.38.20.B09.1.454.CMB.1.raw
  modified_base (415)..(420): a, c, t, g, unknown or other
  misc_feature (415)..(420): n is a, c, g, or t
tcagtcgatcacgtcacgaccggtgctcgatttagtgtagtgtgaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctggggcacagcggccctggctgcctggtcaaggactacttccacgtgatcgactgagcgggctggcaaggcgcatagnnnnnn

SEQ ID NO: 95746 - DNA, 448 bp, Homo sapiens
  misc_feature: GYAE6OF02G20M9.38.20.B09.1.454.CMB.1.raw
  modified_base (434)..(448): a, c, t, g, unknown or other
  misc_feature (434)..(448): n is a, c, g, or t
tcagtcgatcacgtcacgaccggtgctcgatttagtgtagtgtgaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaactttccttttgactggttattatcccctagtgaccactggggccagggaaccctggtcaccgtctcctcagcctccaccaagggcccatcggtcttccccctggccacccctcctccaagacgcacctcgtgggggcacgagccggcccgtcggctcgccgtggtacgaaggacctacttccacgtgactcgactgagcgggctcggacaggcgcagtagcnnnnnnnnnnnnnnn

SEQ ID NO: 95747 - DNA, 486 bp, Homo sapiens
  misc_feature: GYAE6OF02GPQ9S.38.20.B09.1.454.CMB.1.raw
  modified_base (457)..(457): a, c, t, g, unknown or other
  misc_feature (457)..(457): n is a, c, g, or t
  modified_base (459)..(486): a, c, t, g, unknown or other
  misc_feature (459)..(486): n is a, c, g, or t
tcagtcgatcacgtcacgaccggtgctcgatttagtgtagtgtgaagggggctggagtgggtctcagttattagtggtagtggtagtagcacagattacgcagactccgtgaagggccggttcaccatctccagagacaattccaacagcacgctgtatttgcacatgaacagcctgagagccgaggacaggccccccccccatatattattgtgcgaaacttccttttgtactggttattactcccctagtgaccacgtcggggccgacgggaaccctggtcaccgtctcctcagcctccaccaaggcccatcggtccttccccctcggccaccctcctccaacgacgcacctctggggcgacacgccggcccgtgggcgtcgccgtcggtcgaacggtactacttccgacgtgactcgactcgaggcgggctcggacaacgggcgacagtaagcngnnnnnnnnnnnnnnnnnnnnnnnnnnnn

SEQ ID NO: 95748 - DNA, 237 bp, Homo sapiens
  misc_feature: GYAE6OF02HLSDR.38.20.B09.1.454.CMB.1.raw
  modified_base (217)..(237): a, c, t, g, unknown or other
  misc_feature (217)..(237): n is a, c, g, or t
tcagtcgatcacgtcacgaccggtgctcgatttagtgtagtgtgaagggtgccagggaaccctggtcaccgtctccctcagcctccaccaagggcccatcggtcttccccctggcaccctcctccaagagcacctctggggggcacagcggccctggggctgcctggtcaaggctacttccacgtgatcgactgagcgggctggcaaggcgcatagnnnnnnnnnnnnnnnnnnnnn

SEQ ID NO: 95749 - DNA, 126 bp, Homo sapiens
  misc_feature: GYAE6OF01DVTIP.4.28.C06.1.454.CMB.1.raw
tcagagcactgtagcacgaccggtgctcgatttagagctcacgtattgggttggcacagcggccctgggctgcctggtcaaggactacttcctacagtgctctgagcgggctggcaaggcgcatag

SEQ ID NO: 95750 - DNA, 142 bp, Homo sapiens
  misc_feature: GYAE6OF01EUSAY.4.28.C06.1.454.CMB.1.raw
  modified_base (130)..(142): a, c, t, g, unknown or other
  misc_feature (130)..(142): n is a, c, g, or t
tcagagcactgtagcacgaccggtgctcgatttagagctcacgtattgggtttgggcacagcggccctgggctgcctggtcaaggactacttccctacagtgctctgagcgggctggcaaggcgcatagnnnnnnnnnnnnn

SEQ ID NO: 95751 - DNA, 131 bp, Homo sapiens
  misc_feature: GYAE6OF01EDJRF.4.28.C06.1.454.CMB.1.raw
  modified_base (130)..(131): a, c, t, g, unknown or other
  misc_feature (130)..(131): n is a, c, g, or t
tcagagcactgtagcacgaccggtgctcgatttagagctcacgtattgggtttgggcacagcggccctgggctgcctggtcaaggactacttccctacagtgctctgagcgggctggcaaggcgcatagnn

SEQ ID NO: 95752 - DNA, 131 bp, Homo sapiens; identical to SEQ ID NO: 95751
  misc_feature: GYAE6OF01B5BJY.4.28.C06.1.454.CMB.1.raw
  modified_base (130)..(131): a, c, t, g, unknown or other
  misc_feature (130)..(131): n is a, c, g, or t

SEQ ID NO: 95753 - DNA, 131 bp, Homo sapiens; identical to SEQ ID NO: 95751
  misc_feature: GYAE6OF01CS5QB.4.28.C06.1.454.CMB.1.raw
  modified_base (130)..(131): a, c, t, g, unknown or other
  misc_feature (130)..(131): n is a, c, g, or t

SEQ ID NO: 95754 - DNA, 130 bp, Homo sapiens
  misc_feature: GYAE6OF01B627A.4.28.C06.1.454.CMB.1.raw
  modified_base (130)..(130): a, c, t, g, unknown or other
  misc_feature (130)..(130): n is a, c, g, or t
tcagagcactgtagcacgaccggtgctcgatttagagctcacgtattgggtttgggcacagcggccctgggctgcctggtcaaggactacttccctacagtgctctgagcgggctggcaaggcgcatagn

SEQ ID NO: 95755 - DNA, 129 bp, Homo sapiens
  misc_feature: GYAE6OF01EYV2N.4.28.C06.1.454.CMB.1.raw
tcagagcactgtagcacgaccggtgctcgatttagagctcacgtattgggtttgggcacagcggccctgggctgcctggtcaaggactacttccctacagtgctctgagcgggctggcaaggcgcatag

SEQ ID NO: 95756 - DNA, 569 bp, Homo sapiens
  misc_feature: GYAE6OF01CCK64.4.28.C06.1.454.CMB.1.raw
  modified_base (237)..(237): a, c, t, g, unknown or other
  misc_feature (237)..(237): n is a, c, g, or t
  modified_base (339)..(339): a, c, t, g, unknown or other
  misc_feature (339)..(339): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgacttggggganagatatgtttcctggtatctccagaggccaggccactcccctattctagtcatgtatcaaactacgaagccgcccctcacggggtccctgagtcgcttttcnggcctcaagtctggggacacagccactctgactctctccggggcccaggccatcgatggagggagactattactgtcgaggcggtgggacagcacaactgcagtcgttcgggcggagggaccgaggggtcgacccggtccgtgggtccacggcccgtaacgggcctcggccccccgttcggtcccgacgttcccgttacgttcccccgtcccctcccgtcccgtaacccg

SEQ ID NO: 95757 - DNA, 549 bp, Homo sapiens
  misc_feature: GYAE6OF01C23HG.4.28.C06.1.454.CMB.1.raw
  modified_base (432)..(432): a, c, t, g, unknown or other
  misc_feature (432)..(432): n is a, c, g, or t
  modified_base (484)..(484): a, c, t, g, unknown or other
  misc_feature (484)..(484): n is a, c, g, or t
  modified_base (535)..(535): a, c, t, g, unknown or other
  misc_feature (535)..(535): n is a, c, g, or t
tcagagcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttgggggagagatatgtttcctggtatctccagaggccaggccactcccctattctagtcatgtatcaaactacgaagcgccctcgacgggtccctgacgcgctttctggcctcaagtcgtggggacacgagccactctgactccgtcgtccgggcccaggccatccgatcggaggggatactatactgtccagggtcgtgggacngacacaactgcgagtccgttcgggcgggaagggccaggggtcaccggttcgngggtcaacgcccgaagggcctcggccccctcggtccacgtcctcgtccccnccctccgtctaacg

SEQ ID NO: 95758 - DNA, 544 bp, Homo sapiens
  misc_feature: GYAE6OF01EIK16.4.28.C06.1.454.CMB.1.raw
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaaacgcttgggggagagatatgtttcctggtatctccagaggccaggccactcccctattctagtcatgtatcaaactacgaagcgccctcaggggtccctgagcgtcttttctggctccaagtctggggacacagccactctcgactctccgtccggggcccacggccatcgagtgagggagactattactgtcgaggcgtgggacagcacaacgtgcaggtcgttcgggcggagggaccagggtcgaccggtccgtgggtcacgcccgaaggctcggccccctcggtccaccgtctcgttccccgccctccctcctaccg

SEQ ID NO: 95759 - DNA, 557 bp, Homo sapiens
  misc_feature: GYAE6OF01DINTE.4.28.C06.1.454.CMB.1.raw
  modified_base (377)..(377): a, c, t, g, unknown or other
  misc_feature (377)..(377): n is a, c, g, or t
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgacgttgggggagagatatgtttcctggtatctccagaggccaggccactcccctattctagtcatgtatacaaactacgaagccgcccctcgacggggtcccctgacgcgtcttttctggctccgaagtcgtaggggacacagccactcngactctcgtcccgggcccaggccagtcgagtggagggatactattactgtcgaggcgtgggacagcacactgctagtcgtcgggcggagggaccgaggggtcgaccggtcgtgggtccacggcccgaaggcctccggccccctcgggccacgtcctacgttccccaccctcctccctacg

SEQ ID NO: 95760 - DNA, 513 bp, Homo sapiens
  misc_feature: GYAE6OF01CZ7VY.4.28.C06.1.454.CMB.1.raw
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (339)..(339): a, c, t, g, unknown or other
  misc_feature (339)..(339): n is a, c, g, or t
  modified_base (492)..(492): a, c, t, g, unknown or other
  misc_feature (492)..(492): n is a, c, g, or t
tcagagcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgacttggggganagatatgtttccnggtatctcagagccaggccactccctattctagtcatgtatacaaactacgaagccgccctcgacggggtcccctggacgcgtcttttcnggctcaagtctggggacacagccactctgactctcgtcccggggccaggccatcgatgagggagactattactgtcgaggcgtggacagcacaactgcagtctgggcggaggacagggtcaccgtcgtggcagccgagctcgcccctcggtcnctctctccccacctcctctac

SEQ ID NO: 95761 - DNA, 673 bp, Homo sapiens
  misc_feature: GYAE6OF01CNWPF.4.28.C06.1.454.CMB.1.raw
  modified_base (238)..(238): a, c, t, g, unknown or other
  misc_feature (238)..(238): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgacgttggggganagatatgtttcctggtatctcaggagccaggccacctcccttattctagtcatagtatacaactacgaacgccgtcccgtcgacgggtccctggacgtcgtcttttcgtggtcctaccgaagtcgtacggggacacgacgccactctcgtactccgtcccggtacccggggcccacggcctacgtccggagttacgggaacgggtacgtaacgttaacgttacgtcggttacggtacgggtcggtacgggaacgacgaccgaacaacgtcggtacgtacggttccggttacgggacgggtacggggaaccgtacgggtccggacccggtccggtacggtccgaccggtacccggaacggtcccgtcccggcccccgttaccgtcccgtaccgttcccgttacccgttacccctaccccttcccgtccgttacccg

SEQ ID NO: 95762 - DNA, 555 bp, Homo sapiens
  misc_feature: GYAE6OF01D27R9.4.28.C06.1.454.CMB.1.raw
  modified_base (236)..(236): a, c, t, g, unknown or other
  misc_feature (236)..(236): n is a, c, g, or t
  modified_base (337)..(337): a, c, t, g, unknown or other
  misc_feature (337)..(337): n is a, c, g, or t
  modified_base (407)..(407): a, c, t, g, unknown or other
  misc_feature (407)..(407): n is a, c, g, or t
  modified_base (426)..(426): a, c, t, g, unknown or other
  misc_feature (426)..(426): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttggggganagatatgtttcctggtatctccagaggccaggccactcccctatctagtcatgtatcaaactacgaagcgcccctcgacggggtccctgagcgtcttttcnggctccaagtcgtggggacacgacgccactctgactctcgtcccggggcccaggccatcgagtgaggganactattactgtcaggtcgngggacaggcacactgctagtcgtcgggcggacgggaccagggtcgaccgtcgtgggtaccaggccccgaaggcctccggtccccccgtcggtcaccgtccttccgttccccgccctcccgtccgtaccg

SEQ ID NO: 95763 - DNA, 590 bp, Homo sapiens
  misc_feature: GYAE6OF01AK4N5.4.28.C06.1.454.CMB.1.raw
  modified_base (235)..(235): a, c, t, g, unknown or other
  misc_feature (235)..(235): n is a, c, g, or t
  modified_base (343)..(343): a, c, t, g, unknown or other
  misc_feature (343)..(343): n is a, c, g, or t
tcagagcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttggggganagatatgtttcctggtatctccagaggccaggccactcccctattctagtcatgtatcaaactacgaagccgcccctcgacggggtcccctggacgccgtcttttcgnggcctccgaaggtcgtggggaccacgacgccactctcgacctctccgtcccggggcccagggcccagtcgatggagggagtacttattacgtgtcagggcgtgggacagcacactgcagtcgtcgggcggagggaccgagggtcgacccgtccgtgggtccacggaccccgaagggtccctaccggccccccgttcggtcccaccgttccgttcccggttcccccgccccttcccgtcccgtaaccg

SEQ ID NO: 95764 - DNA, 545 bp, Homo sapiens
  misc_feature: GYAE6OF01DXOK5.4.28.C06.1.454.CMB.1.raw
  modified_base (341)..(341): a, c, t, g, unknown or other
  misc_feature (341)..(341): n is a, c, g, or t
  modified_base (363)..(363): a, c, t, g, unknown or other
  misc_feature (363)..(363): n is a, c, g, or t
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttgggggagagatatgtttcctggtatctccagaggccaggccactcccctattctagtcatgtatcaaactacgaagccgcccctcgacgggtccctgacgcgtcttttcnggctccaagtcgtggggacacngccactctgactctcgtcccggggcccaggccatcgatggaagggagactattactgtcaggcgtgggacagcacaactgctagtcgtcgggcggagggaccgagggtcgacgtccgtgggtcaggcccgaaggccgtcggcccccgtcggtcacgtcctcttccccaccctccgtcctacg

SEQ ID NO: 95765 - DNA, 598 bp, Homo sapiens
  misc_feature: GYAE6OF01D7MAX.4.28.C06.1.454.CMB.1.raw
  modified_base (341)..(341): a, c, t, g, unknown or other
  misc_feature (341)..(341): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttgggggagagatatgtttcctggtatctccagaggccaggccactcccctattctagtcatgtatcaaactacgaacgccgcccctcgacgggtccctgagcgtcttttcgngctacagtcgtggggacacagccactctgacttccgtaccgtcccggggacccacgggcccagtccgagtgggaaggggtacgtactaagttactggtacgagggtcggtgggaccagcaacacgtgcagtccgtcgggcggtagggaccgagggtcgaccggttccgtcgggtccacggcccgaacggcctccggcccccgtacgggtcccaccgttcttacccggttacccctaccccttcccgtcccgtaaccg

SEQ ID NO: 95766 - DNA, 540 bp, Homo sapiens
  misc_feature: GYAE6OF01BJHPV.4.28.C06.1.454.CMB.1.raw
  modified_base (236)..(236): a, c, t, g, unknown or other
  misc_feature (236)..(236): n is a, c, g, or t
  modified_base (337)..(337): a, c, t, g, unknown or other
  misc_feature (337)..(337): n is a, c, g, or t
  modified_base (404)..(404): a, c, t, g, unknown or other
  misc_feature (404)..(404): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttggggganagatatgtttcctggtatctccagaggccaggccactcccctattctagtcatgtatcaaactacgaagccgcccctcacggggtccctgagcgcttttcnggctccaagtctggggacacagccactctgactctcgtcccggggcccaggccatcgatggaggganactattactgtcaggcgtgggacaggcacactgcagtcgtcgggcggacgggaccagggtcgaccggtcgtgggtcacggcccgaacggtcctcggccccctcggtccacgtctcgtccccaccctccgtcctacg

SEQ ID NO: 95767 - DNA, 573 bp, Homo sapiens
  misc_feature: GYAE6OF01CFMSB.4.28.C06.1.454.CMB.1.raw
  modified_base (338)..(338): a, c, t, g, unknown or other
  misc_feature (338)..(338): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttgggggagagatatgtttcctggtatctcagaggccaggccactccctattctagtcatgtatcaaactacgaagcgccctcgacggggtccctgacgtcgctttttcgnggcctccgaagtcgtggggacacagccacgctgactctcgtccgggccaggccatcgatgagggagactatactgtcgaggcgtggacagacacaactgactacggtcgttcgggcgggaacgggaccgagggtcgacccgtcgtcgggtaccacggtaccccgaagggcctcggtccccccgtcggttaccaccttcccgtcggtttacccccacccttcccgttccgtaaccg

SEQ ID NO: 95768 - DNA, 660 bp, Homo sapiens
  misc_feature: GYAE6OF01EHTR9.4.28.C06.1.454.CMB.1.raw
  modified_base (236)..(236): a, c, t, g, unknown or other
  misc_feature (236)..(236): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttgggganagatatgttcctggtatctcagtacgccaggccacctccctattcctagtcatgtactacaaacgtacgaacgccgcccgtcgtacggggtccctgacgtcgttctttcgtcggctaccgaaggttccgtaggggacacgtacgccctaactcgtacgtacctccgtccgtcccgggcccgacgggtcctacgtcgaagtggaacggtagaacttacgttacgtgtacgaggtcgtcgggacacgactacaacgtcgacgtacgtccggtacgggaccgggtagggaccgtaggggtaccggtaaccggttccggtacgggtccaaccgggaccccgtaaagggtccctacccgggtcccccttacgggtacccttacccgttccgtacccgttaccccctaccccgtcccgttcccgtaaccg

SEQ ID NO: 95769 - DNA, 646 bp, Homo sapiens
  misc_feature: GYAE6OF01C438V.4.28.C06.1.454.CMB.1.raw
  modified_base (349)..(349): a, c, t, g, unknown or other
  misc_feature (349)..(349): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatccacctgcctctgaccaaacgacgttgggggagagatatgtttcctggtactctccagaggccaggccacctccctattctagtctatgtactacaaactacgaacgccgccctcgacgggtcctgacgtcgtcttttcgnggtcctaccgaacgttcgtacgggactacgacgtcctactctcgtacctcgtcccggtcccgggcccgacggccctagtccggtagtcgggaacgggaactacgttaattacgtcggtacgagggtccgggtacggactacgccaacgaacgtgacctaggttccgggtacgggacgggacgggacgtaggggtccaccgggtccgttacgggccgacgacccggacgtccgtaccccggtccccgtaggtcccaccgttcccgtccggttacccccgccccttccgttccgtacgg

SEQ ID NO: 95770 - DNA, 569 bp, Homo sapiens
  misc_feature: GYAE6OF01ECXF3.4.28.C06.1.454.CMB.1.raw
  modified_base (238)..(238): a, c, t, g, unknown or other
  misc_feature (238)..(238): n is a, c, g, or t
  modified_base (339)..(339): a, c, t, g, unknown or other
  misc_feature (339)..(339): n is a, c, g, or t
tcagagcactgtagcacgaccggtgctcgatttagagctcacgtattggggtttgggggggcctcaggaagaagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttggggganagatatgtttcctggtatctccagaggccaggccactccctattctagtcatgtatcaaactacgaacgcgcccctcacggggtccctgagcgtcttttcnggctccaagtctggggacacagccactctgactctcgtccggggcccaggccatcgagtggagggagactaattactgtcgagggcggtggacgagcacaactgcagtcgttcgggcggtagggaccgagggtcgaccggtccgtcgggtccgacggcccgaacggtccgtaccgcccccgttcggtcctaccgtccgttccgttccccaccccttcctcccgtctacgg

SEQ ID NO: 95771 - DNA, 564 bp, Homo sapiens
  misc_feature: GYAE6OF01C272X.4.28.C06.1.454.CMB.1.raw
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (338)..(338): a, c, t, g, unknown or other
  misc_feature (338)..(338): n is a, c, g, or t
  modified_base (404)..(404): a, c, t, g, unknown or other
  misc_feature (404)..(404): n is a, c, g, or t
tcagagcactgtagcacgaccggtgctcgatttagagctcacgtattgggtttgggggggcctcaggaagcagcatcggaggtgcctcagccatggcatggatccctctcttcctcggcgcccttgcttactgcacaggatccggggcctcctatcaactgactcaaccaccctcactgtccgtctctccaggacggacagccgtcatcacctgctctgcaaacgacttggggganagatatgtttccnggtatctccagaggccaggccactcccctattctagtcatgtatcaaactacgaagccgcccctcgaggggtccctgagcgtcttttcnggctccaagtctggggacacagccactctgactctccgtccggggcccaggccatcgatgaggganactattactgtcaggcgtgggacagcacaactgcagtcgttcgggcgggagggaccgaggggtcgacccggttccgtcggggtccacggcccgaacgggcctacggcccccgtcgggtccaccgttccgttacgttcccccacccttccctcccgtaacg

SEQ ID NO: 95772 - DNA, 582 bp, Homo sapiens
  misc_feature: GYAE6OF01BFUOC.4.28.C06.1.454.CMB.1.raw
  modified_base (236)..(236): a, c, t, g, unknown or other
  misc_feature (236)..(236): n is a, c, g, or t
  modified_base (338)..(338): a, c, t, g, unknown or other
  misc_feature (338)..(338): n is a, c, g, or t
  modified_base (444)..(444): a, c, t, g, unknown or other
  misc_feature (444)..(444): n is a, c, g, or t
  modified_base (457)..(457): a, c, t, g, unknown or other
  misc_feature (457)..(457): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttggggganagatatgttcctggtatctccagagccaggccactcccctattctagtcatgtatcaaactacgaagccgcccctgacggggtcccctgacgcgtcttttcnggcctcaagtcgtggggacacgagcctactctcgacttccgtccgtcccgggggcccacgggccagtccgagtggagggagactattacgtgtcgaggcgtggacngacacaactgacngtcgttcgggcggtacggacgagggtcgtaccggtccgtgggtccgacggaccccgaggcctccggcccccgttacggtccctaccggtttccgttcccccgtccctcccctcccgtaccgtcgg

SEQ ID NO: 95773 - DNA, 586 bp, Homo sapiens
  misc_feature: GYAE6OF01A9DPN.4.28.C06.1.454.CMB.1.raw
  modified_base (342)..(342): a, c, t, g, unknown or other
  misc_feature (342)..(342): n is a, c, g, or t
  modified_base (564)..(564): a, c, t, g, unknown or other
  misc_feature (564)..(564): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttgggggagagatatgtttcctggtatctccagaggccaggccacctcccctattctagtcatgtatacaaactacgaagccgcccctgacggggtccctgacgcgtcttttcnggctccaagtcgtggggacacagccactctgacctcgtccgtcccggggcccagggcccagtcgatggagggatactattactgtacgaggcggtggacaggacacaacgtgcagtccgttcgggcggacgggaccggagggtcgaccggtccgtgggtcgacggcccgaacggtcctccggtccccccgtcggtacccaccgttcccttccgttacccccnccccgttcccgtcccgtaaccg

SEQ ID NO: 95774 - DNA, 610 bp, Homo sapiens
  misc_feature: GYAE6OF01DWFGO.4.28.C06.1.454.CMB.1.raw
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttgggggagagatatgtttcctggtactctccaggacggccacggccactccctattctagtcatgtatacaaactacgaacgccgccctcgacgggtccctggacgtccgtcttttcgtggtcctaccgtaagtcgtaggggacacgacgccactctacgacctcgtcccgtcccggggacccacgggcctagtccgagtcggagggagtacttagttacgtgtacgaggtcgtagggacacgacacactgctagtcgtcgggcggacgggacgtagggtcgaccggttcgtgggtaccacggacccgaggtccctccggcccccgttacggtccctaccgttccgtcccggttcccccgccccttcccgtccgtacccgg

SEQ ID NO: 95775 - DNA, 591 bp, Homo sapiens
  misc_feature: GYAE6OF01DOPNT.4.28.C06.1.454.CMB.1.raw
  modified_base (345)..(345): a, c, t, g, unknown or other
  misc_feature (345)..(345): n is a, c, g, or t
  modified_base (575)..(575): a, c, t, g, unknown or other
  misc_feature (575)..(575): n is a, c, g, or t
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgacgttgggggagagatatgtttcctggtatctccgagacggccaggccacctccctattctagtcatgtatacaaactacgaacgccgccctgacgggtccctgacgtcgtcttttcnggtcctccgaagttcgtaggggacacgacgccactctcgacctccgtccgtcccggggcccagggccatcggagtgggagggagtacgttaattacgtgtcagggtcgtgggactacgacacaacgtcgactacggtcgttcggggcgggacgggaccgagggtcgaccgtcgtgggccacggcccgaacggtccgccggccccgtcggtcctacgtccttccggtcccncccctcctccgtaccg

SEQ ID NO: 95776 - DNA, 623 bp, Homo sapiens
  misc_feature: GYAE6OF01BE2FE.4.28.C06.1.454.CMB.1.raw
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgacgttgggggagagatatgttcctggtatctcagaggccaggccacctccctattctagtcatgtatcaaactacgaagccgcccctcgacggggtccctggacgtcgtctttcgtcgctaccgtaagtcgtggggactacgacgcctactcgtagacctcgtccgtcccggggcccacgggcctagtcgagtcggaagggtacgtacgttagttacgtcggtcgagggtcggtagggacacgacaacgactcgcgtagtccgtcgggacgggacggaccgtgggtacgaccgtcggtacgggtccaccggacccgaacgggtcccgtccggccccccgttacggtcccgacttcccggtacccggttcccccgccccttcccgttcccgtaaccg

SEQ ID NO: 95777 - DNA, 769 bp, Homo sapiens
  misc_feature: GYAE6OF01CL2SK.4.28.C06.1.454.CMB.1.raw
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttgggggagagatatgtttcctggttactctccagaggccaggccacctccctattctagtcatgtatacaaactacgaacgccgccctcgacgggtccctggacgcgtcttttcgtcggtcctaccgaacgtcgtcggggaacacgacgccaacttcgtacgtacctccgtccggtcccggggcccacgggacccacgtcggacgtagggacgggaacgtacgttaactttaacgtggtacgtacgggtcgggttacgggaacgtacggaaccaacgaaccgtcggaaccgtacggttaccgggttaccgggggaccgggtaaccgggggtaacccggtaacgggggtacccgggttaaccccgggttaccgggttaccggggtacccggtaacccgggaccccgggtaaaccggggtccccggttacccccgggttcccccccggttaccgggttacccccgttacccgtttccccggtttacccccgggtttccccccgttacccccccgttccccgtttacccccggttaacccgg

SEQ ID NO: 95778 - DNA, 675 bp, Homo sapiens
  misc_feature: GYAE6OF01BMZWK.4.28.C06.1.454.CMB.1.raw
  modified_base (351)..(351): a, c, t, g, unknown or other
  misc_feature (351)..(351): n is a, c, g, or t
  modified_base (475)..(475): a, c, t, g, unknown or other
  misc_feature (475)..(475): n is a, c, g, or t
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttgggggagagatattcgtttcctggttatcctccgagtacggccaggccacgtcccctattctagtcatgtatacaaactacgaagccgcccctcgacggggtccctgagcgtcttttcgnggcctccaagtcgtggggacacaggccctactctcgacctcgtccgtcccggggcccacgggccagttccgagtgggaagggacgtacttagttacgttacggtcgagggtaccggtgggaacnggaccaacctaactggcctaaggttccgttcggggacgggtacgggaccgtaggggtacggacccggttccgtaggggttaccaccgggtaccccggtaaacgggtcccgttcccggacccccccgttcggtacccgtaccccgtttccgtttaccccgggttcccccccgccccctttcccgtccccggttaacccggg

SEQ ID NO: 95779 - DNA, 651 bp, Homo sapiens
  misc_feature: GYAE6OF01ESMFI.4.28.C06.1.454.CMB.1.raw
  modified_base (236)..(236): a, c, t, g, unknown or other
  misc_feature (236)..(236): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttgggganagatatgttcctggtatctccagacggccaggccacctccctattctagtctatgtactacaaaactacgaacgccgcccctcgacggggtccctggacgtccgtcttttcgtcggtcctaccgaacgttcgtacggggactacacgcccacgtctcgactccgtccgtcccgggcccacgggccacgtcgagttgaagggtacgtaactagttacgtgcgagggtcggtacgggactacgacaacacgtcgtacgtacggttccgtcggggtacgggaccggggtaccgtaaggggtaccggtaccggttccggtacggggttaccaccggtacccggaacggtccgtccccgtccccggttcgtcccgtacccgtcggttacccgttccccgtcccctcccgtcccgtaccgg

SEQ ID NO: 95780 - DNA, 627 bp, Homo sapiens
  misc_feature: GYAE6OF01AM3G4.4.28.C06.1.454.CMB.1.raw
  modified_base (236)..(236): a, c, t, g, unknown or other
  misc_feature (236)..(236): n is a, c, g, or t
  modified_base (346)..(346): a, c, t, g, unknown or other
  misc_feature (346)..(346): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgcgttggggganagatatgttttcctggtatctccagaggccaggccactcccctattctagtcatgtactacaaactacgaagccgcccctcgacggggtcccctggagccgtcttttcgnggcctccgaagttcgtaggggacacgagccactctgaccttcgtccgtcccggggcccacgggcccatccggatggacgggagtaacttattacgtgtcgagggtcgtacgggacacgcacgaacctgccgtagttccgtacgggccgggacgggtaccgaggggtccgtacccgggtccgtcgggccgaacggccccggaacggtcccgtcccggccccccggttcggtccctaccgttcccgtcccgttaccccctccccttccccgttccgtacccgg

SEQ ID NO: 95781 - DNA, 754 bp, Homo sapiens
  misc_feature: GYAE6OF01AI3RC.4.28.C06.1.454.CMB.1.raw
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgacgttgggggagagattattcgtttccgtggtactcctccgaggacggccgacggccctacctccccttattccgtagtccaattgtaactaccaaaacgtaccgaacggcccgtaccccgtccggacggggttcccctggacgtccgttccgttttccgtcgggtcctaccgtaaggttccgtaggggaccacgacgccctacgttccgtacgtaccctccgtcccggtccccggggcccaacgggccagtaccggagtgggacgggtactaacgttagttacgtcggtaccggacgggtcgggttagggaccgacggaccgtaaccaacgtcggtaccgtacggttccggttacggggaccggggtaacggggaccggtacgggggttccgacccggttccggtacgggtccgaaccggtacccggaacgggtcccgttaccccggtccccccggtttaccggtcccgtaccccggttccgttaccccggttcccccgttccccccttcccgtcccgttacccgg

SEQ ID NO: 95782 - DNA, 653 bp, Homo sapiens
  misc_feature: GYAE6OF01B9S2Q.4.28.C06.1.454.CMB.1.raw
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcactcacctgctctgacaaacgacgttgggggagagatagttgttccgtggtactctccgaggacgccgacggcctacctccctacttctagtcattgtactacaactacgaacgccgccctacgacgggtccctgacgtccgtctttcgtcgtcctcgtaagtcgtcggggaccacgacgccactctcgacctcgtccgtccgggccacggcctagtcgagtggaacgggactaacttacttacgtcgtacgacggtcggtcgggaacaccggacaacgtacgtcgtacgtacgggtttccgtaccggggtacgggacgggaacgtaggggttccacccgggttccgcgggtacccgaccggtcccgaacgggtccttccccggcccccgttcggacccgttacttcccggttacccgtccccctcccgttcccgtccgtaacccgg

SEQ ID NO: 95783 - DNA, 622 bp, Homo sapiens
  misc_feature: GYAE6OF01EQZ4T.4.28.C06.1.454.CMB.1.raw
  modified_base (237)..(237): a, c, t, g, unknown or other
  misc_feature (237)..(237): n is a, c, g, or t
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgcgttggggganagatatgtttcctggtatctcagaggccaggccactccctattctagtcatgtatcaaactacgaacgccgcccctcgacggggtccctggacgtcgtcttttcgtggcctccgaagtcgtcggggacacacgcctactctgactcctccgtcccgggcccagggccctagtcgagtacggagggagaacttattacgtgtacgagggtcggtgggacaggcaacaacgtgacgtagtccgttcgggcgggacgggaccgaggggtcgacccggtccgtcgggtaccacggacccgacgggtcccgttcccggccccccgtccgggtaccctacccgttcccttcccggttacccccctaccccgttccccgtcccgtaacccgg

SEQ ID NO: 95784 - DNA, 651 bp, Homo sapiens
  misc_feature: GYAE6OF01BX4BV.4.28.C06.1.454.CMB.1.raw
  modified_base (585)..(585): a, c, t, g, unknown or other
  misc_feature (585)..(585): n is a, c, g, or t
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggagtccggggcctcctatcaactgactcaaccaccctcactgtccgtctctccaggacggacagccgtcactcacctgctctgacaaacggacgttgggggagagatattgtttcctggtatctcaggacggccaggccacctccctattctagtcatgtactacaaactacgaacgccgcccgtcgacggggtccctggacgtccgtcttttcgcggtcctcgaagtcgtcggggacacacgccactctacgaccttccgtcccggtcccggggccctacgggcctacgtcggaacgtcgggagggacgtaacttacgttacgtcggtcgacgggtcgggtggacaggccaacaacgtcgacgtacggtccggtcggggacgggacgggaccggagggtaccccccgaggtccggcgggtccgaccggacccggaacgggtcccncccggtcccccgtcggtacctcccgttccggttcccgttacccccgccccttccctcccgtaccgg

SEQ ID NO: 95785 - DNA, 562 bp, Homo sapiens
  misc_feature: GYAE6OF01DK044.4.28.C06.1.454.CMB.1.raw
  modified_base (235)..(235): a, c, t, g, unknown or other
  misc_feature (235)..(235): n is a, c, g, or t
tcagagcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttggggganagatatgtttcctggtatctccagaggccaggccactccctattctagtcatgtatcaaactacgaagcgccctcacggggtccctgagcgcttttctggctccaagtctggggacacgagccactctgacctcgtccgtccggggcccaggccagtcgatggagggagactattactgtcaggcgtggacagcacactgcagtcgtcggcggacgggaccgaggggtcgaccggttccgtcgggtccacggcccgaaggcctacggccccccgttcgggtcccaccgttccttcgttcccccgccccttcccgtcccgtaaccggg

SEQ ID NO: 95786 - DNA, 690 bp, Homo sapiens
  misc_feature: GYAE6OF01A4H54.4.28.C06.1.454.CMB.1.raw
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacacgccgtcactcacctgctctgacaaacgacgttgggggagagatatgtttcctggtatctcagcgccaggccactccctattctagtcatgtatacaaactacgaacgccgccctcgacgggtccctgacgtcgtcttttcgcggcctccgaagtcgtaggggacacgacgcctacgtctcgtacttccgtccggtcccggggcccacgggccctacgtcggagtgggaacgggacgtaacttagttacgtcggtcgacgggtcggtaggggaccaggaccaacgtaacgtcgacgtacggttccggttacggggaccgggtaacgggtaccggtacggggtacggtaccccggttcgggtacgggtaccgaaccggtccccggaaacgggtcccgtacccgggtccccccgttcgggtaccccttacccggttcccggtttacccccggttccccccgtacccccttcccgttcccccgttaaccggg

SEQ ID NO: 95787 - DNA, 762 bp, Homo sapiens
  misc_feature: GYAE6OF01BPBBK.4.28.C06.1.454.CMB.1.raw
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccgaggacgacagccgtcactcacctgctctgacaaacgcgtggggagagatatgttctgtatctcagacggccagccacctccctattcctacgtcactgtactacctaaaacgtacgaaacgccgtcccctcggtaccgggtccctaggacgtccgttcttttaccgcggtcctacgtaacggttcggtacggggacctaccgacggccctacgtaccgttcgtaaccttccgttccccgggtccccgggggtacccgtacgggacccctagtacccgggtaagttacgggggaaacgggtaacgtaaccgtttaagtttacccggtacggttaccggacgggtttacgggacgggggtaaaccacgggaacctaacccgtaacgtcggtaaccggtacgtttccccggggtaccgggggtaccgggtaaacgggggtacccggaaggggtttacccgggacccggtaccgggttcgggtacccgaccggtacccggtaacggtcccgtccccgggtacccctcgggtacctccgttcgttcccgtccccggtccccttctcccggtaacg

SEQ ID NO: 95788 - DNA, 896 bp, Homo sapiens
  misc_feature: GYAE6OF01C0MF9.4.28.C06.1.454.CMB.1.raw
tcagagcactgtagcacgaccggtgctcgatttagagctcacgtattggggtttgggggggcctcaggaagcagcatcggaggtgcctcagccatggcatggactccctctcttcctcggcgtccttgcttactgcacgaggacgtcccggggcctcctatccaactgacctaccaacccaccctcactcgtccgtctctccgagggacgacacgccgtcactccacctgcctcgtacgaacgaaacggtacgggttaggggggaacgtagtagtttagttcggttttccgtagggttacttccgtaccgaagggaccggaccgacggtccctaccctcccctattcgtacgtactacgtacgtaactaaccgaaacctaaccggaaccgcccgtaccctacggtacgggtccccgtaggacgtccgttcgttccgtcggtacctaccgtaacggtcggtacgggaactacgaccgtccgtaccgtaccgtacgtccttcccgtccccgggtacccgggcccgtaccggaccgttacgtacggaaccggtgggaacgggtaacgttaccgttaacgttaacggtcggtaaccgggtaacggggtcgggttaaccgggaaccgaccggtaacccgtaaacggttaaacccggtcgaacccgggttacggggttacccggttaacccgggggggacggggttaacccgggggaacccgggttaacgggggttcccggtaaccccggggttccggtaccggggtaacccggtacccgggaacccccggtaaccggggttccccgtaccccccggtcccccgggtaccgggttaccctaccccggtttccccggtttcccccggacccccgttccccccttaacccggtaccccgtacgg

SEQ ID NO: 95789 - DNA, 796 bp, Homo sapiens
  misc_feature: GYAE6OF01C6UMO.4.28.C06.1.454.CMB.1.raw
tcagagcactgtagcacgaccggtgctcgatttagagctcacgtattggggtttgggggggcctcaggaagcagcatcggaggtgcctcagccatggcatggactccctctcttcctcggcgtccttgcttactgcacaggacgtccggggcctcctatcaactcgactaccaaccaccctcactcgtccgtctcctccgaggacggacacgccgtcactcacctgctcgcgacaaacggtcggttggggagagattagtcgtttccgtggtactcgtaccgaggacggccacggccctaccttaccccttattcctacgttctaattacgtaactaaccaaaacgtaccgaaccgtcccgtaccccgttacggaccggggttccctggaccggtccgttccgttttccgcggtaccctaccgtaacggttccgggtacggggaacctaaccgtaccggaccctacgttaccgtaccggtaacccgtttcccggtcccgggtaccccgggggaccccaacggggaccctaacgttaccgggaacggttacgggaacggggtaaccgttaacgttaacgtttacggtacggtacgtacggggtacggtcgggaacacggtacaaccgtacgtcgtacgtaacgttccggtacggggacggtaaaccgggtcggacgggtaccggtacccggtcgggttcgggaccacggtaccccggaacggtcccgtacccggcccccggttacgttcccgtacccgttccgtcccggttacccccgccctttcccgcttacccgg

SEQ ID NO: 95790 - DNA, 817 bp, Homo sapiens
  misc_feature: GYAE6OF01C94F7.4.28.C06.1.454.CMB.1.raw
tcagagcactgtagcacgaccggtgctcgatttagagctcacgtattggggttgggggggcctcaggaagcagcatcggaggtgcctcagccatggcatggatccctctcttcctcggctccttgcttactgcacgaggactccggggcctcctatcaactgactcaacccacctcactgtccgtctctccgaggacgacacgccgtacactcctacctcgacctcgtacgacgtaacggtacggttagggggaacaggtacttagttcggttccgtaggttaactccgtacgacggacggcccgaggtaccctaccttcccttattcctacggtactagttacgtaacttaaccaaaccgtaacgaacgtcccgtacccgtacggtaccgggtccctggaccgttccgttacgttttccgacggttcctaccgtacggtacggtacgggtaccacggtacctaccctacgtacgtccggtaccttccgtccgggtacccgggaccctacgggtacctaggtaccggtaacgtacgggaacgggtacctaacggttaacgttacgtacgggtacgtacgggttaccggtaggggtaacctacgaacgttaacccgtacgggtacgtccgtaaccgggttccgggtaaccgggtacggggtaaccggtccgggttacggtacccggtaccggttccgggacggttacccgaacgtacccggggtaacgtccccgtacccggtaacccccggtttccggaacccgttccgttccccgggtaacccccttcccggcccccttacggtaccgttacccggg

SEQ ID NO: 95791 - DNA, 706 bp, Homo sapiens
  misc_feature: GYAE6OF01ACGB8.4.28.C06.1.454.CMB.1.raw
  modified_base (346)..(346): a, c, t, g, unknown or other
  misc_feature (346)..(346): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatccacctgctctgacaaacgacgttggggagagatatcgtttctggtactcctcagacggccaggccacctcccctattctagtcatcgtatacaaactacgaacgccgccctcgacgggtccctgacgtctcgtttcncggtcctacgtaacgtcgtcgggacacgcgcctacgtctacgacctcgtaccggcccgggtacccacgggccctaagtccgtaagtacgggacggggtaactaactttacgtttaccgtacggtaccggaaggggttccggtacggggtaaccacggtaaccgaactaaaccggtgtaacgtaccgtttcgggtccggggaccggggaacggtacccgggtagggtccggtacccggttcggtccgggttaccggaccgaccccgggttaacgggccccgttcccggcccccggtttcgggaccccttacgttccccgtttaccccttcccccctaccccgttccctacccgttacccgg

SEQ ID NO: 95792 - DNA, 638 bp, Homo sapiens
  misc_feature: GYAE6OF01BBTME.4.28.C06.1.454.CMB.1.raw
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttgggggagagatatgtttcctggtatctccagacggccaggccactccctattctagtcatgtactacaaactacgaagccgccctcgacgggtccctgacgcgtcttttcgtcggcctccgagtcgtcggggacacgacgaccactcgtcgacctccgtccggtcccggggcccacggaccacgtcgagtcggacgggagtaacttacgttacgtcgtcgagggcggtacgggactacgacaacgactcggacacggttcggtccgggacgggtacgggaccggtagggtccgtaccggtcggtcgggtaccgacggacccggaacggtccgtacccggtcccccgtcggtccctacccgttcccgttacccggttaccccctaccccgttcccgtcccgttaaccgg

SEQ ID NO: 95793 - DNA, 751 bp, Homo sapiens
  misc_feature: GYAE6OF01ERY47.4.28.C06.1.454.CMB.1.raw
  modified_base (238)..(238): a, c, t, g, unknown or other
  misc_feature (238)..(238): n is a, c, g, or t
  modified_base (302)..(302): a, c, t, g, unknown or other
  misc_feature (302)..(302): n is a, c, g, or t
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgacgttgggganagatattcgttcctggtactcctcaggacggccgaggcctacctcccttattctacgtctagtntactactaaacgtacgacgccgaccctcggacgggtcccaggacgtcgttcgtttcgcgcctaccgagtcgcgggacacgacgccactcgtacgaccttccggtccggtacccggggacccacgggtaccctaacgtccgggtaagtacggggtaacggggtaaccgttaactttaacgttacggtaccggtacggtaacgggggtcgggttacgggaacgaaccgtacgaacccttaacgtacggcttaaccgggtcggtttaccgggggaacggggtacgggtaaccggtacgggggtaccgttacccggtccggggttcgggaacccggtaccggaacccggtacccgggtaccggttccccggtcccccgggttacccggtccgttaccccgttaccggttcccccggttaccccgtccccctttacccgtccctttaaacccgg

SEQ ID NO: 95794 - DNA, 681 bp, Homo sapiens
  misc_feature: GYAE6OF01ACJNY.4.28.C06.1.454.CMB.1.raw
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaacccaccctcactgtccgtctctccaggacggacagccgtcactcacctgctctgacaaacgacgtgggggagagatatgttctggtatctcagacggccacggcctacctcccctattctacgtctatgtactacaaacgtacgaacgccgccctacggacgggtcctgacgtcgtctttcgtcgtctccgacgtcgtcgggacacgacgcctactcgtcgtactccgtccggtcccgggccgacggtccagtcgagtacgggaggtactacttagttacgtgtacggagggtcgtacgggacacgccgaacgacgtcgacgttaacggtccgggtacgggaccgggtaacggggaccgtaggggtacccggtaccgtccgggtacgggtaacccgtacccgggaccgtaaccggggtcccgttacccccgggcccccgtttcccgggtacccttacccggttacccgttccccggttaccccccctacccgtttccccgtaccttacccggg

SEQ ID NO: 95795 - DNA, 785 bp, Homo sapiens
  misc_feature: GYAE6OF01CFR5M.4.28.C06.1.454.CMB.1.raw
  modified_base (526)..(526): a, c, t, g, unknown or other
  misc_feature (526)..(526): n is a, c, g, or t
tcagagcactgtagcacgaccggtgctcgatttagagctcacgtattggggtttggggggggcctcaggaagcagcatcggaggtgcctcagccatggcatggatccctctcttcctcggcgtccttgcttactgcacaggagtccggggcctcctatcaactgactcaacccaccctcactgtccgtctctccgagggacggacagccgtcatcacctgctctgacaaacgtacggtagggggagagtattattcgtttccgtggtatctaccgaggcggccacggcccaccttaccctattctagtaccagtacgtactacctaaactacggaacgcccgacccgtcggacgggtccctggacgtccgttcttttcgtcggccttacgtaacggtcggtagggaaccacgacgacccactcgtcgtacctccgtccggcccggggcccgacgggcctacgtcggagtacgggacgggtaactactaacggttctacggtacggagggtaccggtcgggtaaacncggaaacccgtactaaccggttcgccgggttaacgttcccggggtccggggaacgggggtacccggggggttaacgggtacgggggttccggtaacccgggttccccgggggttacgggtacccggaccggggtaccccgggtaacgggtccccgtttacccggggtcccccccgggttaccggtccccggttacccgttacccggtttcccccgggttaccccccggtaccccctttcccggttaacccgggtaccgg

SEQ ID NO: 95796 - DNA, 867 bp, Homo sapiens
  misc_feature: GYAE6OF01D7XX7.4.28.C06.1.454.CMB.1.raw
  modified_base (217)..(217): a, c, t, g, unknown or other
  misc_feature (217)..(217): n is a, c, g, or t
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactcgtccgtctctccgaggacggacagccgtcatcacctnctctgacaaacgcgttagggggagagtattagttcgtttccgtaggtactcctccgaaggacggacccacggccctaccttaccccttatttcgtacgttacctagttcgtaactaccctaaaaacgttaccggaaacgtccccggaccccgttacgggtaccgggggttccctacgggacgtcccgttttcgtttttccgtcgggtacccttacccggtaacggtttaccggtaagggggaaccctaacgtaccgtacccctaacgttcgttacctaccgttccccggtccccgggtacccccgggggaccccgtaacggggtccctaaccgttccgggtaaggtacgggaaacggggtaaccttaacgtttaacgttacggtcggtaaccggtacggggttaccggtacggggaaacctacgaacccgtaacgtaaccgttacggacccgtaggttcccggttaccgggggtacggggaaaccgggtcggtaacggggttcccggtaacccgggttccggttacgggtaccgacccggtaaccccggtacggggtcccgtaccccggtccccccgttacgggtacccctcccgttacccgttacccgttacccccccttaacccgttcccgttaaccccgttaccggg

SEQ ID NO: 95797 - DNA, 700 bp, Homo sapiens
  misc_feature: GYAE6OF01BBD4O.4.28.C06.1.454.CMB.1.raw
  modified_base (237)..(237): a, c, t, g, unknown or other
  misc_feature (237)..(237): n is a, c, g, or t
  modified_base (351)..(351): a, c, t, g, unknown or other
  misc_feature (351)..(351): n is a, c, g, or t
  modified_base (368)..(368): a, c, t, g, unknown or other
  misc_feature (368)..(368): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggactccggggcctcctatcaactgactcaaccaccctcactgtccgtctctccaggacggacagccgtcatcacctgctctgacaacgcgttggggganagatgttgtttcctggtactctccgaaggtacggccgacggccctaccttccccttattcgtagtactattgtaactacaaacgtacgaacgcccgcccgtcgacggggtcccnggacgtcgttctttcgngtcctaccgaaggtcgtacggggaccacgcgtcctactccgtacgaccttccgtccggtcccggggacccacggcctaggtcgaggtaggaacgggtactacgtacgttacgtcgtacggagggtacgggtaggtacacggacctaacgaccgtggccgttacggtccggtacgggaccgggtaacgggtaccggtacggggtccgtacccggttcggtaccgggtccaaccgggtacccggaacggtcccgtaccccggtccccggttccggtaaccctcccgtttaccgttccccggttaccccgtccccctttcccgttccgtacccgg

SEQ ID NO: 95798 - DNA, 643 bp, Homo sapiens
  misc_feature: GYAE6OF01AUM8J.4.28.C06.1.454.CMB.1.raw
  modified_base (236)..(236): a, c, t, g, unknown or other
  misc_feature (236)..(236): n is a, c, g, or t
  modified_base (514)..(514): a, c, t, g, unknown or other
  misc_feature (514)..(514): n is a, c, g, or t
  modified_base (596)..(596): a, c, t, g, unknown or other
  misc_feature (596)..(596): n is a, c, g, or t
  modified_base (628)..(628): a, c, t, g, unknown or other
  misc_feature (628)..(628): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaacgcgttggggganagatatgtttcctggtactctccagacggccaggcccacctcccctattctagtacatgtactacaaacgtacgaacgccgtacccctcggaccggggtccctggaacgtccggttccttttcgtcggtccttaccgtaacggttccgtacgggggaccacgacgcctacgtcgtcgaccttccgtcccggtcccggggtcccacgggtcctacgtaccggagtacgggaaggggtactaacgttacttacgttggtccgacgggtcggtacgggacncgaccaacgactcgcgtacgttccggtcgggacgggacggacgtgggtccgaccgtcggtacggccgacgacccgaggtccnccggtccccgtcgtcacctcgtcccgtacccnccctccgtccgtacg

SEQ ID NO: 95799 - DNA, 719 bp, Homo sapiens
  misc_feature: GYAE6OF01B5OO9.4.28.C06.1.454.CMB.1.raw
  modified_base (238)..(238): a, c, t, g, unknown or other
  misc_feature (238)..(238): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccgaggacgacagccgtcatcacctgctctgacaaacgtcgttggggganagatatgttcctgtatctccagcgcaggccactccctatctatcatgtatacaaactacgaacgccgcccctcgacggggtccctggacgtcgttcttttcgcggtcctacgtaaacgttcgtacggggtaaccacgacgtacccaccttcgtacgtaccttcccggtcccggtcccccgggggtacccacgggccctagtaccggtagtacgggaagggacgtaacttaacgttacgtacggtccgtagggtcggtacgggaacctaggaccaacgtaacgtgccgtacggttccggttacggggacgggaaccgggtacggacgggggttccgacccgggttaccggtcgggtacccgtaacgggtcccccgtaaggggtccccgtacccccgggtccccccggttcgggttacccctaacccgtttccgttaccccgtttacccccccgacccccgtttcccggtccccgttaaccgg

SEQ ID NO: 95800 - DNA, 909 bp, Homo sapiens
  misc_feature: GYAE6OF01D8ODN.4.28.C06.1.454.CMB.1.raw
tcagagcactgtagcacgaccggtgctcgatttagagctcacgtattggggtttgggggggcctcaggaagcagcagtcgggaggtgcctcagccatggcatggactccctctcttcctcggcgtccttgcttactgcacgaggtacgtcccggggccttcctatcaacttcgacctaccaacccaccctctactcgtcccgtctcctccgagggacggactacggtcctactactccgtacctggtcctcgtacgtaacccgtaaaaccgggtagggttaggggggaactaagttagtttaacggttttccggtttccgttaaggttaccttacccgttaccgtaacgggaaccggtacccggaccggtaccccttaacccttaccccgtttaactttccgtaacgttccgtttaaggttaacgtaaccttaaccgttaaaaaccggaccggttaaacccggccccccggtaaccccggttacgggtaccccggggttaccctaagggtccgtccccgtttgttttaaccggccgttccgtaacccgttaggggttacgtaacccgggttaccaatcccggaccctacgttacccggcgttaaaccctccggttacccggccccgggaacgtccggtaaccgttacgtacgtacgggtagggtaacggttaacgtaactttacgtcggtacggttacgtagggtaccggtaggacgtacgactaacgtacgtacggtacgtacggtacggtcgggtacggggtaacgggtaccgggttacggtacccgttaccggtcggtaccgggtaccggtaaccggccgtacccggtacgttccccggaccccgttacggtcccttaacccgtcccgttaaccccgttccccgtcccgttcccgtcgttacccgg

SEQ ID NO: 95801 - DNA, 861 bp, Homo sapiens
  misc_feature: GYAE6OF01EYMH5.4.28.C06.1.454.CMB.1.raw
  modified_base (842)..(842): a, c, t, g, unknown or other
  misc_feature (842)..(842): n is a, c, g, or t
tcagagcactgtagcacgaccggtgctcgatttagagctcacgtattggggtttgggggggcctcaggaagcagcatcggaggtgcctcagccatggcatggactccctctccttcctcggcgtccttgcttactgcacgaggacgtccgggcctcctatcaactgactcaaccaccctcactcgtccgtctctaccgagggaccgacgacgtccgtactactacctaccgtcgtccttaccgtacggaaccgtaaaaccgggtacgggtttaggggggaatagtacgttagtttcgttttccgtaggttactccgtaccgacggaccggaccgaccgggccctaacccttaccccttagttttaccgtacggttacctaacgttacggttaaccttaaacccgtaaaaccggttaacccggaaccggtcccccgtccccggtaccgggtaaccgggttcccgtagggtaccggttccgtttccgttttaccgtccggtaccgttaaccgtacggtccgtacggggaacccacggtaccgtacccttaaccgtcgtaacccgttccttcccgggtaccccggtccccggggacccgtacggcccgtacggtacggtacggtaagggtaacggggtaaccttacgttacgttacggacggttcgggacgggtcgggtaccggaacgacggaacctaaccgtaccgtcgtaccgtacggttcccggggacgggacggggtaccggacgggtaccgggtacgtacccggtcgtacgggccgtaccgacccggaccgtccggccccgtcccggttagtacccctccgttaccgccccgttaccccncccgttccgtacctaccgg

SEQ ID NO: 95802 - DNA, 764 bp, Homo sapiens
  misc_feature: GYAE6OF01C0MM9.4.28.C06.1.454.CMB.1.raw
  modified_base (272)..(272): a, c, t, g, unknown or other
  misc_feature (272)..(272): n is a, c, g, or t
  modified_base (348)..(348): a, c, t, g, unknown or other
  misc_feature (348)..(348): n is a, c, g, or t
  modified_base (704)..(704): a, c, t, g, unknown or other
  misc_feature (704)..(704): n is a, c, g, or t
tcagagcactgtagcacgaccggtgctcgatttagagctcacgtattggggtttgggggggcctcgggaagcagcatcgggaggtgcctcagccatggcatggactccctctcttcctcggcgtcctgtcttactgcacgaggcgtcccgggcctcctatcaacgtgacctaccaacccaccctcaccgtcgtccgtcctccaccgacgggacgacgacgccgtcactccacctgtcctacgtacgaaccgtaaacggtcggtagggggaanagtagtacgttcgtttcctggtaacttccgacgaggacgtaccgaccgaccctacccttcccgtattcgttacgtntacgtacgtaacaaccgtaaaacgtaccgaaccgcccgtacccgtacggtccggtccctaggtaccgtccgtttacgttccgacgtaccgtaccggtacggttaccgggacgggaacccacgtaccgtccctaaccgtcgtaacccggtccgtcccggttacccggggccccgaccgtaccggtaccgtacggtaccgtagggtaacggacgggtaactacgtttacgttacgtcggtaagggtccgggtacggaaccggtacgacgaccctaacgaacgtcgtacggttcggtaccggtacgggaccgggtacgggaacggtcggtacccgtcggtacggtcgaccgacggaccncggcccgtccgccgtccgtccgtccttaccgtcccttacccgtcctcccgtctcggtccg

SEQ ID NO: 95803 - DNA, 669 bp, Homo sapiens
  misc_feature: GYAE6OF01E1443.4.28.C06.1.454.CMB.1.raw
  modified_base (523)..(523): a, c, t, g, unknown or other
  misc_feature (523)..(523): n is a, c, g, or t
tcagagcactgtagcacgaccggtgctcgatttagagctcacgtattggggtttggggggggcctcaggaagcagcatcggaggtgcctcagccatggcatggatccctctcttcctcggcgtccttgcttactgcacagggatccggggcctcctatcaactgactcaaccaccctcactcgtccgtctcctccaggacggacagccgtcatccacctgctctgaccaaacgtacgttgggggagagtatattcgtttcctggcctatcctacgaacgacggccacggccacctcccctattctacgtcatgtaactacaaacgttaacgaacgccgccctacggtacgggtccctggacgcgttactttcgtcggtctccaaggtcgtacggggacacgacgtaccacttcctacgtacctccgttaccggtcccggggccccgaacggcccctaacggtccgtaaggtacgggtaacggggtaactaccgttagttaccgtgtcgagggtcgtacgggancgacacgacgtcgacgtacggttcgtacgggagggtaccggaccgagggggtaccacccggtcggtcggtacgaccggaccggacgtccgtccccggcccgttacgacccgtccttcccgtacccgttccccgtcccgtcctaccg

SEQ ID NO: 95804 - DNA, 713 bp, Homo sapiens
  misc_feature: GYAE6OF01BF3R5.4.28.C06.1.454.CMB.1.raw
  modified_base (258)..(258): a, c, t, g, unknown or other
  misc_feature (258)..(258): n is a, c, g, or t
tcagagcactgtagcacgaccggtgctcgatttagagctcacgtattggggtttgggggggcctcaggaagcagcatcggaggtgcctcgagccatggcatggatccctctcttcctcggcgtccttgcttactgcacaggactccggggcctcctatcaactcgactacaaccacctcactcgtccgtctctccgacggacggacacgccgtacactccacctgtcctctacgacgtaaacgtacggttaggggganagtagttacgttcgttaccgtggtactctcgacgacgccgacggcctacccgttaccttacgttctacgtcgtattacgtataaccaaacgtaccggaacgtcccgtcccgtacggaccgggtacctcgtacggtcttcgtttcgtcgcctacgtaacgttcggtacgggaccacgcgtacctacgtcgtacgtccgtccgtaccgggtacccgggcccgtacggcctagtcggacgtaagggacgggtaactacgttaacgtcgtaacggtcggagggtcggaggaactacgccgtaactacgtgaccgttggtaccggtcgggaacgggacgtacgacgggcctaccggtcgtacgggaccaccggtaccgcggtcccgttacccggccccgttcgttaacccgtccgttcccggttaccccctccccttaacccctccggttcccgtaacgg

SEQ ID NO: 95805 - DNA, 882 bp, Homo sapiens
  misc_feature: GYAE6OF01D7UFF.4.28.C06.1.454.CMB.1.raw
tcagagcactgtagcacgaccggtgctcgatttagagctcacgtattggggtttgggggggcctcaggaagcagcatcgggaggtgcctcagccatggcatggatccctctcttcctcggcgtccttgcttactgcacgaggactccggggcctcctatcaactgacctcaacccaccctcactcgtcccgtctctccgaggacggacacgccgtcactccacctgctctgacgaaacgtacggttgggggaagagtaagttagttcgtttccgttaggtacttccgtaccgaaggaccggaccgacggtccctacccttaccccttacttaccgtagtactattagtaacctaacgaaaaccgtaccggaacggtcccgtccccgtaccgggtaccgggtcccgtggaccggtccgtttcttttccgacggtccttaccgtaacggttccgggtacgggaacctacgtaccggaccctaccgttcgtaccgtacccgtttccggtaccccggttcccgggggacccctaccgggtcctacggtacccggtaaggtaggggaacggggtaaacgttactttaacgttaccggttcggaccgggtaagggccgggttaacgggaaccgaaccggaccgtaaccgtaacgtccggaacgttaccgggttcccggttaccggggacgggtaaccggggaccggttacgggggtacccgtaccccgggttccgggtacggggtacccgtacccgggtaccccggtaaccgggtccccggttccccggtaccccccgggtttacggtcccccgttaacccggtttccccgttacccccggttacccccccctttacccgtttcccccggttaacccgttacccgggg

SEQ ID NO: 95806 - DNA, 726 bp, Homo sapiens
  misc_feature: GYAE6OF01BLNC0.4.28.C06.1.454.CMB.1.raw
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (272)..(272): a, c, t, g, unknown or other
  misc_feature (272)..(272): n is a, c, g, or t
  modified_base (335)..(335): a, c, t, g, unknown or other
  misc_feature (335)..(335): n is a, c, g, or t
tcagagcactgtagcacgaccggtgctcgatttagagctcacgtattggggtttgggggggcctcaggaagcagcatcggaggtgcctcagccatggcatggactccctcttcttccctcggcgtcctgtcttactgcacgaggcgtcccgggtcctcctatccaaactcgactaccaaccctaccctctactcgtcctctcctccgaggaccgactcgccgtcactccnccgtncctctaacgaacgtaacggtcggttaggggataagtnttagtttcgttccgtgttactcacgaggacgccgacgacccctaccttcccgttacttacgtnttctacgtagtttaacaccaaacggcgtacccggcccgtaccctcggtccgggtcctagtcgtccgtttcttacggccgtactaccgagttcggaacgggtaccacgtcacctcgttccgctacccttcccggtcccggacccgggcctccgctagttacggagtcgggagtaacttacgttacgtacggcggtaccggcggtcgggtaaccggcacccgtaacgacccggtagtcggtagttacccggttcgggtacggggacgggacggtaccgggtagggtcccgtacggttacggtgaaacccggccggtaaccgcgtcccgtccccggtcccgtcgtacctccccgttcccgttaccccgcccttaccccgttccgtccccgtcgg

SEQ ID NO: 95807 - DNA, 719 bp, Homo sapiens
  misc_feature: GYAE6OF01EVQ5B.4.28.C06.1.454.CMB.1.raw
  modified_base (243)..(243): a, c, t, g, unknown or other
  misc_feature (243)..(243): n is a, c, g, or t
  modified_base (446)..(446): a, c, t, g, unknown or other
  misc_feature (446)..(446): n is a, c, g, or t
tcagagcactgtagcacgaccggtgctcgatttagagctcacgtattgggtttgggggggcctcaggaagcagcatcggaggtgcctcagccatggcatggatccctctcttccgtcggcgtccttgcttactgcacaggatccgggcctcctatcaactgactcaaccaccctcactgtccgtctctccgaggacggacaggtccgtcagtcacctgactctagacgaacgcgttagggganagattagttcgttacgtggtactcgtccgagtacggccgacgcctacctccctagttacagtctagtctatacctaacgtacgacgccgaccctggacgggtccagcgtcgtctttcgcgtactaccgtagtcgtacggacagacgtccagtcgtacgcttccgtccggccgggacccgtgacctacgtcagtagggaacggngttaaccttgttaacgtcggtacgtacgggcggtcggaacgtacgaccgtaacgtacgacgttacggtaccgggtttccgaccgggggtacggtaaccggggtaccgggtacgggacccggtacccggttccggggttcggaacccggtacccgtaacccgggtacggttccccgtacccggaccccccggtttagggtacccctttaacggttcccccgttttacccctaacccccccgggtccctttacccccggttacccgttaacccgg

SEQ ID NO: 95808 - DNA, 805 bp, Homo sapiens
  misc_feature: GYAE6OF01C21T5.4.28.C06.1.454.CMB.1.raw
  modified_base (435)..(435): a, c, t, g, unknown or other
  misc_feature (435)..(435): n is a, c, g, or t
  modified_base (788)..(788): a, c, t, g, unknown or other
  misc_feature (788)..(788): n is a, c, g, or t
tcagagcactgtagcacgaccggtgctcgatttagagctcacgtattggggtttgggggggcctcaggaagcagcatcggaggtgcctcagccatggcatggactccctctcttcctcggcgtccttgcttactgcacgaggacgtcccggggccttcctatacaactgacctacaacccaccctcactcgtccgtcctctaccgaggaccggacacgcccgtacactccaccgtcgtcctcgacggactaaacggtacggttagggggagagtacgtacgttacggtttccgtaggttacttccgtaccggaacggacggacccgaccgtaccctaccttaccccgttactttacggtacgttacctacgttacgttaaccaacgtaaaccgttaaccggaaccgcccggtcccgtagggtaccgggttacccngaccggtccgtttccgtttacgtccggtaccttaccggtaaggttaccgggtacgggaaccaaccgtcgtacccgtacgttcgtacgtaccttccggtcccggtccccgggtaccacgggtaccgtaacgtccgggtaacgttaacgggaaggttaccgttaacgttaacggttcgttacggaccgggagggtacgggacggtacacggtacaaccgtacgcggtacgttaccggaggttccgggaaccgggtcggaaccggttgggtaccggtccgttacggacgggtaccaccgggtcctaacgggccgttaccccgccggttacacgttcccttacccgcccggttcccncccggtcctcgttaacg

SEQ ID NO: 95809 - DNA, 128 bp, Homo sapiens
  misc_feature: GYAE6OF02HAV1O.4.28.C06.1.454.CMB.1.raw
  modified_base (128)..(128): a, c, t, g, unknown or other
  misc_feature (128)..(128): n is a, c, g, or t
tcagagcactgtagcacgaccggtgctcgatttagagctcacgtattgggtttggcacagcggccctgggctgcctggtcaaggactacttccctacagtgctctgagcggctggcaaggcgcatagn

SEQ ID NO: 95810 - DNA, 130 bp, Homo sapiens; identical to SEQ ID NO: 95754
  misc_feature: GYAE6OF02H7NE5.4.28.C06.1.454.CMB.1.raw
  modified_base (130)..(130): a, c, t, g, unknown or other
  misc_feature (130)..(130): n is a, c, g, or t

SEQ ID NO: 95811 - DNA, 129 bp, Homo sapiens; identical to SEQ ID NO: 95755
  misc_feature: GYAE6OF02IPDEW.4.28.C06.1.454.CMB.1.raw

SEQ ID NO: 95812 - DNA, 130 bp, Homo sapiens; identical to SEQ ID NO: 95754
  misc_feature: GYAE6OF02HRA71.4.28.C06.1.454.CMB.1.raw
  modified_base (130)..(130): a, c, t, g, unknown or other
  misc_feature (130)..(130): n is a, c, g, or t

SEQ ID NO: 95813 - DNA, 532 bp, Homo sapiens
  misc_feature: GYAE6OF02GUJ2O.4.28.C06.1.454.CMB.1.raw
tcagagcactgtagcacgaccggtgctcgatttagagctcacgtattgggtttgggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttgggggagagatatgtttcctggtatctccagaggccaggccactcccctattctagtcatgtatcaaactacgaagcgcccctcaggggtccctgagcgctttctggctccaagtctggggacacagccactctgactctctccgggccaggccatcgatgagggagactattactgtcaggcgtgggacagcacaactgcagtcgttcggcggagggaccgagggtgaccgtccgtgggtccaggcccgaagggcctcggcccccttcggcaccgtcgtcgttccccgccctcccctactccgg

SEQ ID NO: 95814 - DNA, 536 bp, Homo sapiens
  misc_feature: GYAE6OF02GGUVP.4.28.C06.1.454.CMB.1.raw
  modified_base (234)..(234): a, c, t, g, unknown or other
  misc_feature (234)..(234): n is a, c, g, or t
tcagagcactgtagcacgaccggtgctcgatttagagctcacgtattgggtttgggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttggggganagatatgtttcctggtatctccagaggccaggccactcccctattctagtcatgtatcaaactacgaagcgcccctcaggggtccctgagcgctttctggctcaagtctggggacacagccactctgactctctccgggcccaggccatcgatgagggagactattactgtcaggcgtgggacagcacaactgcagtcgtcggcggagggaccgagggtcgaccgtccgtgggtccacggcccgaaggccgtcggcccccgtcggtccactccgttccgttccccgccctccctccctaccg

SEQ ID NO: 95815 - DNA, 555 bp, Homo sapiens
  misc_feature: GYAE6OF02JAV38.4.28.C06.1.454.CMB.1.raw
  modified_base (465)..(465): a, c, t, g, unknown or other
  misc_feature (465)..(465): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttgggggagagatatgtttcctggtatctccagaggccaggccactcccctattctagtcatgtatcaaactacgaagccgcccctcgacggggtccctgacgcgcttttctggctccgaagtctggggacacagccactctgactctcgtccggggcccaggccatcgatggagggagactattactgtacagggcgtgggacagcacaactgacagtcgttcggcggagggaccgngggtcgaccggtcgtgggtcacggcccgaagggcctcggcccccgttcggtccaccgttccgttccgttccccgcccttccctcctaccg

SEQ ID NO: 95816 - DNA, 537 bp, Homo sapiens
  misc_feature: GYAE6OF02FGCQ2.4.28.C06.1.454.CMB.1.raw
  modified_base (334)..(334): a, c, t, g, unknown or other
  misc_feature (334)..(334): n is a, c, g, or t
tcagagcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttgggggagagatatgtttcctggtatctccagaggccaggccactcccctattctagtcatgtatcaaactacgaagcgccctcacggggtccctgagcgcttttcnggctcaagtctggggacacagccactctgactctctccggggcccaggccatcgatgagggagactattactgtcaggcgtgggacagcacaactgcagtcgttcggcggagggaccgagggtcgaccgttccgtgggtcacggcccgaagggcctcggcccccttcggtccaccgtcctcgttccccaccctccctccctac

SEQ ID NO: 95817 - DNA, 550 bp, Homo sapiens
  misc_feature: GYAE6OF02HDLRG.4.28.C06.1.454.CMB.1.raw
  modified_base (234)..(234): a, c, t, g, unknown or other
  misc_feature (234)..(234): n is a, c, g, or t
tcagagcactgtagcacgaccggtgctcgatttagagctcacgtattgggtttgggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttggggganagatatgtttcctggtatctccagaggccaggtcactcccctattctagtcatgtatcaaactacgaagcgcccctcaggggtccctgagcgcttttctggctccaagtctggggacacagccactctgactctctccggggcccaggccatcgatgagggagactattactgtcaggcgtgggactagcacaactgcagtcttcgggcggtagggaccgaggggtcgaccggttccgtggggtccaggtccccgaaaggccgtacggcccccgtcgggtccaccgttcgtccgttcccctaccctcctccctacg

SEQ ID NO: 95818 - DNA, 527 bp, Homo sapiens
  misc_feature: GYAE6OF02INNVV.4.28.C06.1.454.CMB.1.raw
  modified_base (235)..(235): a, c, t, g, unknown or other
  misc_feature (235)..(235): n is a, c, g, or t
tcagagcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttggggganagatatgtttcctggtatctccagaggccaggccactccccctattctagtcatgtatcaaactacgaagcgcccctcaggggtccctgagcgcttttctggctccaagtctggggacacagccactctgactctctccggggcccaggccatcgatgagggagactattactgtcaggcgtgggacagcacaactgcagtcttcggcggagggacccagggtcgaccgtcctgggtccaggcccgaaggctggccccctggtccacgtctcgttcccaccctcctcctacg

SEQ ID NO: 95819 - DNA, 579 bp, Homo sapiens
  misc_feature: GYAE6OF02I30UQ.4.28.C06.1.454.CMB.1.raw
  modified_base (237)..(237): a, c, t, g, unknown or other
  misc_feature (237)..(237): n is a, c, g, or t
  modified_base (343)..(343): a, c, t, g, unknown or other
  misc_feature (343)..(343): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttggggganagatatgtttcctggtatctccagaggccaggccactcccctattctagtcatgtatacaaactacgaacgccgcccctcgacggggtccctgacgcgtcttttcnggcctccaagtcgtggggacacgacgccactctgacctccgtccgtcccggggcccacggccagtcgagtggaagggactactattacgtgtcagggtcggtggacagacacaactgcagtcgtcgggcggagggaccgagggtcgaccgtcgtcgggtcacggacccgaacgggcctccggcccccgtcggtcctaccgttccgttccgttcccccacccgttccctccgtaacg

SEQ ID NO: 95820 - DNA, 551 bp, Homo sapiens
  misc_feature: GYAE6OF02H141S.4.28.C06.1.454.CMB.1.raw
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttgggggagagatatgtttcctggtatctccagaggccaggccactcccctattctagtcatgtatcaaactacgaagcgcccctcaggggtccctgagcgctttctggctccaagtctgggacacagccactctgactctctccggggcccaggccatcgatggaggganctatacngtcaggcgtggacagcacaacgtgacagtcgttcggcggagggtaccgagggtcgaccgtcgtcgggtcaggcccgaaagggcctcggtcccccgttcggtccctacgtccgttccgttcccccgtccccttccctccgtaaccg

SEQ ID NO: 95821 - DNA, 543 bp, Homo sapiens
  misc_feature: GYAE6OF02HNO92.4.28.C06.1.454.CMB.1.raw
  modified_base (236)..(236): a, c, t, g, unknown or other
  misc_feature (236)..(236): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttggggganagatatgtttcctggtatctcagagccaggccactcccctattctagtcatgtatcaaactacgaagcgcccctcgacggggtccctgagcgtctttctcggctccaagtctggggacacagccactctcgactcgtccgtccgggcccacggccatcgagtggagggagactagttactgtcgaggcggtgggacagcaacactgcagtcgtcggcgggagggccgagggtcgaccgtccgtggtcacgcccgaaggcctccgccccgttcgccacctccgtccgttcccaccctccctcctaccg

SEQ ID NO: 95822 - DNA, 648 bp, Homo sapiens
  misc_feature: GYAE6OF02G5VN4.4.28.C06.1.454.CMB.1.raw
  modified_base (335)..(335): a, c, t, g, unknown or other
  misc_feature (335)..(335): n is a, c, g, or t
  modified_base (364)..(364): a, c, t, g, unknown or other
  misc_feature (364)..(364): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgcgttggggagagatatgtttcctggtatctccagaggccaggccactcccctattctagtcatgtatcaaactacgaagccgcccctgacggggtccctgagcgctttcnggctccaagtcgtgggacacgagccatcngactctccgtccgggcccacggccagtccgagtcggagggtacgactattacgtcgtacgagggtcggtgggaactaggccaacgaactcggacgtacggttccgttaccggggacgggacggggaaccgtaacgggggtccgtaaccgggttcccgttacggggtccgtaacgggaccccggaaacgggcccttacccgggtcccccccgttacgggtcccgtaacccgttccgtttacccggttaccccccgtacccccgtttcccctacccgttaacccgg

SEQ ID NO: 95823 - DNA, 596 bp, Homo sapiens
  misc_feature: GYAE6OF02I3HZ1.4.28.C06.1.454.CMB.1.raw
  modified_base (236)..(236): a, c, t, g, unknown or other
  misc_feature (236)..(236): n is a, c, g, or t
  modified_base (341)..(341): a, c, t, g, unknown or other
  misc_feature (341)..(341): n is a, c, g, or t
tcagagcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttggggganagatatgtttcctggtatctccagaggccaggccactcccctattctagtcatgtatacaaactacgaacgccgccctcgacggggtccctgacgcgtcttttcnggctccaagtcgtagggacacgacgccactctgacctcgtccgtccggggcccaggccagtcgagtggacgggagactacttactcgtcaggcgtgggacagacacgaacgtcgactacgttcgtcgggacggacgggacccgaggggtcgacccggtccgtcgggtccgacggcccgaacgggtccgtccggtcccccgttcggtaccgtaccgttccgttaccgttacccccacccgttcccgtaccctaccg

SEQ ID NO: 95824 - DNA, 566 bp, Homo sapiens
  misc_feature: GYAE6OF02JH3NL.4.28.C06.1.454.CMB.1.raw
  modified_base (235)..(235): a, c, t, g, unknown or other
  misc_feature (235)..(235): n is a, c, g, or t
  modified_base (238)..(238): a, c, t, g, unknown or other
  misc_feature (238)..(238): n is a, c, g, or t
  modified_base (340)..(340): a, c, t, g, unknown or other
  misc_feature (340)..(340): n is a, c, g, or t
tcagagcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttggggganagntatgtttcctggtatctccagaggccaggccactcccctattctagtcatgtatcaaactacgaagccgcccctcgacggggtccctggacgcgtcttttcnggctccgaagtcgtggggacacagccactctgacctctccgtccggggcccaggcccagtccgagtggacgggagtactattacgtgtacgagggtcgtgggacagcaacaactgcagtcgttcgggcgggacgggaccgagggtcgaccggtccgtcgggtcacggccgaagggcctcggccccgtcggtccacgttcgtccgttcccgcccttcctccgtaccg

SEQ ID NO: 95825 - DNA, 564 bp, Homo sapiens
  misc_feature: GYAE6OF02HQQBX.4.28.C06.1.454.CMB.1.raw
  modified_base (237)..(237): a, c, t, g, unknown or other
  misc_feature (237)..(237): n is a, c, g, or t
  modified_base (344)..(344): a, c, t, g, unknown or other
  misc_feature (344)..(344): n is a, c, g, or t
  modified_base (413)..(413): a, c, t, g, unknown or other
  misc_feature (413)..(413): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttggggganagatatgtttcctggtatctccagaggccaggccactcccctattctagtcatgtatcaaaactacgaaagccgcccctcgacggggtccctggacgcgtcttttcnggctccaagtcgtggggacacacgccactctgactctccgtccgggcccaggccagtcgatggaggganactattctgtcgaggcgtgggacagcacactgacagtcgtcggcggaggaccgagggtcgaccgtcgtcgggtcacggacccgaaggcctccggcccccgttcggtcctaccgtccgttccgttccccctacccttccctaccgttaaccg

SEQ ID NO: 95826 - DNA, 637 bp, Homo sapiens
  misc_feature: GYAE6OF02JR8ZP.4.28.C06.1.454.CMB.1.raw
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
  modified_base (314)..(314): a, c, t, g, unknown or other
  misc_feature (314)..(314): n is a, c, g, or t
  modified_base (332)..(332): a, c, t, g, unknown or other
  misc_feature (332)..(332): n is a, c, g, or t
  modified_base (349)..(349): a, c, t, g, unknown or other
  misc_feature (349)..(349): n is a, c, g, or t
tcagagcactgtagcacgaccggtgctcgatttagagctcacgtattggggtttgggggggcctcaggaagcagcatcgggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgacgttggggganagatagtgtttccnggtatctccagacggccaggccactcccctattcagtcatgtatacaaactacgaagccncccctagacggggtcccngacgtccgtcttttcgnggtcctccgaaggttcggtgggacctacacgcctactcgtgtaccgtcctccggtcccggggccacggcccagtaccgagtacgggagggacgtacttacgttacgtgacgtagggcggtgggacaggaccaacgtaaccgtgaccgtagttccggtcgggacgggaacgggaccgagggtccgaaccggtcgtcggaccacggacccgaacgggtcctcccggtccccgtcggtacccaccggtttacctcccggttaccccctacccgttcccgtacccgtaccgg

SEQ ID NO: 95827 - DNA, 637 bp, Homo sapiens
  misc_feature: GYAE6OF02J0LMR.4.28.C06.1.454.CMB.1.raw
  modified_base (236)..(236): a, c, t, g, unknown or other
  misc_feature (236)..(236): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgcgttgggganagatatgttcctggtatctccagacgccaggccactccctattctagtcatgtatcaaactacgaacgccgccctgacgggtcccagacgtcgtcttttcgcggcctccgaagtccgtaggggaccagacgtccactctcgactccgtaccgtccggggaccacggccagtaccgagtaggaggtaacgtacttacttacgtcgtacgaggtcgtagggactacgacaacgaacgtgaccgtagttcgtaccgggtacgggacggtaccgtacgggtcgacccggttcggttacgggaccgacggacccggtaacggtcccgtaccggtcccccggttacggttaccctaccgtttccggttacccggttcccctaccccgttcccgtacccgttaaccgg

SEQ ID NO: 95828 - DNA, 575 bp, Homo sapiens
  misc_feature: GYAE6OF02HIGHT.4.28.C06.1.454.CMB.1.raw
  modified_base (341)..(341): a, c, t, g, unknown or other
  misc_feature (341)..(341): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacgacagccgtcatcacctgctctgcaaacgacgttgggggagagatatgtttcctggtatctccagaggccaggccactcccctattctagtcatgtatcaaactacgaagccgcccctgacggggtccctggacgcgtcttttcgnggcctccgaagtcgtggggaccacgacgcctactctcgaccttcctccggtcccggggacccaggcccagtccgagtaggagggagacttattactgtcaggtcgtggacagcacactgcaggtcgtcgggcggacgggaccgagggtcgaccgtcgtgggtcgacgcccgaaggcctaccggcccccgttcggtccaccttccgtccgttccccctacccgtccctcctaccg

SEQ ID NO: 95829 - DNA, 578 bp, Homo sapiens
  misc_feature: GYAE6OF02H380D.4.28.C06.1.454.CMB.1.raw
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttgggggagagatatgtttcctggtatctccagaggccaggccactcccctattctagtcatgtatcaaactacgaagccgcccctcgacggggtccctggacgcgtcttttcgtggcctccgaagtcgtggggacacacgccactctgacctcgtcgccggggcccaggccatcgagtggaggganacgtattactgtacgnggcggtgggacagcacaactcgactagtcgtcgggcggacgggaccgaggggtcgaccggtccgtgggtccgacgacccgaaggccgtccgcccccgttcggtaccgtaccttccgtccgttcccccgtcccgttccctccgtaccg

SEQ ID NO: 95830 - DNA, 508 bp, Homo sapiens
  misc_feature: GYAE6OF02IZF5P.4.28.C06.1.454.CMB.1.raw
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (304)..(304): a, c, t, g, unknown or other
  misc_feature (304)..(304): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (451)..(451): a, c, t, g, unknown or other
  misc_feature (451)..(451): n is a, c, g, or t
  modified_base (475)..(475): a, c, t, g, unknown or other
  misc_feature (475)..(475): n is a, c, g, or t
  modified_base (487)..(487): a, c, t, g, unknown or other
  misc_feature (487)..(487): n is a, c, g, or t
  modified_base (503)..(503): a, c, t, g, unknown or other
  misc_feature (503)..(503): n is a, c, g, or t
tcagagcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaaacgcttggggganagatatgtttccnggtatctccagaggccaggccactcccctattcagtcatgtatcaaaactacgaancgcccctcaaggggtccctgagcgcttttctggctccaagtctggggacacagccaactctgactctctccgggccaggcatcgatgaggngcattacntcaggctgggacagcactaatcgcagtcttcggcgagggccaagggtnaccgtcctgggcagcccgaaggcngccctcggcacnctcttcccgaccttcncctac

SEQ ID NO: 95831 - DNA, 541 bp, Homo sapiens
  misc_feature: GYAE6OF02HCPCE.4.28.C06.1.454.CMB.1.raw
  modified_base (235)..(235): a, c, t, g, unknown or other
  misc_feature (235)..(235): n is a, c, g, or t
tcagagcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttggggganagatatgtttcctggtatctccagaggccaggccactcccctattctagtcatgtatcaaactacgaagcgcccctcaggggtccctgagcgcttttctggctccaagtctggggacacagccactctgactctctccggggcccaggccatcgatgagggagactattactgtcaggcgtgggacagcacactgcagtcttcgggcggagggaccagggtcgaccgtccgtgggtccaggcccgaaggcctcggccccccgttcggtcacgtttccgtcgttcccccacccttccctccctaccg

SEQ ID NO: 95832 - DNA, 784 bp, Homo sapiens
  misc_feature: GYAE6OF02I167B.4.28.C06.1.454.CMB.1.raw
  modified_base (236)..(236): a, c, t, g, unknown or other
  misc_feature (236)..(236): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttgggganagatatgtttacctggtatctcagagccaggccactcccctattctagtcatgtatacaaactacgaacgccgccctcgacgggtccctgacgtcgtacttttcgcggtctaccgaagtccgtacggggacacgacgcctaacgtctgaccttccgtccgtcccggggtacccacgggccctaagtcccggtaagttcgggaacggggtacgtaacgtttaacgtttacgtacggttacggtaacggggtccggttaacggggaacccgaacggtaccgaaaccgtaaccggttacggaccgttacgggttacccggtttaccggggaccggggtaacggggaacccggtaacgggggttaccgtaccccgggttaccgggttacggggtaccgaacccgggtaccccggtaaaccggggtcccgtttaaccccggggtccccccccggtttacgggttacccccgtaacccggtttaccccggtttcccgggtttaccccccccgggtccccccgtttacccccggtttacccccgttaaacccggg

SEQ ID NO: 95833 - DNA, 565 bp, Homo sapiens
  misc_feature: GYAE6OF02F4N0J.4.28.C06.1.454.CMB.1.raw
  modified_base (173)..(173): a, c, t, g, unknown or other
  misc_feature (173)..(173): n is a, c, g, or t
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
tcagagcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccacctnactgtccgtctctccaggacggacagccgtcatcacctgctctgcaaacgcttggggganagatatgtttccnggtatctccagaggccaggccactcccctattctagtcaatgtatcaaactacgaacgccgcccctgacggggtccctgacgcgtcttttcgcggcctcgaagtccgtggggaccacacgcctactctcgacctctcgtcccggggccaggccagtcgatggaggganactattacgtgtcgnggcgtgggacngcactacgngacacgtcgtcggcgggtacggccgaggtcgacggtccgtggtcacgccgaaggcctaccggcccccgtggtccaccgttccgtccgttaccctaccccgttccctacccgtaccg

SEQ ID NO: 95834 - DNA, 593 bp, Homo sapiens
  misc_feature: GYAE6OF02FLFZ9.4.28.C06.1.454.CMB.1.raw
  modified_base (239)..(239): a, c, t, g, unknown or other
  misc_feature (239)..(239): n is a, c, g, or t
  modified_base (352)..(352): a, c, t, g, unknown or other
  misc_feature (352)..(352): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgaccaaacgacgttggggganagatatgtttcctggtatctccagacggccaggccacctcccctattctagtcatgtatacaaaactacgaacgccgcccctcgacgggggtccctggacgccgtcttttcgnggtcctaccgaagtcgtgggacacgacgcctactctcgactccgtccgtcccgggccacggccagtcgagtggaggacgtacttacgttacgtgtcgaggtcgtaggacagcacactcgcacggttccgtcgggacgggtacgggaccgtagggtcgaccggtccgtacgggcacggacccgaaggcctccggtccccgtcggtcctacgtccgttccgtcccctacccgttcctcctacg

SEQ ID NO: 95835 - DNA, 644 bp, Homo sapiens
  misc_feature: GYAE6OF02HY0VW.4.28.C06.1.454.CMB.1.raw
  modified_base (263)..(263): a, c, t, g, unknown or other
  misc_feature (263)..(263): n is a, c, g, or t
  modified_base (344)..(344): a, c, t, g, unknown or other
  misc_feature (344)..(344): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttgggggagagatagtgtttcctggtatctccagnggccaggccactccctattctagtcatgtatacaaactacgaagccgcccctcgacggggtccctgacgccgtcttttcgnggtctaccgaagtcgtcggggacacagcccactctgactctccgtcccggggcccaggccatcgagtaggagggtacgacttacgttacgtggtacgagggtcggtacgggtacgacgacaacaacgtcgacgtacgtccgttacggggacgggtaacgggaccgtaggggtcgaacccggttccgtcgggtaccgaccggacccggaacggccgttacccggaccccccgttcgggtaccctaccgttcccgttcccggttacccccgtaccccctttccccgtacccgttaaccccgg

SEQ ID NO: 95836 - DNA, 672 bp, Homo sapiens
  misc_feature: GYAE6OF02G72HA.4.28.C06.1.454.CMB.1.raw
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (305)..(305): a, c, t, g, unknown or other
  misc_feature (305)..(305): n is a, c, g, or t
  modified_base (341)..(341): a, c, t, g, unknown or other
  misc_feature (341)..(341): n is a, c, g, or t
tcagagcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggacgacagccgtcatcacctgctctgcaaacgacttggggganagatatgtttccnggtatctcagacgccaggccactcccctattctagtcatgtatcaaactacgacgccncccctgacggggtccctggagtccggtacttttcgnggctccgtaaagtcgttacggggacacgtacgcctactccgtgtaccttccgtcccgtcccgggggcccaacgggtcccaagtccgaagtcggaaggggacgtaacgttacttaacgtcggtaccgtagggccggttaggggaaccaggccaaccgtaactcggaccgtaacggttcccgtttacggggaccggtaacggggacccgtacggggttacggtacccggttccgttacggggtacctaacggacccggtaaacggtcccgtaccggcccccgttacggaccctacgtccgttaccgttccccgtaccctcccgtaccctaccg

SEQ ID NO: 95837 - DNA, 594 bp, Homo sapiens
  misc_feature: GYAE6OF02F6XAR.4.28.C06.1.454.CMB.1.raw
  modified_base (239)..(239): a, c, t, g, unknown or other
  misc_feature (239)..(239): n is a, c, g, or t
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgacgttggggganagatatgtttcctggtatctccagagccaggccactcccctattctagtcatgtatacaaactacgaaagcgcccctcgacggggtccctgacgcgtcttttctggctccaagtcgtggggacacgacgccactctgactctcgtcccggggcccaggccagtcgatcggagggagtactaattacgtgtcgacgggcggtcgggacaggaccacgaaacgtcgctaacggttcgttaccgggcgggacgggaccgaggggtcgaaccgtcgtacgggtcgacgtaccggaacggccgtccgtcccccgtcggtccacgtccgtccgttaccccggcccctcccgtccgtaccgg

SEQ ID NO: 95838 - DNA, 741 bp, Homo sapiens
  misc_feature: GYAE6OF02HCPTL.4.28.C06.1.454.CMB.1.raw
  modified_base (237)..(237): a, c, t, g, unknown or other
  misc_feature (237)..(237): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccgggcctcctatcaactgactcaaccaccctcactgtccgtctctccaggacgacagccgtcatcacctgctctgacaaacgacggttggggganagtatattgtttcctggtactcctacgaggacgccgacggccctacctccctattctacgtctatgtatacaaactacgaacgccgcccctcggacgggtccctggacgtccgttcttttcgcggtacctccgaagtccggtaggggaccacgacgcctaactcgtacgtacctccgtaccggtcccggggcccgacgaccgtaacgtccggtaaggtacgggtaacgggaacgtaaccgttacgttaaccggtcggtaacggtacgggacgggttacgggaacgtaacggaccgtaaccgtaacggtcggtaccgtaacgggttcccggttacggggaccggggtaacgggtacccggtacggggtaccgtaaccgggtcgggttaccgggtacgaccggtacccggtaacgggtcccgtcccggtacccccgttcggttacccgtacccgtttcccgttccccggttacccccgtccccttaccccgttacccgttacccgg

SEQ ID NO: 95839 - DNA, 736 bp, Homo sapiens
  misc_feature: GYAE6OF02HMM96.4.28.C06.1.454.CMB.1.raw
  modified_base (301)..(301): a, c, t, g, unknown or other
  misc_feature (301)..(301): n is a, c, g, or t
  modified_base (449)..(449): a, c, t, g, unknown or other
  misc_feature (449)..(449): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactcgtccgtctctccaggacggacacgccgtcactcacctgctctgacaaacgtacgttgggggagagatattcgttccgtggtatcctcaggagccgacggccacctccctattctagtctatntatacaaactacgaacgcccgccctccgtacgggtccctgacgtccgttcgttttcgtcggtcctaccgtaacggttcgtacggggaccacgacgccacttcgtacgtaccttccgtacccggtcccggggaccccgacgggtacccncggtaccggaggtacggaacgggtactacgttaacttacgtggtacgaggggtcggtgggaaccgtagtaccaaccgtacgtacgacgtacggttaccggtcggggcggtaaccggggaccggtacggggtaccggtcccggttaccggtcgggtacccgtaaccggacccggtaaccgggtcccggttaccccggtaccccccggtaccggttacccgtaccccgtttcccggttaccccggttccccccggtacccccgtttccccttacccccgtttaaccggg

SEQ ID NO: 95840 - DNA, 706 bp, Homo sapiens
  misc_feature: GYAE6OF02F3MUA.4.28.C06.1.454.CMB.1.raw
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgacgttgggggagagatatgtttcctggtatctccagaggccaggccacctcccctattctagtcatgtatacaaactacgaacgccgcccctcgacggggtccctaggacgccgttcttttcgcggtcctccgaaggtccgtggggtaccacgacgcctactctacgtacctcgtccggtccccggggaccacgggcctagtccgagtcgggaagggtactacttacgttacgtcggtacgagggtcggtaggggaaccaggaccaaacgaacgtcggaccgtacggttccgttacgggggacgggaacgggggtaccgtaagggggtacccgtaccgggttccgtacggggtaccaaccgggtacccggaaacggtcccggttaccccgggtccccccggttacgggttaccccgtaccggtttcccggtttaccccggttccccccgtacccccgtttcccgttaccccgttaaccgg

SEQ ID NO: 95841 - DNA, 743 bp, Homo sapiens
  misc_feature: GYAE6OF02GALOE.4.28.C06.1.454.CMB.1.raw
  modified_base (229)..(229): a, c, t, g, unknown or other
  misc_feature (229)..(229): n is a, c, g, or t
  modified_base (341)..(341): a, c, t, g, unknown or other
  misc_feature (341)..(341): n is a, c, g, or t
tcagagcactgtagcacgaccggtgctcgatttagagctcacgtattgggtttggggggcctcaggaagcagcatcggaggtgcctcagccatggcatggatccctctcttcctcggcgtccttgcttactgcacaggatccgggctcctatcaactgactcaaccaccctcactgtccgtctctccaggacggacagccgtcatcacctgctctgcaacgctgggganagatatgtttcctggtatctccagacggccaggcccactcccctattctagtcatgtatcaaaactacgaacgccgacccctcgacggggtccccaggacgcgtcttttacncgggcctaccgaagttccgtggggaccacacgcccactcgtcgacctcgtccgtacccggggcccagggtcccagtcgacgtaggaacggggactaaccgttaagttaaccgttggtaccgacgggtaccggtttacggggaacctacgggacctaaccgtaaccgttacggaccgtaacggtttccgtttaccggggacccggggtaacggggtaccccgggtaaacggggttaccggtaccccgggttacccggttaccgggggttacccgacccgggtacccccgtaaacggggtccccgttccccggtaccccccccggttacgggtaccccgttacccgttcccggttccccggtttaccccccggccccccgtttacccgtccccgtttaacccgg

SEQ ID NO: 95842 - DNA, 620 bp, Homo sapiens
  misc_feature: GYAE6OF02GNBP9.4.28.C06.1.454.CMB.1.raw
  modified_base (349)..(349): a, c, t, g, unknown or other
  misc_feature (349)..(349): n is a, c, g, or t
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgacgttgggggagagatatgtttcctggtatctccaggaggccaggccacctcccctatttcagtcatgtactcaaactacgaagccgcccctcgacggggtccctggacgccgtcttttcgnggtcctccgaagtcgtggggacacacgcctactctagacctctccggtcccggggcccaggcccatcgagtggagggactaacgtattacgtgtccgagggtcggtgggaccaggccaacactgccagttcgtacgggcgggagggaccgaggggtcgacccgggttcgtcgggacgtacgcccgtaagggcccgtccggcccccgttcggtaccgtacccgttccgttcccggttacccccgcccccgtttcccgtaccccgttaaccgg

SEQ ID NO: 95843 - DNA, 707 bp, Homo sapiens
  misc_feature: GYAE6OF02JH8Z0.4.28.C06.1.454.CMB.1.raw
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (336)..(336): a, c, t, g, unknown or other
  misc_feature (336)..(336): n is a, c, g, or t
  modified_base (366)..(366): a, c, t, g, unknown or other
  misc_feature (366)..(366): n is a, c, g, or t
tcagagcactgtagcacgaccggtgctcgatttagagctcacgtattgggtttgggggggccgtcgaggaagcagcatcggaggtgcctcagccatggcatggatccctctcttcctcggcgtccttgcttactgcacaggatccggggctcctatcaactgactcaaccaccctcactgtccgtctctccaggacggacagccgtcatccacctgctctgcaaacgcgttggggganagatatgtttccngtntctcagnggccngccacctccctattctagtcatgtatacaactacgaacgccgcccctcgacgggtcctgacgctctttcngctaccgagtcgtaggggactacgacgccncgtactcgtaccttccgtacccgtcccggggacccacgggtacccgaagttccgaacggttggaacggggtaccgttaagtaacgttaaccgttggtaccgtacggggtcggttaacggggaacctacggaccgaaccgtaaccgtcggtaccgttaacggtccgggtttacggggacggggaacggggtacccgaaacgggggttccggttaacccgggtacgttaccgggtccgaacggtccccggtacgggaccgttcccgggaccccccgttcggttacccgtacccgtttcccgttacccggttaccccgtcccccttacccgttccctaacccgg

SEQ ID NO: 95844 - DNA, 772 bp, Homo sapiens
  misc_feature: GYAE6OF02HAV36.4.28.C06.1.454.CMB.1.raw
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgacgttgggggagagatatgttcctggtatctaccgagaggccacggccacctcccctattcctagtcattgtactacaaaacctaacggaacgccgtacccctccggaacggggtcccctggacgtccgtccgttttcgtcgggcctacccgtaagttccggtcggggaaccaacgacgaccctaccttcgtacgaaccttccgttacccggtccccggggggtccccctagggaccccgtaacgtaccgggtaacgttacggggaaacggggtaacgttaccttaaactttaccggtacggttacggaaacggggtccgggttacggggaacacggtaaccgaaaccgtaacgttcgaccgtacggtttccggttaccggggacgggaacggggtaccgtacgggggttacggacccgggttcccggtacgggtaccgaccggtaaccccggaagggtaccccgtccggtaccccccggttcggtcccgtaaccgttcccgttcccggtttacccccgtccccctttcccgtccccgttaaccgg

SEQ ID NO: 95845 - DNA, 610 bp, Homo sapiens
  misc_feature: GYAE6OF02H4EW6.4.28.C06.1.454.CMB.1.raw
  modified_base (311)..(311): a, c, t, g, unknown or other
  misc_feature (311)..(311): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttgggggagagatatgtttctgtatctcagaggccaggccactcccctattctagtcatgtatcaaactacgaacgcgccccncgacggggtccctggagcgtccgttttcgtggtcctccgaacgtcgtaggggtacacgacgccactctgtacctcgtcgtcccggggacccacgggccactcggagtacggacgggaagtacttataccgtggtcgtagggccggttgggaacacgacaacgaacgtcgacgacggttcgtcgggcggacgggaccgtaggggtcgaaccgtcgtagggcgacggtaccgaaggtccgccgtccccgtaccggtccacccgttcgttcccgttaccccctcccgttccctccctaaccg

SEQ ID NO: 95846 - DNA, 573 bp, Homo sapiens
  misc_feature: GYAE6OF02G4CA6.4.28.C06.1.454.CMB.1.raw
  modified_base (238)..(238): a, c, t, g, unknown or other
  misc_feature (238)..(238): n is a, c, g, or t
  modified_base (351)..(351): a, c, t, g, unknown or other
  misc_feature (351)..(351): n is a, c, g, or t
  modified_base (431)..(431): a, c, t, g, unknown or other
  misc_feature (431)..(431): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacgttgggggaanagatatgtttcctggtatctccagacggccaggccacctcccctattctagtcatgtactacaaaactacgaacgccgcccctcgacggggtccctggacgtcgtcttttcgnggtcctccgtaagtcgtacggggacacgacgcctactctcgactcgtccgtcccggggaccaggccagtcgatggagganactattacgtgtcgaggcgtaggacagcacactgacagtcgtcggcggacgggacagggtcgaccgtcgtcgggcacgcccgaaggcctaccgccccgtcggtaccacgttccgtccgttaccccacccttccgtacctacg

SEQ ID NO: 95847 - DNA, 607 bp, Homo sapiens
  misc_feature: GYAE6OF02IE4G0.4.28.C06.1.454.CMB.1.raw
  modified_base (235)..(235): a, c, t, g, unknown or other
  misc_feature (235)..(235): n is a, c, g, or t
  modified_base (341)..(341): a, c, t, g, unknown or other
  misc_feature (341)..(341): n is a, c, g, or t
  modified_base (430)..(430): a, c, t, g, unknown or other
  misc_feature (430)..(430): n is a, c, g, or t
  modified_base (453)..(453): a, c, t, g, unknown or other
  misc_feature (453)..(453): n is a, c, g, or t
tcagagcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttggggganagatatgtttcctggtatctcagaggccaggccactccctattctagtcatgtatcaaactacgaagccgcccctgacggggtccctggacgcgtactttttccgnggtccttaccgaagtcgtagggggacctacacggccactctgactctccgtcccgggcccaggcccatcgatggagggatactattacngtcaggtcgtagggacagccaanaacgtgacgtagtccgttacgggcgggtacgggaccgtagggtcgaccggtccgtgggtaccacggtacccgaacgggtccctccggccccccgttacggtccctaccgttccgttaccggttaccccctacccgttccccctacctaacccgg

SEQ ID NO: 95848 - DNA, 690 bp, Homo sapiens
  misc_feature: GYAE6OF02GL479.4.28.C06.1.454.CMB.1.raw
  modified_base (240)..(240): a, c, t, g, unknown or other
  misc_feature (240)..(240): n is a, c, g, or t
tcagagcactgtagcacgaccggtgctcgatttagagctcacgtattggggtttggggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgacaaacgacgttggggganagatatgtttccgtggtatctcgagacggccacggccacctccctattctagtctatgtactacaaactacgaacgtccgcccctcgacggggtccctgacgtccgtcttttcgtcggtcctacgtaacggtcgtacggggacacgacgtccactcgtacgtacctccgtccgtcccggggacccacgggtacccacgtcgaaggtcggaacgggtagtaaccttacgttacgtcggtacggagggtcggtacgggacgacgacctaaccgtacgtcgtacgtacggttcggtaccgggggtacgggaaccgggtacgggtacgggtaccggtaccgggttccggtacgggccgaaccggaccggtaacgggtccgtacccggtcccccggttacgtcccgtaccgttcccgttacccggttcccctaccccgttcccgtaccgtaccgg

SEQ ID NO: 95849 - DNA, 747 bp, Homo sapiens
  misc_feature: GYAE6OF02FZLW8.4.28.C06.1.454.CMB.1.raw
  modified_base (235)..(235): a, c, t, g, unknown or other
  misc_feature (235)..(235): n is a, c, g, or t
  modified_base (337)..(337): a, c, t, g, unknown or other
  misc_feature (337)..(337): n is a, c, g, or t
  modified_base (367)..(367): a, c, t, g, unknown or other
  misc_feature (367)..(367): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccacctcactgtccgtctctccaggacggacagccgtcatcacctgctctgcaaacgacttggggganagatatgttcctggtatcgtcggaggccaggccactcccctattcagtcatgtatcaaactacgagccgcccctgacgggtccctgacggcctcgttttcgnggtcctaccgaagtcgtaggggaccaacgngcccactctcggtaccttcgtcccgtcccggggtacccacggaccctacgtacgtacgttacggaaggggtaacgtacctttaacgttaacttacgggtaccgaaggggtccggtacggggaacacggacccgtaaccgtaaactcggacctaacgggttccgtttccggggaaccgggtaacggggtacccgtaacgggggtacccggtaacccggttaccgggtacggggtacccgtaaccgggtaccccggaaaccgggttcccggtacccgggttacccccccgtaccgggtttacccctaacccggttccccgttacccggtttaccccccgttaaccccccgtaccccgtttaccccgtacccgttaacccggg

SEQ ID NO: 95850 - DNA, 845 bp, Homo sapiens
  misc_feature: GYAE6OF02GUDJ8.4.28.C06.1.454.CMB.1.raw
  modified_base (235)..(235): a, c, t, g, unknown or other
  misc_feature (235)..(235): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcactgctctgcaaacgcgttggggganagatagtcgtttctggtatctccagacggccaggccacctcccctattctagtcatgtactacaaactacgaacgccgccctcgacgggtccctggacgtccgtcttttaccgcggtcctaccgtaacggtcgtacggggaactacggacgtcctaacgtcgtacgtaccttccgtacccggtccccggggaccccgtacggacccgtacgtaccggtacggtacgggaacggggtaacgtaaccgtttaacgttaccgtcggttaccggtaacggggtccgggtttacggggacctacggaacccgtaacctaaaccggtcgggtaacccgtacgggtttacccgggttacccgggggtaccgggggtaaccggggtaacccgggtacgggggttaacccggttaaccccggggtttcccgggtaccgggggttaccccggtaaccgggtaacccccgggtaaacccgggggttcccggttaccccccggggtaccccccccgggtttaccgggttaacccccgttaacccggttcccccggttttaccccggtttaccccccccggtccccccggtttaccccccttaccccgggtttaaaccccggg

SEQ ID NO: 95851 - DNA, 810 bp, Homo sapiens
  misc_feature: GYAE6OF02IL3PC.4.28.C06.1.454.CMB.1.raw
tcagagcactgtagcacgaccggtgctcgatttagagctcacgtattgggtttgggggggcctcaggaagcagcatcggaggtgcctcagccatggcatggatcctctcttcctcggcgtccttgcttactgcacaggactccgggcctctatcaactgactcaaccaccctcactcgtccgtctctccaggaccggactagccgtcaactccaccttcgcttcgtacgcaaacgacggttcggggagacgatagttgtttaccgtggtatccgtccaggtacgacgacgcctaaccttcccgtattcctaggtactacgtcgtactacaaaaccgttaccggaaacgtcccgccccgtacggacggggttccctagacggtccttacgttttcgacggtctaccggaacgttcggtacggggtaacaccgtaccggtcccttaacgtcccgtaacgttaccccgttaaccggttaccccgggtcccggggggtacccctacggggttacccgaaccggtttaaccgggtacgtaaacgggacgggggtaaagttaacccgtttaacggttaccggtacgtactacggggttacggttaccgggacgtacgacgtaccgtaaacgtcgtaaccgtacgggttcccggtaaggggccgggtaacgggtaacggacgggtaaccggtccggtaacggttccggacccggtacggacccggtaacccgggtcctcccggtaaccccgggttaccgtcccgtaacggttccttacccggtaccccccgtttccctaccccttcgttaacccggg

SEQ ID NO: 95852 - DNA, 695 bp, Homo sapiens
  misc_feature: GYAE6OF02FXRJ3.4.28.C06.1.454.CMB.1.raw
  modified_base (243)..(243): a, c, t, g, unknown or other
  misc_feature (243)..(243): n is a, c, g, or t
tcagagcactgtagcacgaccggtgctcgatttagagctcacgtattggggtttggggggggcctcaggaagcagcatcggaggtgcctcagccatggcatggatccctctcttcctcggcgtccttgcttactgcacaggagtccggggcctcctatcaactgactcaaccaccctcactgtccgtctctccaggacggacagccgtcatccaccgtgctctgacaaacgcgttaggggganagactatcgtttccgtggtatcctccgaggacggccgaacggccaccgttcccccgtattctacgtcatgtactacaaactacgaagccgacccctcgaccggggtccctgaggtcttccgttttcgcggtccttacgtaacgtcggtacggggacactagacctactctacgtaccttccggtcccggacccggggcccacgggaccctagtaccggaggtacgggaaggggtactaaccgttaagttaccggtctacggcgggtcggacggggtccacgggactaaccgtaacgtcggaacttaccgggtccggttccgggggaacggtacggggtacccgaagggtcggaaccgtcgggtcggtaccaacggtccgaacggaccctccgggtccccgtggtccctacgttcccgttcccggtaccccctccctttccgacccgttaccg

SEQ ID NO: 95853 - DNA, 850 bp, Homo sapiens
  misc_feature: GYAE6OF02F7I9D.4.28.C06.1.454.CMB.1.raw
  modified_base (140)..(140): a, c, t, g, unknown or other
  misc_feature (140)..(140): n is a, c, g, or t
tcagagcactgtagcacgaccggtgctcgatttagagctcacgtattgggtttgggggggtccgtcgaggaagcagcatcggaggtgcctcagccatggcatggatccctctcttcctcggcgtccttgcttactgcacnggagtccgggcctcctatcaacgtgactccaaccaccctcactcgtccgtctactccgaggaccggacacgtcccgtaccaatccaccgtcgccttctcgaaccaaacggtcggttaggggagagtagttattcgtttacctggttactcgttacccaggtaccggacccgaggaccctaccgttacccctagttttaccgtacgttacctaagtacgttaacgttaccgtaaaacgtaccggtaaccggacccgtacccccgttacggaccggggttaccctcgggtacggtccgtttaccgttttcgtccgggtacttccggaacgtttcgaccggggtaacaaccgcggaaccttccgtacgtaccgtaccggtttcccgacccggggtttcccgggacccgtaccggacctacggtaccggtacggtcggggtaacggtaaccggtaccgttaacgttaccgttacgggtaccgtacggggtaaccgttcggggaacccgtacgttaaccgaccgtaaccggttacgtaccggtaaccggttcgttacccggggtacgggtacccgggacgggttaaccgggtacggtaccccgggttacgtccggttacggacccgtaaccggggtaccgtacggaccccgttcccggtaccgttccgtacccgtccgtttcccgtaccccgtaccgttcccacccgttacccgg

SEQ ID NO: 95854 - DNA, 743 bp, Homo sapiens
  misc_feature: GYAE6OF02H6G5V.4.28.C06.1.454.CMB.1.raw
  modified_base (178)..(178): a, c, t, g, unknown or other
  misc_feature (178)..(178): n is a, c, g, or t
tcagagcactgtagcacgaccggtgctcgatttagagctcacgtattgggtttggggggtccgtcgaggaagcagcatcggaggtgcctcagccatggcatggatcctctcttcctcggccgtcttcgcttactgcactaggactccgggcctcctatcaactcgctcaaccaccctnactcgtcctctctccgaggccgtacagccgtcatcacctgctctgacaacgtacgtggggactagactatgtttaccggtatcctcagacgccgagtccacttccctatcctatcattctactacaacttacgagtccgaccctggaaccgggtctcggacgttctacgtttctggtcctacctaggttcgcgggaactacgaacgtcccgattccagtaaccttccggttccggtacccgggggccttacggacctacgtaccgaggttacggacggtagaaccgttagttacgtacggtacgtaacgggtccggttacgggtaagccgtaacgtaccgtaaacgtcgggtaaaccctgggttaccggttacggtacccggggaagggtaacccggtaacggggtaccggtaacccgggtttccggggtaacgggttacccgagggtaccccggtaaaccggttaccggtccccggggtaccccctttacccgggaaccggttacccgttacccggttcccggttttaacccccgtaccgttacccccgttaccggtaacccgg

SEQ ID NO: 95855 - DNA, 709 bp, Homo sapiens
  misc_feature: GYAE6OF02IQE22.4.28.C06.1.454.CMB.1.raw
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactccaaccaccctcactcgtccgtctctccaggacgacacgccgtcactcacctgctctgacaaacgacgttgggggagagatattcgttcctgtatctcagagccacggcctacctccctattctacgtcattgtatacaaactacgaacgccgtccctcgacgggtcctggcgcgttctttcgcggtctacctacgtcgtacggggacacgacgcctactctacgtacctcgtccggtcccgggacccgtacgaccgtacgtacgtagtacgggacgggtaacgtaccttaacgttacgtcggtaccggtacgggtcgggttacgggaccgacgtaccgaacgaaccgtggtaccgtacggttccggtaccggggcggggtaacgggtaccgggtacgggggtaccgacccgggttccggtaccgggtaccgtaccgggacccggtaacgggtcccgttacccggaccccggttccggttacccgtacccgttcccggtttacccggttccccccgtaccccgttaccctacccgttaacccgg

SEQ ID NO: 95856 - DNA, 645 bp, Homo sapiens
  misc_feature: GYAE6OF02HHCGI.4.28.C06.1.454.CMB.1.raw
  modified_base (608)..(608): a, c, t, g, unknown or other
  misc_feature (608)..(608): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctcgacaaacgacggttgggggagagatatgtttccgtggtactctccagacggccaggccacctcccctattctagtcatgtatacaaactacgaacgccgcccctcgacggggtccctgacgtcgtcttttcgcggctaccgtaagtcgtggggaccacgagcccactccgtacgtaccttccgtccggtcccggggacccacgggaccctacgtccggaagtcgggaaggggtaacgtacgttaacgttacgtcggtacgacgggtcgggttacgggacacggtacaacgtaccgtgacctaggttccgttacgggacgggtacgggaccgaggggtcgaccgggtcgtgggtaccacggaccgtaggccgtccgccccgtacggtccncgttccgtcccgttccccacccgttccctccgtaccg

SEQ ID NO: 95857 - DNA, 754 bp, Homo sapiens
  misc_feature: GYAE6OF02FXTGN.4.28.C06.1.454.CMB.1.raw
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgactcaaccacctcactgtccgtctctccaggacggacagccgtcatccacctgctctgacaaacgacgttgggggacgagatagttcgttccgtggttactctccgaggacggtccgaggccctacctccccttagttctagtctattacgtacgtactaaaacgttacggaaacgcccgtaccccgtacgacggggtccctaggacgtccgttctttcgcggtacctaccgtagtcggtcggggacctacgacggccctacgtaccgtgtacccttccgtaccgggtccccggggtacccaccgggtccctaggtccgaacgtacggggtacgggaattaccgttaacgttacggtcgttacgggacgggtacggttagggacctacggaaccgtaaccgtaaagccgtaccggtacggtttaccggtccggggtacgggaaccggggtaacggtccgggtacggtacccgggtaccgttacgggaccgtacggtaacccggtaggccctaccccggggtccccctagggtaccctaccgttcccggttaccccgtaccccgttccccggttaccccgtaccgttaacccgg

SEQ ID NO: 95858 - DNA, 735 bp, Homo sapiens
  misc_feature: GYAE6OF02IJ20J.4.28.C06.1.454.CMB.1.raw
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggcgacagccgtcatcacctgctctgacaaacggcggttgggggagtagatagttcgtttcctaggtactccgtaccgaggacggaccgacgggccctaccttccccttattaccgtacgtcctaagtagtactaccaaaacgtacggaacgcccgtccccgtacgaccgggggtcccctagggacgtccgttcgttttccgcgggtcctacccgtaaggtcggtacggggactacgacgtccactccgtacgtactcccgtccggtacccgggggtcccaccggtaccacgtaccggtaacggtacgggtaacgggtaacggtacttaaccggtttaacctacgggtcgaaggggcggttaccgggacgaccgtacaacgaccgttacgtaccgtacggttccggtacgggccgggtaccgggtaccggagggtacggtacccggtccggtacggttccaaccggtcccgaacggtccgcccggtcccccgtacgttccgtaccgtccgttaccggtccccgtcccgtccctacccgtaccg

SEQ ID NO: 95859 - DNA, 958 bp, Homo sapiens
  misc_feature: GYAE6OF02IVZCB.4.28.C06.1.454.CMB.1.raw
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggagtccggggcctcctatcaactgactcaaccaccctcactgtccgtctctccgaggacggacagcccgtcaacttccaccgtgcctcgtacgaccaaaaccgtccggtttaggggggaagaggtaattaacgttacggttttccgtagggttaacttccgtaccgaacggtaccggacccgaacgggtaccctaaccgttacccccgttaatttccgtaacggtacctaagttacggtaactaaccgaaaaccgttaacggaaaccgcccggtaccccgttacggtaccgggggttaccccgtacggtaccggttaccgttaccgttttccggtacggtcccgttaacccgtaagggttccggttaacgggggaacctaaccgtacgggtacctaaccgtttcgtaacgtacccgttaccggttcccgggtaccccgggggtacccaccgggtaccctaacgttcggtaaaggttacggggaacggggtaacttaccggttaaacgtttaccggttacgggtaacccggtacgggttccgggtaaacggggtaccaaccgggttaaacccaactaaaccggttcggtacccgttaaggggtttacccggtaaccgggggacggggtaaaccggggtcccggttaaacgggggtacccggttaacccggttccggggttaacggggtaccctaaccgggtaaaccccgggcggttaacccggttccccgggtacccccctttacggggttaaccgttaacccgttcccggttacccccggttacccccggtaacccctttcccgtccccgttaaaccgg

SEQ ID NO: 95860 - DNA, 668 bp, Homo sapiens
  misc_feature: GYAE6OF02JGYSO.4.28.C06.1.454.CMB.1.raw
  modified_base (244)..(244): a, c, t, g, unknown or other
  misc_feature (244)..(244): n is a, c, g, or t
  modified_base (419)..(419): a, c, t, g, unknown or other
  misc_feature (419)..(419): n is a, c, g, or t
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagccgtcatccacctgcctctgaccaaacgtacgttgggggganagatattcgtttcctggttactctccaggcggccacggcccacctcccctattctagtcattgtactacaaaacgtacgaacggccgccccgtcgacggggtcccctagacgtccgttcttttcgcggtactcccaaggtccggtagggggaacctacgacggtcccaacttcgngtacccttcggtccggttcccccgggggccacgggtcccagtaccgagttacgggacgggacgtaactactttaacgtcgtacggaggcgggttagggaccaggaccaactaaccgtgactacgttccgttcgggacgggtacgggccgaggggtccgaccgtccgtcgggtcgacgccggtaacgggcctccggtccccgttcgtcccgtacgttcctccggtcccctcccgttccctaccctaccgg

SEQ ID NO: 95861 - DNA, 809 bp, Homo sapiens
  misc_feature: GYAE6OF02IG6GY.4.28.C06.1.454.CMB.1.raw
  modified_base (102)..(102): a, c, t, g, unknown or other
  misc_feature (102)..(102): n is a, c, g, or t
  modified_base (174)..(174): a, c, t, g, unknown or other
  misc_feature (174)..(174): n is a, c, g, or t
  modified_base (286)..(286): a, c, t, g, unknown or other
  misc_feature (286)..(286): n is a, c, g, or t
tcagagcactgtagcacgaccggtgctcgatttagagctcacgtattgggtttgggggggcctcaggaagcagcatcggaggtgcctcagccatggcatggntccctctcttcctcggcgtccttgcttactgcacaggagtccggggcctacctatcaactgactacaacccncctctactcgtccgtctctccgaggacggacagccgtacactcacctgctcgtcgacgtaaacggtacgttagggggatagtacttacgttcgtttccgttaggtacttccnccgaaggacggaccgacggaccaccttacccttagttctacgtacctagtacgttaactaaccgaaacttacggtaaacgcccgtaccccgtacggtaccggggtttccctcggaacggtccggttccttttcgtccgggtactaccgtaggttaccggtacggggaccaacgtacggacctacgttccgtcgtaaccttcccgttaccggcccgggggccctacggggtaacccgtacgtacggtaacggcgggtaacgggtaacggttacctaagtttccgtacgttcgtacggggaccgtacggggaccgtaacggtcctaaacggaccgtttagccgtaccgggtaccgttacggggaccgggtaacgggtaccggtaacgggttccggtaccggttaccggtaccgggttaccgaaccggtcccggaagggtaccttcccccgggacccggtttaccggtccgttaccggtccgttaccccggttcccctaaccccgttacccgtaccccgttaacgg

SEQ ID NO: 95862 - DNA, 833 bp, Homo sapiens
  misc_feature: GYAE6OF02HGTD8.4.28.C06.1.454.CMB.1.raw
tcagagcactgtagcacgaccggtgctcgatttagagctcacgtattgggtttggggggggcctcaggaagcagcatcgggaggtgcctcagccatggcatggatccctctcttcctcggcgtccttgcttactgcacaggatccggggcctcctatcaactgactcaaccacctcactgtccgtctctccgaggacggacagccgtcactccacctgctctcgacaaacgtacggttgggggacgagatagttcgtttccgtggttatccgtaccgtaggacggccgacgggccctaaccttccccttattacctacggtacctattacgtaactaacctaaaaacgtacggtaaaccgcccggtcccccgttaccgggaaccgggggttcccctagggtaccggtccggttccttttttaccggccgggtaccttaacccgtacggttaccggtacgggggaacctaaccgaacggtccctaacttccgtacgtacccttccggttcccggtccccgggggtacccaacgggtacccctaggtacccgtaggtacggggagggtaaacgttactaacgttacgttcggtacggacggggtacggtacgggacacgtaccgaacgtaccgtagtaccgtacgttaccgggtccgggacggggtaacggtaccgggtaaggggtccgaccgggttccggtagggtacccggacgggtacccggaaacggttcccggtccccgggtcccccgttaccgggttacccgttaccgtttacccggttcccccggttaacccccttacccccgtttcccgtaaccccgttaacccggg

SEQ ID NO: 95863 - DNA, 715 bp, Homo sapiens
  misc_feature: GYAE6OF02IDV9N.4.28.C06.1.454.CMB.1.raw
  modified_base (238)..(238): a, c, t, g, unknown or other
  misc_feature (238)..(238): n is a, c, g, or t
tcagagcactgtagcacgaccggtgctcgatttagagctcacgtattgggtttggggggcctcaggaagcagcatcggaggtgcctcagccatggcatggatccctctcttcctcggcgtccttgcttactgcacaggatccggggcctcctatcaactgactcaaccaccctcactgtccgtctctccaggtacggacagccgtcatcacccctgctctgcaaacgacttggggganagatatgtttcctggtatctccagaggccaggccactcccctattctagtcatcgtaatacaaactacgaacgccgtcccctgacggggtccctggacgtccgtcttttcgtcggtcctaccgtaaggttccgtagggggacctacgacgtcccaacgttcctacggtaccttccgtccggtccccggggacccacgggacccacgtccgaacgtggaacggggtaacgacgttacttacgtcgtcggacggacggttacgggacacgtaccgaacgaaccgttgaccgtacggttccgttcggggaccgggaacggggtacccgtaaggggtccggtaacccgggttccgttacggggtaccgaccggacccggtaaccgggtcctcccgggtaccccccgttaccggtacccgttacccgtttcccggttacccggttccccccggtacccctttcccccgtaccgttaacccgg

SEQ ID NO: 95864 - DNA, 690 bp, Homo sapiens
  misc_feature: GYAE6OF02JZRTP.4.28.C06.1.454.CMB.1.raw
  modified_base (253)..(253): a, c, t, g, unknown or other
  misc_feature (253)..(253): n is a, c, g, or t
  modified_base (386)..(386): a, c, t, g, unknown or other
  misc_feature (386)..(386): n is a, c, g, or t
  modified_base (440)..(440): a, c, t, g, unknown or other
  misc_feature (440)..(440): n is a, c, g, or t
  modified_base (558)..(558): a, c, t, g, unknown or other
  misc_feature (558)..(558): n is a, c, g, or t
  modified_base (653)..(653): a, c, t, g, unknown or other
  misc_feature (653)..(653): n is a, c, g, or t
  modified_base (666)..(666): a, c, t, g, unknown or other
  misc_feature (666)..(666): n is a, c, g, or t
  modified_base (676)..(676): a, c, t, g, unknown or other
  misc_feature (676)..(676): n is a, c, g, or t
tcagagcactgtagcacgaccggtgctcgatttagagctcacgtattgggtttgggggggcctcaggaagaagcatcggaggtgcctcagccatggcatggatccctctcttcctcggcgtccttgcttactgcacaggatccggggcctcctatcaactgactcaaccaccctcactgtccgtctctccaggacggacacgccgtacacttccgacctcgtctctcgaccgaaaacgtacggttgggggganacgtatacgttcgtttcctggttactctccgagtacggcccgtaggccctaccttacccttagttcctacgtctaagtacgttactaacaaaccgtacgtaacgcccgaccccgtacggtacggggttacccnggtacgtccgttctttacgtcgtacctcgtacgtcggtacgggaccacgtaccncgtactcgtacgtacccgtcgtacccgggtcccggggacctagccgtacgtcgacggtaggacggactacgttacttacggtcgacggtacggtacggtacggcgaactacacgtacncgtaccgtacggtcggtacggacggggtacgggaccgttcgggaccgtccggtcgacggtccacggacgtacggcccgtccgtacccgtcgtccnccttcccggtccnccccttaccnccgttactactcgg

SEQ ID NO: 95865 - DNA, 729 bp, Homo sapiens
  misc_feature: GYAE6OF02G8ML7.4.28.C06.1.454.CMB.1.raw
  modified_base (239)..(239): a, c, t, g, unknown or other
  misc_feature (239)..(239): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccggggcctcctatcaactgacctcaaccaccctcactgtccgtctctccaggacgacagccgtcatcacctgctctgacaaacgtacgttggggganagatatgtttcctggtatctccgagacggccacggccacctcccctattacctagtctatcgtaactacaaacttacggaacgcccgtaccccgtcgacggggtccctggacgtcggttcttttcgtcggtccttaccgtaacggtcgtacggggacaacgacgtaccacctcgtacgtacctccgtcccggtccccggggacccgacggcccgtacgtaccggtacgtaggggacgggtaacgtaccgttaacgttacgtacggtaaccggtagggtccgggtacgggacgacggaccgtaactaacgtcgtacttacggttcgtacgggacgggtacggggacggtacggggtacgaacccggttccggtacgggttacccgaacggacccggtaacgggtcccggtccggtcccccggtccggttaccctacccggttccgttaccccgttccccgttaacccccgttcccgttacccgttaaccgg

SEQ ID NO: 95866 - DNA, 753 bp, Homo sapiens
  misc_feature: GYAE6OF02FJ0GI.4.28.C06.1.454.CMB.1.raw
  modified_base (237)..(237): a, c, t, g, unknown or other
  misc_feature (237)..(237): n is a, c, g, or t
tcagagcactgtagcacgaccggtgctcgatttagagctcacgtattgggtttggggggggcctcaggaagcagcatcggaggtgcctcagccatggcatggatccctctcttcctcggcgtccttgcttactgcacaggatccggggcctcctatcaactgactcaaccaccctcactgtccgtctctccaggacggacagcctcactcacctgctctgcaacgacgttggggganagatatgtttcctggtactctccagacggtcacggccacctcccctaattctagtcagtcgtatacaaactacgaacgccgcccctcgtacggggtccctggacgccgttacgtttcgtcggtacctaccgtaacggtccggtacggggaaccacgtacggtccctactaccgtcgtaccgttccgtcccgggtacccggggaccccgtacggtccctaacgtacccggtaggtacgggaacggggtaacgtaaacgttacgtttaacgtcggtaccggtaagggtccgggttacgggacaaccggcgaaacgtaaccgtggccgtacggttccgggttaccgggacggggaccgggtaacccgggtagggtacggtccccggttacggtacggggtaccgaaccggacccggttaacggtacccgtcccgggtaccccccggttaccgggttacctaccggttcccggttacccggttcccccgttaccccgttccccggttaccccgtaaccgg

SEQ ID NO: 95867 - DNA, 758 bp, Homo sapiens
  misc_feature: GYAE6OF02HPT56.4.28.C06.1.454.CMB.1.raw
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggacgtccggggcctcctatccaactcgactcaaccaccctcactcgtccgtctctccgaggacgacacgccgtacacttccgacctgtcctctagaaccgaaacgtcgggttagggggaacacgtattacgttcgtttacgtagttactcctaccgtaaggacggcccgtaccgtccctacccgttccccttaacgttctacgtacgtagtacgttaactaacctaaacgtaaccgaacgccccgtaccccgtacgggtaccggggtacctggacggtccgttcttttcggacgtcctaaccgtaacggtcggtacgggacctacgtaccgcctacttcgtacctaccgttccgtcccggtacccgggcccggtaaccgtcctacgtaccgaggttcgggaacggtacgtacgtttaacgttcgtaccggtggtacggacgggtacggaccgtacgaccgtaactaccggtacgtccggtacgttccggtacgggggacggtaaccgggtaccgtacgggtccgtaacggtccgtacggtccgacgtacccggagtcccgacccgtccccgtagtcccgtacttccgtaccccgtacccctaccgttcccacgttacgg

SEQ ID NO: 95868 - DNA, 747 bp, Homo sapiens
  misc_feature: GYAE6OF02I5ACP.4.28.C06.1.454.CMB.1.raw
  modified_base (255)..(255): a, c, t, g, unknown or other
  misc_feature (255)..(255): n is a, c, g, or t
  modified_base (681)..(681): a, c, t, g, unknown or other
  misc_feature (681)..(681): n is a, c, g, or t
tcagagcactgtagcacgaccggtgctcgatttagagctcacgtattgggtttggggggggcctcaggaagcagcatcggaggtgcctcagccatggcatggatccctctcttcctcggcgtccttgcttactgcacaggagtccggggcctcctatcaactgactcaaccaccctcactgtcccgtctctccagggaccggacacgccgtctactccacctgccttcgtcgaccaaacgtacggttgggggganagtatagtcgtttaccgtggtactctacgaggacggtccgacggaccctaccttaccccctatttacctacgttacctagttagtactactaaaaaccgtacggaaccgtacccggtccccgtacggtacggggtcccctcgggacgtccggttacttttccgtggtccgtacctacggtcggtggggaaccgtacacggtacccacttccgtgtaccttccgtacccggtcccggggaccgtacggtaccgaacgtccggaagtcgggaacggcgttactacgttacgtacgttcgagggacggtggtaacgcggactaaccgtaacgtacgtccttaacgttccgggtacgggacgggtacgggtaccgtaacggggtacgttacccggcgggtaccggtccgtacgaccccggaagggtcccnccccgggtcccgtaccggtcctaaccgtccggtcccgttacccctcccgttaccctccttaaccgg

SEQ ID NO: 95869 - DNA, 1065 bp, Homo sapiens
  misc_feature: GYAE6OF02JB8RT.4.28.C06.1.454.CMB.1.raw
  modified_base (225)..(225): a, c, t, g, unknown or other
  misc_feature (225)..(225): n is a, c, g, or t
tcagagcactgtagcacgaccggtgctcgatttagagctcacgtattgggtttgggggggcctcaggaagcagcatcggaggtgcctcagccatggcatggatccctctcttcctcggctccgttgcttactgcacaggagtccgggcctcctagtcaactgactcaaccaccctcaccgtcgtccgtctcctaccgacggaccgggacacgcccgtctactccnccgtgccttccgtggaacctaaaccggtacgggttacgggggacgagtacgttatttacggtttccgtggttaaccgttcctaaccgacgtacggaccgtaccggcccctaaccctttccccgttaactttacgtacggtcctagttacgttactaaacctaaaaccgtaaccgaaccggtccccgtccccgtacggtaccgggtttacccgaacggtccgttcgttccgttttcgttaccgggccttaacccgtaaagggtttccgggagggtaacccgtaaccgtaccggtacccgttaccgtaccggtttaaccgtcccgtttacccggttaccccgggggttaaccccggggaccccgtacggggttacccctacggttttacccgggggtaagtttaaacccggggggaaaggggttttacccctaaaacggttttcgtttaaaacccgggtttcgggaaaacccgggggttcgggggttaacccgggttttacgggtaaacccggaaacgtaccccggttaaaacccgttaggggtttacccggtacccgggtaacccggggtttttaccggggttaacccggggttaaaccccggggggggaacgggggtttacccccgttaaggggggttaaacccccgtttacccgggggtttacccgggtaaaccggggttccccgaaaaccggggtaccccccggttccgggggtaacccctaccccgggggttaacccccggtttaaccccggggttacttttaaccccccgttccgggttaaccccccggtttccccccggtaaaccccgtttcccccgtaccccgtttaaccgggg

SEQ ID NO: 95870 - DNA, 663 bp, Homo sapiens
  misc_feature: GYAE6OF02HFJ5Q.4.28.C06.1.454.CMB.1.raw
  modified_base (272)..(272): a, c, t, g, unknown or other
  misc_feature (272)..(272): n is a, c, g, or t
  modified_base (456)..(456): a, c, t, g, unknown or other
  misc_feature (456)..(456): n is a, c, g, or t
  modified_base (463)..(463): a, c, t, g, unknown or other
  misc_feature (463)..(463): n is a, c, g, or t
  modified_base (548)..(548): a, c, t, g, unknown or other
  misc_feature (548)..(548): n is a, c, g, or t
  modified_base (554)..(554): a, c, t, g, unknown or other
  misc_feature (554)..(554): n is a, c, g, or t
  modified_base (596)..(596): a, c, t, g, unknown or other
  misc_feature (596)..(596): n is a, c, g, or t
tcagagcactgtagcacgaccggtgctcgatttagagctcacgtattggggtttgggggggcctcaggaagcagcatcggaggtgcctcagccatggcatggactccctctcttccgtcggcgtccttgcttactgcacaggactccgggcctcctatcaactgacctaccaaccctaccctcacgttcgtcccgtctcctaccgacggaccggacacgccgtcactccaccgtcgacttcgtacgaacgtaaacggtacggttaggggganaagtattaacggttcgtttccgtaggtactaccgtcgaggacggccaccggacctaccttcccttagttacctagtcctaagttcgtaactaacgaaaaccgtaccgaaaccctcccgtacggtaccgggtccctaggacgtcgtttacttcgcggtacctcgagttacggacggacacgtacnccgtacncgtagtacctcgtcccggaccggaccgagacctgtacggagtagggacgtatactagtcgtgcgaggtcgaggacctgaccaacngtacgntacggtcgcggaggccgtagaccggtgccgtcgacgaccganaccggtagtcccgtactcccggtagcccttcgtccggttcccttacccaaccttcccgtagcgtccg

SEQ ID NO: 95871 - DNA, 780 bp, Homo sapiens
  misc_feature: GYAE6OF02IFK8F.4.28.C06.1.454.CMB.1.raw
tcagagcactgtagcacgaccggtgctcgatttagagctcacgtattggggtttggggggggcctcaggaagcagcatcggaggtgcctcagccatggcatggatccctctcttcctcggcgtccttgcttactgcacaggcgtcccggggcctcctatcaactgacctaccaaccaccctcactgtccgtcctctccgacggacggacacgccgtcactccacctgctcgtcacgaacggtacggtggggacgagtatagttcgtttacgtcggttactctcgacgacggtccgaggcctaccctccttatctcgacgtatagtactactaaacacgacgcccgtcccgtacggtaccgggttccgtacggacgtcgttccgtttcgcggtactaccgtaccggtcggtacggggaccaccggactccgtaacgttcaggtacccgtaccgttcccgggtccccgggtaacccggtaccggaccgtacgtaccggaacgggtacgggaaacgggtaacgttacgttacgtaccggtcgttacgggtacgggacggtcgggaactacggaaccctaaggtaacccgtcggtaacgttacgggtacgggttccggggaaccggggtacgggtaacccgggtcgggtaaccggttaccgtcccgggtaagggtccgtaaccgacccggggaacggttccccggacccggttaccccggaaccggttccgtacccgttcccggttcccggttacccctcccggttaccctttcggtaacccgg

SEQ ID NO: 95872 - DNA, 750 bp, Homo sapiens
  misc_feature: GYAE6OF02GI2DS.4.28.C06.1.454.CMB.1.raw
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
tcagagcactgtagcacgaccggtgctcgatttagagctcacgtattgggtttgggggggcctcaggaagcagcatcggaggtgcctcagccatggcatggatccctctcttcctcggcgtccttgcttactgcacaggatccgggcctcctatcgaactgactcaaccaccctcactgtccgtctctccgaggacggacacgccgtcaactcacctgctctgacaaacgcgttgggganagatatgttccnggtactctccagtaggccaggcctaccttccccgtattcgtacgtacgattcgtataccaaaaccgtacggaacgtcccgaccccgtcggtaccggggttccctggacgtccgttctttaccgtcggccttaccgtaaggtccgtagggaccaacgtcgacctactccgtacgtactccggtaccgtacccggggaccctacgggtcctaccgtccgtaaggtacgggaagggtacgtaacttacgtttaccggtacgtcggtacgggtacggttacgggaacctaggtaaccgtacgaaccgttcggtaccgtacgggttccctaacgggggtccgggaacggtccgggttaacggggtccggtaacccgggttccgggttaacgggtccgtaaccggtaccggtaaccggtcccggttacccggacccccgttacgggttacccgtaccgtttcccggttcccgttaccccggtccccttacgtaccccgttaccg

SEQ ID NO: 95873 - DNA, 743 bp, Homo sapiens
  misc_feature: GYAE6OF02GDJRF.4.28.C06.1.454.CMB.1.raw
  modified_base (598)..(598): a, c, t, g, unknown or other
  misc_feature (598)..(598): n is a, c, g, or t
tcagagcactgtagcacgaccggtgctcgatttagagctcacgtattggggtttgggggggcctcaggaagcagcatcggaggtgcctcagccatggcatggatccctctcttcctcgcgtctgcttactgcacaggacgtccggggcctcctactacaacgtgactacaacccaccctcacgtcgtccgtctctccgaggacgacacgccgtacactcacctgcctcgtgaccaacgtcggttggggagagtatagttcgtttcgtagtacttctacgaggacgccgacgccacctccccttattctacgtctagttagtactaaccgtaaaccgtaccggaaccgtcccgtccccgttacgggaccggggttcccgtaggaccggttccgtttaccgttttcgtccggtaccttaccggttaacggttccggggtacgggacctaacggaccgtaacccttccgttacgtacgtaccccgttccggttcccgggccccgggtaccgaccggtaccgtaacgtacggacgtaacggggaacggtaaccgttacgttaacgttaccggtcggtaccggtgggttaccggacgggaacncgaaccgtaccgtacgtcgacgtacggtcggtccggggtacggacggtacggtacgggtcctaccgggtcgtacggtcgacgtccgacggccgtcccggtccccgtcgttccgtccttccgtcctaccctcctacccgtcctacg

SEQ ID NO: 95874 - DNA, 784 bp, Homo sapiens
  misc_feature: GYAE6OF02G23X1.4.28.C06.1.454.CMB.1.raw
  modified_base (171)..(171): a, c, t, g, unknown or other
  misc_feature (171)..(171): n is a, c, g, or t
  modified_base (586)..(586): a, c, t, g, unknown or other
  misc_feature (586)..(586): n is a, c, g, or t
tcagagcactgtagcacgaccggtgctcgatttagagctcacgtattggggtttgggggggcctcaggaagcagcatcggaggtgcctcagccatggcatggatccctctcttcctcggcgtccttgcttactgcacaggactccggggcctctatcaactgactcaaccncctcactcgtccgtctctccgaggacgacagccgtcatccacctgcctcgcgaccaacgtacggttggggaacagtatagttcgtttaccgtaggttatccgtccgaaggacggtaccgacggccctacccgttccccttattccgtatctaagttcgtaataccgtaaaacgtacgacgtcccggtaccctacgggtacgggtccgtaggaccggttccgttcgttttacgacggtacctaccgtaaggttccgggtacgggaacctaccgtaccgtacccgtacttacgtaccgtacccgttccgtaccccgggtacccgggtccaacggggtccctaggtcgaaggttacgggaacggacttacgttacgtctacgggacctagggtaccggtacgggacacgcccgtaaanacccggtagacccggtttagtacccgggtttccggggaacggtaccggggaccgggtacgggttaaccgtaccccgggtttaggtaccgggaccttaacccggacccgggtaacggttccccgacccggtccccgtacccggttacctccggttacccgttacccgtccccggttccccttaccgtaccgttaacccg

SEQ ID NO: 95875 - DNA, 498 bp, Homo sapiens
  misc_feature: GYAE6OF01B22S8.45.80.H03.1.454.CMB.1.raw
  modified_base (402)..(402): a, c, t, g, unknown or other
  misc_feature (402)..(402): n is a, c, g, or t
tcagacgcgatcgacacgaccggtgctcgattagctgtgcgtcgaagggaaagggggctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcgggccaggccctctattgataatatatctggactctaagaggccctcagggatccctgagcgattctctggctccagcgcagggacaactgtcacattgaccatcatgatccagctgagacgagctgactatactntcagtcagtagacgccaccactacctcacgtcgcgttcggcggaggaccaagctcgacgtccttggcagcccgaaggcctgccccctggtctaccg

SEQ ID NO: 95876 - DNA, 620 bp, Homo sapiens
  misc_feature: GYAE6OF01DXUYS.45.80.H03.1.454.CMB.1.raw
tcagacgcgatcgacacgaccggtgctcgatttagctgtgcgtcgaagggaaaggggctgggagacgagcccagcactggaagtcgccggtgtttccactcggtgatcatcaccgaacacagaggacgcaccatggagtttgggctgagctggctttttcctcgttgctcttttgagaggtgtccagtgtcaggtgaagttggtggagtcgtggggggagcgtggtccagcctggggagtccctgagacctctcctgtgagtcagtggattcaattcagtaactatgccatacattgggtccgcaggcctcgaggcaaggggctggagtggctgtcagttattacgaaaaaggtaataactaatataattatagaagtactccaagttaacgggcctattacaacctatacctaccagacactaacttaccaaagaaacggcggtagtacttctgacaagtatagacgcgaacgtcctaggacggccttaggaaccgacgtacgggtccttggttaccttagtttaacgttggtacggtacccaaggtaacgaacgtttagggtaccgggtcccgggaaacggggggggtaggggaaaccctggggtcggggtacccggg

SEQ ID NO: 95877 - DNA, 584 bp, Homo sapiens
  misc_feature: GYAE6OF02FRJDS.45.80.H03.1.454.CMB.1.raw
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (407)..(407): a, c, t, g, unknown or other
  misc_feature (407)..(407): n is a, c, g, or t
tcagacgcgatcgacacgaccggtgctcgatttagctgtgcgtcgaagggaaaggggctgggagacgagcccagcactggaagtcgccggtgtttccactcggtgatcatcaccgaacacagaggacgcaccatggagtttgggctgagcgtggtcgtttcctacggttgcctacttttggagaggtgtccagtgtcaggtgaagttggtggagtcgtgggggaggcgtggtccagcctggggacggtccctgagactctcctgtgaagtcagtggattcaacttcaagtaactatcgccatacattgggtcccgcaggctccaggcaaggggctggagtggctgtcagttattacgaaaaaggatacatatatangaanactacataaggcatacacatcacaganacacttaccgaaagaacgtcgtagtactctagacagtactagagcagccgtagacgccgtaggaaccgaccgacgggtcctgtaaccgttattattagggccgtactaagggaacttaacgtaaggttccggggaacccggtaacggggggggacgaacggtaggggttgggcccgg

SEQ ID NO: 95878 - DNA, 662 bp, Homo sapiens
  misc_feature: GYAE6OF02HNMNG.45.80.H03.1.454.CMB.1.raw
tcagacgcgatcgacacgaccggtgctcgatttagctgtgcgtcgaagggaaagggggctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgtctttcgaccaacaacaatattggttactggtaccagcaaggaaggcgggaccacggcccctatattgaataatatatcgtgactacgtaaggcgcctacgacggtactacccgtgacgtcgtattcctacgtcggtcctaccgacggtaccgacgtaacgggaactaaacgtcgtactaacgtacgtttacgaacctactacgtaagttacgggtaacgttaccgacgtacccggttagggaacgggtacggacggtacgtacgtaacttaacgtttactcgttactacgtacgtaggtacgaccgtacctaccgtactaccgtacgaccggtccgtaccggttcgggaccggacgggaccaacggtcgtacggtacccgttcgtcggtacgaccgaccgacggtcccgtaccgtccccgtacgtacctccg

SEQ ID NO: 95879 - DNA, 818 bp, Homo sapiens
  misc_feature: GYAE6OF02F2UO2.45.80.H03.1.454.CMB.1.raw
tcagacgcgatcgacacgaccggtgctcgatttagctgtgcgtcgaagggaaaggggctgggagacgagcccagcactcggaagtcgccggtgtttccactcggtgatcatcaccgaacacagaggcgcaccagtggagtttgggctgagcgtgcttttcctcgttgcttctttgagtaggtgtccgagttcgtacgaggttagaaggtttgggtaggacgttccggtggggggtacgtcggttgggtacccgaggtcccgttagggggaccgttcccgtagacgtacttccgtaccgttgtacgaacgttcgaagtaggagttactaacgttactaaggttaactagtccgcctaataccgtagttcgggtacccaccggtaggtccgtaccgaagggtaccggaaggggtccgtagggtacggtcggtaacttcggttaccgttagtttaacgttaaaggaaaaaacgggtaacttaaacgtaattaattaagtttaacgtaagtaaactacccgtaagtaacgggtttaacgggtaccgtaactaccaaccgtcgttaacctacccgaagggtaaactacctaaccgttaaccggaaacggtaaggtaccgttaggtcttacgtagtacggtaacgagtcgaacgtcggtaaaccgtcggtaccgggacgttcgtaccgggaaccgtacggtaacccggtcggttatttacggttattccgggttacgtcggtaaccgtaggttaacgtaaggtttcgggaacccgggttacggggtacggggggaacgtcggggtaccggttacgtcccggggg

SEQ ID NO: 95880 - DNA, 300 bp, Homo sapiens
  misc_feature: GYAE6OF01DICM5.48.19.B08.1.454.CMB.1.raw
  modified_base (290)..(300): a, c, t, g, unknown or other
  misc_feature (290)..(300): n is a, c, g, or t
tcagagtatacatacacgaccggtgctcgatttagtgagtcagtaaggggccctcagggtccctgatcgcttctctggctccaagtctggcaacacggcctaccctgaccatctctggctccaggctgaggatgaggctgattattactgctgctcatatgcaggcagctacacttggtgttcggcggaggaccaagctgaccgtctaggtcagcccaaggctgcccctcggtcactctgttcccaccttcctctatgtatactctgagcgggctggcaaggcgcatagnnnnnnnnnnn

SEQ ID NO: 95881 - DNA, 295 bp, Homo sapiens
  misc_feature: GYAE6OF01C3HUR.48.19.B08.1.454.CMB.1.raw
  modified_base (285)..(285): a, c, t, g, unknown or other
  misc_feature (285)..(285): n is a, c, g, or t
  modified_base (290)..(295): a, c, t, g, unknown or other
  misc_feature (290)..(295): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaaggctgcccctggtcactctgtccaccctctctatgtatactctgagcgggtctggcaaggcncatgnnnnnn

SEQ ID NO: 95882 - DNA, 345 bp, Homo sapiens
  misc_feature: GYAE6OF01AEED2.48.19.B08.1.454.CMB.1.raw
  modified_base (304)..(345): a, c, t, g, unknown or other
  misc_feature (304)..(345): n is a, c, g, or t
tcagagtatacatacacgaccggtgctcgatttagtgagtcagtaaggggcccgtcgaggggtccctgatcgcttcctctggcctccaaggtctcggcaacacggcctccctgaccatctctggctccaggctcgaagatcaggctgattattactgctgttcattttcaagttcctttttgccttcggaacttgggaccgaggtccaccggtcctaggtccacgcccaaggccaacccccagtgtcactctgttccccaccctcctctatgtatactctgagcgggctggcaaggcgcatagnnnnnnnnnnnnnnnnnnnnnnnnnnnnnnnnnnnnnnnnnn

SEQ ID NO: 95883 - DNA, 654 bp, Homo sapiens
  misc_feature: GYAE6OF01BJ3IV.48.19.B08.1.454.CMB.1.raw
  modified_base (219)..(219): a, c, t, g, unknown or other
  misc_feature (219)..(219): n is a, c, g, or t
  modified_base (331)..(331): a, c, t, g, unknown or other
  misc_feature (331)..(331): n is a, c, g, or t
tcagagtatacatacacgaccggtgctcgatttagtgagtcagtaagggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccngcagtgatgttggtgttatactatgtctcctggtaccaacagccaccaggacaaacgaccccaaactcatgtatttatgatgtacagtaacgccggtccctcgacgggtccngactcgtcttctcgtcggcctaccaagtcgtcggaccaaccgaccggcccttcccgtacgaccctagtcctcgtcgggcccttccgaggtcctaggacggtacgtggacggtccttaggttaacttttaacgttacgtccgtacttcgccttacgatttacgtcggaccgtagggacctacggtacccgttaaccgttacgggtttcgggggtttcgggttccgggggaccgggaaaccggggtaaccgtacgggtcccgttaccggggtaccccggttacccggttaacgggacccgtaaccggtacccccggtaaaccggg

SEQ ID NO: 95884 - DNA, 495 bp, Homo sapiens
  misc_feature: GYAE6OF01D6F3S.48.19.B08.1.454.CMB.1.raw
tcagagtatacatacacgaccggtgctcgatttagtgagtcagtaaggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgttataactatgtctctggtaccaacagcacccaggcaaacgccccaaatcatgatttatgatgtcagtaagcggcctcgagggtccctgatcgcttctctggctccaagtctggcaacacggcctccctgaccatctctggctccaggctgagatgagctgattatactgctgctcatatgcaggcagctacacgttgggtcgttcggcgggagggcccaaggtcctacggtacccgtccgtaagggtcagccccgaaggg

SEQ ID NO: 95885 - DNA, 300 bp, Homo sapiens
  misc_feature: GYAE6OF01CNBDZ.48.19.B08.1.454.CMB.1.raw
  modified_base (294)..(300): a, c, t, g, unknown or other
  misc_feature (294)..(300): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaaggctgccccctggtcactctgttcccaccctcctctatgtatactctgagcgggctggcaaggcgcatagnnnnnnn

SEQ ID NO: 95886 - DNA, 294 bp, Homo sapiens
  misc_feature: GYAE6OF01BWULS.48.19.B08.1.454.CMB.1.raw
  modified_base (291)..(294): a, c, t, g, unknown or other
  misc_feature (291)..(294): n is a, c, g, or t
tcagagtatacatacacgaccggtgctcgatttagtgagtcagtaagggccctcaggcgtttctaatcgcttctctggctccaagtctggcaacacggcctccctgacaatctctgggctccaggctgaggacgaggctgattattatgctgctcatatgcaggtggtactacttgggtgttcggcagagggaccaagctgaccgtcctaggtcagcccaaggctcgccccctggtcactctgttcccacctcctctatgtatactctgagcggctggcaaggcgcatagnnnn

SEQ ID NO: 95887 - DNA, 299 bp, Homo sapiens
  misc_feature: GYAE6OF01DK5QT.48.19.B08.1.454.CMB.1.raw
  modified_base (295)..(299): a, c, t, g, unknown or other
  misc_feature (295)..(299): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaaggctcgcccctcggtcactctcgttcccaccctcctctatgtatactctgagcggctggcaaggcgcatagnnnnn

SEQ ID NO: 95888 - DNA, 296 bp, Homo sapiens
  misc_feature: GYAE6OF01E284I.48.19.B08.1.454.CMB.1.raw
  modified_base (290)..(296): a, c, t, g, unknown or other
  misc_feature (290)..(296): n is a, c, g, or t
tcagagtatacatacacgaccggtgctcgatttagtgagtcagtaagggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccctggtcactctgttcccacctcctctatgtatactctgagcggctggcaaggcgcatgnnnnnnn

SEQ ID NO: 95889 - DNA, 297 bp, Homo sapiens
  misc_feature: GYAE6OF01CYRGR.48.19.B08.1.454.CMB.1.raw
  modified_base (290)..(297): a, c, t, g, unknown or other
  misc_feature (290)..(297): n is a, c, g, or t
tcagagtatacatacacgaccggtgctcgatttagtgagtcagtaagggccctcaggggtccctgatcgcttctctggctccaagtctggcaacacggcctccctgaccatctctgggctccaggctgaggacgaggctgattattattgctgctcatatgcaggtggtactacttgggtgttcggcagagggaccaagctgaccgtcctaggtcagcccaaggctgccccctggtcactctgttcccacctctctatgtatactctgagcggctggcaaggcgcatagnnnnnnnn

SEQ ID NO: 95890 - DNA, 301 bp, Homo sapiens
  misc_feature: GYAE6OF01CYJ9C.48.19.B08.1.454.CMB.1.raw
  modified_base (294)..(301): a, c, t, g, unknown or other
  misc_feature (294)..(301): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaaggctgccccctggtcactctcgtcccaccctcctctatgtatactctgagcgggctggcaaggcgcatagnnnnnnnn

SEQ ID NO: 95891 - DNA, 299 bp, Homo sapiens
  misc_feature: GYAE6OF01DA99Y.48.19.B08.1.454.CMB.1.raw
  modified_base (297)..(299): a, c, t, g, unknown or other
  misc_feature (297)..(299): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtctaggtcagcccaaggcctcgccccctcggtcactctcgttcccaccctcctctatgtatactctgagcgggctggcaaggcgcatagnnn

SEQ ID NO: 95892 - DNA, 300 bp, Homo sapiens
  misc_feature: GYAE6OF01CBT5I.48.19.B08.1.454.CMB.1.raw
  modified_base (289)..(289): a, c, t, g, unknown or other
  misc_feature (289)..(289): n is a, c, g, or t
  modified_base (294)..(300): a, c, t, g, unknown or other
  misc_feature (294)..(300): n is a, c, g, or t
tcagagtatacatacacgaccggtgctcgatttagtgagtcagtaaggggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctcgccccctggtcactctcgttcccaccctctctatgtatactctgagcgggctggcaaggcncatgnnnnnnn

SEQ ID NO: 95893 - DNA, 592 bp, Homo sapiens
  misc_feature: GYAE6OF01B67F6.48.19.B08.1.454.CMB.1.raw
  modified_base (293)..(293): a, c, t, g, unknown or other
  misc_feature (293)..(293): n is a, c, g, or t
tcagagtatacatacacgaccggtgctcgatttagtgagtcagtaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgttatactatgtctcgtgtaccaacagcaccagacaaacgccccaaatcatgtatttangatgtcagtaacgcgccctgacgggtcctgactcgcttctctgctcaagtcgtacgcaacgaccggtcctcccgtgaccctatccgtcgtcgggtcctaccgaggtctaggaggtatgggaacggtcctaggtaactttacgtttaacgtgtccgttgaccttagtaactacgtcgacgtacggacaacggtcttaacgtccggtttgggggtcggttccggggagggaaccgggtaccgtaacgggtccgttacggtacccggttacccgtagggtcccaaccggtccccgtaacggg

SEQ ID NO: 95894 - DNA, 312 bp, Homo sapiens
  misc_feature: GYAE6OF01EZHBH.48.19.B08.1.454.CMB.1.raw
  modified_base (292)..(292): a, c, t, g, unknown or other
  misc_feature (292)..(292): n is a, c, g, or t
  modified_base (298)..(312): a, c, t, g, unknown or other
  misc_feature (298)..(312): n is a, c, g, or t
tcagagtatacatacacgaccggtgctcgatttagtgagtcagtaagggcccgtcaggggtccctgatcgcttctctggctccaagtctggcaacacggcctccctgaccatctctggctccaggctgaggatgaggctgattattactgctgctcatatgcaggcagctacacgttgggtgttcggcggagggaccaagctgaccgtctaggtcagcccaaggcctcgcccctggtcacgtctgttcccgccttcctctatgtatactctgacggcggctggccaaaggcncatagnnnnnnnnnnnnnnn

SEQ ID NO: 95895 - DNA, 300 bp, Homo sapiens
  misc_feature: GYAE6OF01DVA4E.48.19.B08.1.454.CMB.1.raw
  modified_base (296)..(300): a, c, t, g, unknown or other
  misc_feature (296)..(300): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaaggctcgccccctcggtcactctcgttcccaccctcctctatgtatactctgagcggctggcaaggcgcatagnnnnn

SEQ ID NO: 95896 - DNA, 299 bp, Homo sapiens
  misc_feature: GYAE6OF01B12ZY.48.19.B08.1.454.CMB.1.raw
  modified_base (295)..(299): a, c, t, g, unknown or other
  misc_feature (295)..(299): n is a, c, g, or t
tcagagtatacatacacgaccggtgctcgatttagtgagtcagtaaggggccctcaggggtccctgatcgcttctctggctccaagtctggcaacacggcccccctgaccatctctgggctccaggctgaggatgaggctgattattactgctgctcatatgcaggcagctacacttgggtgttcggcggagggaccaagctgaccgtcctaggtcagcccaaggctgccccctggtcactctgttccccgccctcctctatgtatactctgagcgggctggcaaggcgcatagnnnnn

SEQ ID NO: 95897 - DNA, 298 bp, Homo sapiens
  misc_feature: GYAE6OF01BA526.48.19.B08.1.454.CMB.1.raw
  modified_base (285)..(285): a, c, t, g, unknown or other
  misc_feature (285)..(285): n is a, c, g, or t
  modified_base (291)..(298): a, c, t, g, unknown or other
  misc_feature (291)..(298): n is a, c, g, or t
tcagagtatacatacacgaccggtgctcgatttagtgagtcagtaagggccctcaggggtccctgatcgcttctctggctccaagtctggcaacacggcctccctgaccatctctgggctccaggctgaggatgaggctgattatactgctgctcatatgcaggcagctacacttgggtgttcggcggagggaccaagctgaccgtcctaggtcagcccaaggctcgcccctggtcactctgttcccacctcctctatcgtatactctgagcggctggcaaggcncatagnnnnnnnn

SEQ ID NO: 95898 - DNA, 597 bp, Homo sapiens
  misc_feature: GYAE6OF01B6Q48.48.19.B08.1.454.CMB.1.raw
  modified_base (223)..(223): a, c, t, g, unknown or other
  misc_feature (223)..(223): n is a, c, g, or t
  modified_base (327)..(327): a, c, t, g, unknown or other
  misc_feature (327)..(327): n is a, c, g, or t
tcagagtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatctcctgcacgtggaaccngcagtgatgttgtgtatactatgtctcctggtaccaacagccaccaggacaacgcccccaaatcatgatttatgatcgtacagtagcggccctgacgggtcccngactcgtcttctcgtcgcctcgaacgtctcggacaaccgccggtccctcccgtacgacctacgttccgtcgtcggtcctaccgacggtctaggacgagtggacggtcgtagtacttacgttacgtcgtcttcgcgttactagttacgtacgacgaggctacgtcctacgttcgttcggggttcggttcgggaccgggtaagggtcccgaacggtcccggtacggtacccgttaccggtacgggtaccgtaaccggtcccggtaaacccgg

SEQ ID NO: 95899 - DNA, 300 bp, Homo sapiens
  misc_feature: GYAE6OF01AGAZ9.48.19.B08.1.454.CMB.1.raw
  modified_base (294)..(300): a, c, t, g, unknown or other
  misc_feature (294)..(300): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaaggctcgcccctcggcactctcgttcccgcccttcctctatgtatactctgagcggctggcaggcgcatagnnnnnnn

SEQ ID NO: 95900 - DNA, 295 bp, Homo sapiens
  misc_feature: GYAE6OF01AXBRV.48.19.B08.1.454.CMB.1.raw
  modified_base (268)..(268): a, c, t, g, unknown or other
  misc_feature (268)..(268): n is a, c, g, or t
  modified_base (286)..(286): a, c, t, g, unknown or other
  misc_feature (286)..(286): n is a, c, g, or t
  modified_base (290)..(295): a, c, t, g, unknown or other
  misc_feature (290)..(295): n is a, c, g, or t
tcagagtatacatacacgaccggtgctcgatttagtgagtcagtaaggggccctcaggcgtttctaatcgcttctctggctccaagtctggcaacacggcctccctgacaatctctgggctccaggctgaggacgaggctgattattattgctgctcatatgcaggtgtactacgttgggtgttcggcagagggaccaagctgaccgtctaggtcagcccaaggcctcgcccctggtcactctcgttcccacctctcgtatgtatacnctgagcggctggcaggcnatgnnnnnn

SEQ ID NO: 95901 - DNA, 397 bp, Homo sapiens
  misc_feature: GYAE6OF01AYEGQ.48.19.B08.1.454.CMB.1.raw
  modified_base (155)..(155): a, c, t, g, unknown or other
  misc_feature (155)..(155): n is a, c, g, or t
  modified_base (168)..(168): a, c, t, g, unknown or other
  misc_feature (168)..(168): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (328)..(328): a, c, t, g, unknown or other
  misc_feature (328)..(328): n is a, c, g, or t
  modified_base (332)..(335): a, c, t, g, unknown or other
  misc_feature (332)..(335): n is a, c, g, or t
  modified_base (339)..(339): a, c, t, g, unknown or other
  misc_feature (339)..(339): n is a, c, g, or t
  modified_base (341)..(397): a, c, t, g, unknown or other
  misc_feature (341)..(397): n is a, c, g, or t
tcagagtatacatacacgaccggtgctcgatttagtgagtcagtaaggggcccgtcagggggtccctgatcgcttactctggctccaagtctggcaacaccggcctccctgaccatctctgggctccaggctgaggatgaggctgagttattacngctgctcatatcncaggcaggctacacgttgggtgttcggcgggaagggaccaagcgtcgaccgtccgtaggtcgagccccgtaaggcctcgccccccgtggtccacctctcgttccccaccctccgtctgtgtactctgtgagccggtntcgganaacggcgagtacagcgntcannnncagntnnnnnnnnnnnnnnnnnnnnnnnnnnnnnnnnnnnnnnnnnnnnnnnnnnnnnnnnn

SEQ ID NO: 95902 - DNA, 750 bp, Homo sapiens
  misc_feature: GYAE6OF01CNZ06.48.19.B08.1.454.CMB.1.raw
  modified_base (143)..(143): a, c, t, g, unknown or other
  misc_feature (143)..(143): n is a, c, g, or t
tcagagtatacatacacgaccggtgctcgatttagtgagtcagtaaggggggggtctcaggaggcagcactctcgggacgtctccaccatggcctgggctctgcctcctcctcagccctcctcactcgagggcacaggatccngggctcagtcctgccctgactcagcctcgctcgagtcggtccggtctccgtggacaggtcagtccacctatcctcctgctacgtcggaaccagctaggtgtattggttggtagttaatactatacgtcctcgtaggtaaccaacacgtaccaacccgacggaccaaaccgaaccccctaaatcatgtaactttatcggtatgtacaacggttaacgccgtcccgtacggtaccggggttcctagtcgtacgtcttaccgtcgtcggtactccgtaacggttcgacgggtacctaaccggccgtacccgtccctacggacccttcgtccgtcgggttaccggccttacccgtaggggtaccttaggggaacgtagggttaacggacggttaaccgtttaacgttacgttttaacgttaccgtcgggttaccgttacgaccctttaagtacgttacgttacggaaccggtaccggtagtaacccgtaacccgttacgggttaccggtttggggtacccgggtaacggggtccggggaaaacgtacccggtacggaccccggttaggaccccggtttacgacgggtaacccgccggtacccgtacccggg

SEQ ID NO: 95903 - DNA, 305 bp, Homo sapiens
  misc_feature: GYAE6OF01BZ77F.48.19.B08.1.454.CMB.1.raw
  modified_base (301)..(305): a, c, t, g, unknown or other
  misc_feature (301)..(305): n is a, c, g, or t
tcagagtatacatacacgaccggtgctcgatttagtgagtcagtaagggccctcagggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaaggcctcgccccctcggtcactctcgttccccaccttcctctatcgtatactctgacgcgggctggcaaggcgacagtagnnnnn

SEQ ID NO: 95904 - DNA, 621 bp, Homo sapiens
  misc_feature: GYAE6OF01BFM7E.48.19.B08.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (321)..(321): a, c, t, g, unknown or other
  misc_feature (321)..(321): n is a, c, g, or t
  modified_base (508)..(508): a, c, t, g, unknown or other
  misc_feature (508)..(508): n is a, c, g, or t
  modified_base (519)..(519): a, c, t, g, unknown or other
  misc_feature (519)..(519): n is a, c, g, or t
tcagagtatacatacacgaccggtgctcgatttagtgagtcagtaaggggggggtctcaggaggcagcactctcgggacgtctccaccatggcctgggctctgctcctcctcagcctcctcactcagggcacgaggatcctgggctcagtctcgccctgactcagcctcgctcagtcgtccggtctccgtggacngtcagtcactatctcctgcactggaaccngcagtgattggttggtagttaataactatcgttcgtcctaggtaaccaacacgaccaccgaggaccaaaaccgacccccaaatcagtagttaattanagtattgtacgtaagacggccgtcccgtacgtacgggtcctagactccgtcttctacgcgtacctacgtacgtcgtacgacgtaaccgccgtccctccgtagaccctatccgtcgtacggcctaccggagcgtaggacgtagtacggcgtattatacgtttactgtcgtctcgaacttcgaagtcgngaacgccgtanaacgttaccgttcggtacgggtttcggggacggttcggggaaccggacggtacccgtagtaccggtacgtacccggtagtccggaccgcccggcggtacccg

SEQ ID NO: 95905 - DNA, 736 bp, Homo sapiens
  misc_feature: GYAE6OF01DJSOM.48.19.B08.1.454.CMB.1.raw
  modified_base (273)..(273): a, c, t, g, unknown or other
  misc_feature (273)..(273): n is a, c, g, or t
  modified_base (321)..(321): a, c, t, g, unknown or other
  misc_feature (321)..(321): n is a, c, g, or t
tcagagtatacatacacgaccggtgctcgatttagtgagtcagtaagggggggtctcaggaggcagcactctcgggacgtctccaccatggcctgggctctgctcctcctcagcctcctcactcaggcacaggatcctggctcagtctgccctgactcagcctcgctcagtcgtccggtctccgtggacagtcagtccacctatctcctgctacgtaggaaccagcagtgtatggttggtgttaataactatcgtcctctacggtaaccaacncgaccaacccgaggacctaaaccgacccctaaatcaagtgtatttagngtatcgtactaagtacgccgtccctcggtacgggtcctagtctccgtcttccgtcgtcggtacctaccgaagttcgtcggaacctaaccgtccggtccctcccgtacgtaaccctacgtccgttcgtcgggtccctaccggaggtctacggaaggtcgtacgggtaacgtcgtaacgttaacgttttacgtaccgttagtaccgttcgttaccgttaccgtaagtttcggaccgtacgttaacggtacccgaaggttacccgttaacggtcccgggttttaggggccggggttttaaacccggggacccggggaaacggtacccccgttaaacgggtccccggtttaacccgggtaaccggtttacccccggttaagggtaaccccgtaaccgggtacccccggtaaacccgggg

SEQ ID NO: 95906 - DNA, 573 bp, Homo sapiens
  misc_feature: GYAE6OF01A5G4J.48.19.B08.1.454.CMB.1.raw
  modified_base (270)..(270): a, c, t, g, unknown or other
  misc_feature (270)..(270): n is a, c, g, or t
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (458)..(458): a, c, t, g, unknown or other
  misc_feature (458)..(458): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
  modified_base (481)..(481): a, c, t, g, unknown or other
  misc_feature (481)..(481): n is a, c, g, or t
tcagagtatacatacacgaccggtgctcgatttagtgagtcagtaagggggggggtctcaggaggcagcactctcgggacgtctccaccatggcctgggctctgctcctcctcagccctcctcactcgagggcacaggatcctgggctcagtctgccctgactcagcctcgctcagtcgtccgggtctccgtggacagtcagtccaccatctcctgcctactcggaaccagcagtgatggttggtaggttatactatgtctcgtagacanacgacaccagaccaacnccccaatcatgtatntanatgtacgagtagccgccgtaccgtagggtccctgacgtcgtcttcctcgtcgtctaccgtagtcgtcgaccaccgtaccgtccctcctacgacctacgttccgtcgcggtctacggtagccgtaggagtgtaggagtcgtagtacttagttcncgtntcgtctcagtncgtatcgngtacgtcctaggtcggtggtaccgggtcggagggacgccggtaacggtcgacccggttacccgtcgttacggccaacccgcccgggtaaccg

SEQ ID NO: 95907 - DNA, 655 bp, Homo sapiens
  misc_feature: GYAE6OF01DBN0Q.48.19.B08.1.454.CMB.1.raw
  modified_base (332)..(332): a, c, t, g, unknown or other
  misc_feature (332)..(332): n is a, c, g, or t
tcagagtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcacgcctcgctcgagtcggtccgggtctccgtggacagtcagtccaccattcctccgtgaccacgtacggaaccagcgagtgtagttggttggtagttaataactagtcgtcctccgtacggtaaccaacgacgaccaccgaggaccaaccgaccccaaatcatgtattagngtatgtacagtacgccgtcctacggacgggtcctgactccgtcttcgtcgtcgtacctacgtagtcgacggaccgaaccgtcccggtcccttaccgacgtaactacttcccgttacggtcggtacctccggaggtccgaggaccggacgacggttcttaggtaacttttagttacgttcgcgttcgacttacgagttcggtgtacggtagggttaacgttcgttaacgggttcggggttacgtcgggaacgtacggggaaccgtaccgacggtcgtcccggtacgtcgtaacggtcaacccggtaccgaggcccgtaccccgg

SEQ ID NO: 95908 - DNA, 723 bp, Homo sapiens
  misc_feature: GYAE6OF01C4ZSZ.48.19.B08.1.454.CMB.1.raw
  modified_base (238)..(238): a, c, t, g, unknown or other
  misc_feature (238)..(238): n is a, c, g, or t
  modified_base (387)..(387): a, c, t, g, unknown or other
  misc_feature (387)..(387): n is a, c, g, or t
tcagagtatacatacacgaccggtgctcgatttagtgagtcagtaaggggggggtctcaggaggcagcactctcgggacgtctccaccatggcctgggctctgctcctcctcagcctcctcactcagggcacaggactccgtgggctcagtctcgccctgactcacgcctcgctcaggtcgtccgggtctccgtggacagtcagtccacctatcctccgtgcctaacgtacggaaccngctaggtcgagttcggttggttagttaactaacgtgtcgtcctccgtacggtaaccaacacgccgaaccgaggaacccaaccgtaccccaaactcctatcgttattacgtgtatcgtacgacgtacggccgtaccgtcggtacggtccngtacgtcgtcttctacgtcgtactcgtacgtcgacgccaacggtccgtcctaccgttgaacccttcgtccgttcggtaccggaccgttaccgtacgggtacggttacggacggtaacgtcgggtaacggtacgttagttaacctttacgttacgtcgttcgtcgtaaccgttcgtaacgtcgtaccggtacgacggtttacgaacgtaccggttaacggttccgggtttcggggacggggttaaccggggtcgggtaaaccggtccgttaaacgggtccggttaccgtacccgggttaacggtcccggtaaccgccgggtaacccggtacccgggg

SEQ ID NO: 95909 - DNA, 978 bp, Homo sapiens
  misc_feature: GYAE6OF01B78FH.48.19.B08.1.454.CMB.1.raw
  modified_base (215)..(215): a, c, t, g, unknown or other
  misc_feature (215)..(215): n is a, c, g, or t
  modified_base (236)..(236): a, c, t, g, unknown or other
  misc_feature (236)..(236): n is a, c, g, or t
tcagagtatacatacacgaccggtgctcgatttagtgagtcagtaaggggggggtctcaggaggcagcactctcgggacgtctccaccatggcctgggctctgctcctcctcagcctcctcactcagggcacaggactccgtgggctcagttcctcgccctgacctcgacgcctcgctcagtcgtccggtctccgtggacagtcacgtccacctntctcgtgcacgtacggaaccngcagtgagttggttggtagttaactaactagtcgtccgtaccgtacggtaacctaacgacgtaccaaccccgtagggtaacccaaaacccggtcccccctaaaaactccgtaagtttacgttaaagtttttaacgcggttaacgttcggttaaccgtaagggttaaacccgggtccccggtaccccggtttacgggtaacccgggggtttacccctacggttaacccgttcccggttacccgttttaccggtacccggttacgggtacccccgtttaacccggtaaacggggtttcccggttaacccgggaaaccccgttaaaccccggtacccccgggttaccccctttaacccccgggttacggtaaaccccgtttaccgttacccggtttaccggggttaccggggttacccctaaccccgggtaacgggttccggttaaacgggtaaccgggtggttaaaccggggtacggtaaccgtttaacggttaacgttttacccggtttaaggttcccgtacggtttccgttacccgtttaacgtaaccggttaggttccggaaaccggttacggacccgtttaacccggtaccgttaaaccgggttcccggggttttaaacggggttccgggttaacccggggaaccggggtaaaccggttaccgtacccggttccgggttaaccccgtaccggtttaccggaacccggtacccggtaaccggtacccgggttaaccccggg

SEQ ID NO: 95910 - DNA, 345 bp, Homo sapiens
  misc_feature: GYAE6OF01CB2OD.48.19.B08.1.454.CMB.1.raw
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
  modified_base (333)..(345): a, c, t, g, unknown or other
  misc_feature (333)..(345): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattacttactgctgactcatatgcaggcagctacacgttgggtcgttcgggcggaggaccagtctcgaccgtcctaggtaccacgaccgaacggtcctccggccccctcggtcctaccttcctccgttccccgtccctccttctagttctacttaactcctagnggcggtntcgggacaggcncgttanagnnnnnnnnnnnnn

SEQ ID NO: 95911 - DNA, 909 bp, Homo sapiens
  misc_feature: GYAE6OF01C919U.48.19.B08.1.454.CMB.1.raw
  modified_base (289)..(289): a, c, t, g, unknown or other
  misc_feature (289)..(289): n is a, c, g, or t
tcagagtatacatacacgaccggtgctcgatttagtgagtcagtaaggggggggtctcaggaggcagcactctcgggacgtctccaccatggcctgggctctgctcctcctcacgcctcctcactcgaggcacgaggtactcgtggctcgtacgtccgtcgtacccgtagactacgcgtcctcgtcctacgtacggttccgggttcccgggttccttccggtacggaaccgtacgtacgtaaccgtaccaaccttcgttcccttccgtcgtacctaacgtacggaaccncggacgttagtagttgttcggtttacgggttacgttaaacttaaacgtgtttccggttcccgtaccggttttaaccggaaacccaacgtaccgaacccaaccggtaaacggaaccccaaaacccccggtaaccccaaaacgttctaaagttcgtttaatttaccgagtactacgtacgaacggtaccgcccggtccgagggttccggtctagtcgtccgttcgttcgcgttacgtcgtacggtaccgtcgtaccgaaaccacgtaccccgttccacgtacgtaccttcgtccgtcggtaccgtacctaccggtcgtacggtacggtacgcggttaggaccgtttactaggtttacttaacgttcgtacgtcgttaccgacgttaccgttaaggtccgtcgggtaaacccggtacgttaaccggtttacccggttaaaacccttttaaccggggggttccggggttttttaccggggggaacccgggggttttacccggggaaacccggggtttaaacccgggtaaccccggtacccgtttaccgggttaaccccggttaccccggttttaacggaacccgggtaccccgttaaacccggggtaccccgggtttaccccgg

SEQ ID NO: 95912 - DNA, 939 bp, Homo sapiens
  misc_feature: GYAE6OF01APUNA.48.19.B08.1.454.CMB.1.raw
tcagagtatacatacacgaccggtgctcgatttagtgagtcagtaagggggggggtctcaggaggcagcactctcgggacgtctccaccatggcctgggctctgcctcctcctcacgcctcctcactcgagggcacgaggactccgtgggcctcgagtcctcggcccctagacctccgacgtccctccgctcgaggttcggtcccgggtcctccgtaggactacggtccggtaccaccgtacgtccgtcctacggacctaaccggtacgggaaacccacgggtaccgtaacggttaacgtactttacgggtttcgggtacgttaacctttaaaccgttaaccgttttccggtaccgtttaccggttaccggtaaaccctaaacgtaccgttacccgaacccgtaacggtaacccgtaaaaccccgtaccccggtaacggttacctttaaacgttttaacgtttacgtaacggtaccgttacgggtaaccctaaccgggtaaccgggtccccgggttaccccggggttacccgggggttacccttcgggtaaccgttcccggttccgtttaccgtccggttacccggttaccgtaacccggtaacgttcccggtaccggtaacccgtaacccggtacccggtacccgtacccgtaaccgtaccgttaccggttccgtccgggtaccggtaccgtaccggtacggtcgtaaaccggagtaccgtacgggtactacgtttaacgttacgtttaccgtcgtccgttcgttacgtttacctttaacgtttccgttttacgtttccgttttgtaccggttaccgggtacgtaccggtacgtaccggtaccttccggttaccgtcgtacccggacccgtaccggtaacccgccctaccgttcgtaccgtacccgtacgttcccggtcccctacccgtcccttaacg

SEQ ID NO: 95913 - DNA, 652 bp, Homo sapiens
  misc_feature: GYAE6OF01AOWOR.48.19.B08.1.454.CMB.1.raw
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (465)..(465): a, c, t, g, unknown or other
  misc_feature (465)..(465): n is a, c, g, or t
  modified_base (484)..(484): a, c, t, g, unknown or other
  misc_feature (484)..(484): n is a, c, g, or t
  modified_base (640)..(640): a, c, t, g, unknown or other
  misc_feature (640)..(640): n is a, c, g, or t
tcagagtatacatacacgaccggtgctcgatttagtgagtcagtaagggggggggtctcaggaggcagcactctcgggacgtctccaccatggcctgggctctgctcctcctcacgccctcctcactcgagggcacaggctcctgggctcagtctcgccctgactcagcctcgctcagtcggtccgggtctccgtggacngtcgacgtccaccatcctcctgaccacgtagaaccancagtcgagttggttcggttagttaactacgtacttcgttcctacgtcggtaaccaacgtacgtaccacccgaggacccaaaccgaccccaactcattacgtaatttcgtagactcgtactaacggcggtccgtccgtcggtaccgggtcctagtacgttccgtcttcccgtcgtcggtacctaccggtacgtcgtacgaccgaccgtaccgtccctccgacgtacctntcgtccgtggtcctaccgngggtccgtaggtcgtagtacggtcgtaacgtcgttaactttcgtccggtctacgttcgtactacgtacgttgcggtacgacgtccgtagtccgtacggttcggtcgggtcggtcgggaggtcggaacgtctccgtaccgggtctacggccggtacncggaccgtccgg

SEQ ID NO: 95914 - DNA, 820 bp, Homo sapiens
  misc_feature: GYAE6OF01E1ST7.48.19.B08.1.454.CMB.1.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
tcagagtatacatacacgaccggtgctcgatttagtgagtcagtaagggggggtctcaggaggcagcactctcgggacgtctccaccatggcctgggctctgctcctcctcagcctcctcactcagggcacaggatcctgggctcagtctgccctgactcagcctcgctcagtgtccggtctcgtggacagtcagtcaccatctcctgcactggaaccngcagtgatgttggngttatactatgtctctgtaccacagccaccaggacaaacgcccccaaatcatgtattatgatgtacaagtaacgccgccctcgacgggtccctgactcgtcttcgtcgtcgcctaccgtaacgtcgtacgggaccctaaccgaccggtcccctacccgtacgaaccctacgttcccgttaccgtcgggtaccctcccggtaacgggtcttaacggaaacgtacgttaccggacggttacccgttaggtaacttttacgtttaaccgttcggttcctttacgttttaccgtttaacgtttttttaaccgttaaaccggtttttttttccccgtttttttaggtttacccggtttaacccggggttaaccgtttaccgggggtaaacccccgggtttaaccgggttacccccgttaaacccccggggtttttaccccggttaaaccggggttaccccgtaaaccccgggtaacccccccgggttaaaacccgggtaacccccccccgttaaaaaccccccccggttacggtttaacccccggttaacccccttaaacccggttttccccggttttaacccccccccggg

SEQ ID NO: 95915 - DNA, 680 bp, Homo sapiens
  misc_feature: GYAE6OF01AIFOI.48.19.B08.1.454.CMB.1.raw
  modified_base (330)..(330): a, c, t, g, unknown or other
  misc_feature (330)..(330): n is a, c, g, or t
tcagagtatacatacacgaccggtgctcgatttagtgagtcagtaagggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggaccagtcagtccacctatcctcctgccacgtcggaaccagcgagtgattcggttggtcgttaataactagtcgtcctccgtaggtaccaacgacgtccacccgacggaccaaaccgcccccaaactcatgtactttangacttcgtacgaagtacggccggtaccctcggtaccgggtccctgacgttccgtccttccgtcgttcggtcctaccgtacgttccgtacggaccgtaaccgcccgtccctccgtacgtacctacgttccgttcgtaccgggtccctccggaggtccgtagggacggtagtacgggtacggtcgttaacgtactttaccgtacgtcgtacgtcgtactaccgtagtacgtcgaccgtaggcctaacggtcctcggttacggttggggtacccgggtcgggacgggaaccggtacccgaggtacccgtaccgtacccgttacggaacggtccacccgggtcccgtaaccggg

SEQ ID NO: 95916 - DNA, 580 bp, Homo sapiens
  misc_feature: GYAE6OF01A47KR.48.19.B08.1.454.CMB.1.raw
  modified_base (321)..(321): a, c, t, g, unknown or other
  misc_feature (321)..(321): n is a, c, g, or t
  modified_base (363)..(363): a, c, t, g, unknown or other
  misc_feature (363)..(363): n is a, c, g, or t
  modified_base (462)..(462): a, c, t, g, unknown or other
  misc_feature (462)..(462): n is a, c, g, or t
tcagagtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctcgccctagactcacgcctcgctcagtcgtccgggtctccgtggacaggtcagtcaccatctcctgccacgtcggaacctagcagtgattggttaggtgttaataacgtatcgtctctacgacacacgacaccagacaacgacccaatcgatagtacttatagtactcganacgtaacgccgtacctacgtacggtcctagacgtcgtcttcngtcgacgtcaacgtcgacgaccaacgacgcctcctagacctactcgtcgtcggtacctcgaacggtctaggaccgtatcgagtactagtattacgttcngtacgcgtactacgacgtatcggcacgacgtacacgttacgtcggttacggtcggtaccggagggaaccgaacgaggtcctaccggtaccgtactaagggtacccacggccgtaacgg

SEQ ID NO: 95917 - DNA, 419 bp, Homo sapiens
  misc_feature: GYAE6OF01BO6DL.48.19.B08.1.454.CMB.1.raw
  modified_base (294)..(294): a, c, t, g, unknown or other
  misc_feature (294)..(294): n is a, c, g, or t
  modified_base (373)..(419): a, c, t, g, unknown or other
  misc_feature (373)..(419): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacgttgggtgttcgggcggagggaccaaggctgaccgttccgtagggtccacgaccccgaaggtcctccggtccccccgtaggtcctaccgttccttccggttcccccaccccttcccgtnttaacttggtttaactaccgttccgtaggaacgggtccggggccttagggaccaaacgggggccaaccgtaagtaatgnnnnnnnnnnnnnnnnnnnnnnnnnnnnnnnnnnnnnnnnnnnnnnn

SEQ ID NO: 95918 - DNA, 290 bp, Homo sapiens
  misc_feature: GYAE6OF02FH52H.48.19.B08.1.454.CMB.1.raw
  modified_base (288)..(290): a, c, t, g, unknown or other
  misc_feature (288)..(290): n is a, c, g, or t
tcagagtatacatacacgaccggtgctcgatttagtgagtcagtaagggccctcagggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccccactgtcactctgttcccacctcctctatgtatactctgagcgggctggcaaggcgcatagnnn

SEQ ID NO: 95919 - DNA, 297 bp, Homo sapiens
  misc_feature: GYAE6OF02IRBU5.48.19.B08.1.454.CMB.1.raw
  modified_base (292)..(297): a, c, t, g, unknown or other
  misc_feature (292)..(297): n is a, c, g, or t
tcagagtatacatacacgaccggtgctcgatttagtgagtcagtaagggccctcagggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaaggctgccccctggtcactctgttccccgcctcctctatgtatactctgagcgggctggcaaggcgcatagnnnnnn

SEQ ID NO: 95920 - DNA, 301 bp, Homo sapiens
  misc_feature: GYAE6OF02F9W9C.48.19.B08.1.454.CMB.1.raw
  modified_base (292)..(301): a, c, t, g, unknown or other
  misc_feature (292)..(301): n is a, c, g, or t
tcagagtatacatacacgaccggtgctcgatttagtgagtcagtaagggccctcagggtccctgatcgcttctctggctccaagtctggcaacacggcctccctgaccatctctggctccaggctgaggatgaggctgattattactgctgctcatatgcaggcagctacacttgggtgttcggcggagggaccaagctgaccgtcctaggtcagcccaaggctgccccctcggtcactctgttcccgccctcctctatgtatactctgagcgggctggcaaggcgcatagnnnnnnnnnn

SEQ ID NO: 95921 - DNA, 518 bp, Homo sapiens
  misc_feature: GYAE6OF02HRQFZ.48.19.B08.1.454.CMB.1.raw
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
  modified_base (439)..(439): a, c, t, g, unknown or other
  misc_feature (439)..(439): n is a, c, g, or t
tcagagtatacatacacgaccggtgctcgatttagtgagtcagtaagggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggcctcgaggggtcccctggacttcgctttctctggctccaagtctggcaaacacggcctccctgaccatctctgggcctcagctgaggntgagctgattatangctgctcattatgccaggcagctaacncgtttgggcgtttcggcgggaagggtacccaaaggcgtcggtaacccggtccgtaacgggtcacggtcccctaacgggg

SEQ ID NO: 95922 - DNA, 300 bp, Homo sapiens
  misc_feature: GYAE6OF02FWT5W.48.19.B08.1.454.CMB.1.raw
  modified_base (288)..(288): a, c, t, g, unknown or other
  misc_feature (288)..(288): n is a, c, g, or t
  modified_base (294)..(300): a, c, t, g, unknown or other
  misc_feature (294)..(300): n is a, c, g, or t
tcagagtatacatacacgaccggtgctcgatttagtgagtcagtaaggggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccctggtcactctcgttcccacctcctctatgtatactctgagcgggctggcaaggcncatagnnnnnnn

SEQ ID NO: 95923 - DNA, 570 bp, Homo sapiens
  misc_feature: GYAE6OF02G31FI.48.19.B08.1.454.CMB.1.raw
  modified_base (221)..(221): a, c, t, g, unknown or other
  misc_feature (221)..(221): n is a, c, g, or t
  modified_base (236)..(236): a, c, t, g, unknown or other
  misc_feature (236)..(236): n is a, c, g, or t
tcagagtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccngcagtgatattggtncttacaactttgtctcctggtaccaacatcacccaggcaaagtccccaaggtcattatttatgatgtcactaagcggccctcggggtccctgactcgcttctctggctccaagtctggcaacacggcctccctgaccatctcgtcggctccgaggctgaagatcagtctgtattattactgtcttgttctattttctaagttttccttttttgtcgtttcggtaacttcgggtaccgtaggttccgaccgttccgttaggtccgtacgacccaacggcccaaccccgtacttaccgtacctaccttccgttccgttacccctacccttaccccg

SEQ ID NO: 95924 - DNA, 298 bp, Homo sapiens
  misc_feature: GYAE6OF02I5MJB.48.19.B08.1.454.CMB.1.raw
  modified_base (296)..(298): a, c, t, g, unknown or other
  misc_feature (296)..(298): n is a, c, g, or t
tcagagtatacatacacgaccggtgctcgatttagtgagtcagtaagggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaaggctcgccccctcggtcactctcgttcccaccctcctctatgtatactctgagcgggctggcaaggcgcatagnnn

SEQ ID NO: 95925 - DNA, 299 bp, Homo sapiens
  misc_feature: GYAE6OF02HFDL6.48.19.B08.1.454.CMB.1.raw
  modified_base (293)..(299): a, c, t, g, unknown or other
  misc_feature (293)..(299): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgagactgattattactgctgctcatatgcaggcagctacacttgggtgttcggcggagggaccaagctgaccgtcctaggtcagcccaaggctgccccctggtcactctgttcccaccctctctatgtatactctgagcgggctggcaaggcgcatagnnnnnnn

SEQ ID NO: 95926 - DNA, 301 bp, Homo sapiens
  misc_feature: GYAE6OF02GI29X.48.19.B08.1.454.CMB.1.raw
  modified_base (286)..(286): a, c, t, g, unknown or other
  misc_feature (286)..(286): n is a, c, g, or t
  modified_base (292)..(301): a, c, t, g, unknown or other
  misc_feature (292)..(301): n is a, c, g, or t
tcagagtatacatacacgaccggtgctcgatttagtgagtcagtaaggggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccctggtcactctgttcccacctctctatgtatactctgagcgggctggcaaggcncatagnnnnnnnnnn

SEQ ID NO: 95927 - DNA, 495 bp, Homo sapiens
  misc_feature: GYAE6OF02IMU98.48.19.B08.1.454.CMB.1.raw
  modified_base (219)..(219): a, c, t, g, unknown or other
  misc_feature (219)..(219): n is a, c, g, or t
  modified_base (294)..(294): a, c, t, g, unknown or other
  misc_feature (294)..(294): n is a, c, g, or t
  modified_base (322)..(322): a, c, t, g, unknown or other
  misc_feature (322)..(322): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
tcagagtatacatacacgaccggtgctcgatttagtgagtcagtaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctctgcactggaaccngcagtgatgttggtgttataactatgtctcctggtaccaacagcacccagcaaacgcccccaaatcatgatttangatgtcagtaagcgcctcgagggtcccngatcgcttctctgctcagtctgcacncgcctcctgaccntcntggctcnggctgagntgagctgattatacngctgctnatntgacaggcagcctactcgttgggtcggttcgggacgggacgggacccaggtcccgtacggacccgttacgcggtccaccggccctaacggg

SEQ ID NO: 95928 - DNA, 299 bp, Homo sapiens
  misc_feature: GYAE6OF02FSWRT.48.19.B08.1.454.CMB.1.raw
  modified_base (295)..(299): a, c, t, g, unknown or other
  misc_feature (295)..(299): n is a, c, g, or t
tcagagtatacatacacgaccggtgctcgatttagtgagtcagtaagggccctcgaggggtccctgagtcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaaggctgccccctggtcactctgttcccaccctcctctatgtatactctgagcgggctggcaaggcgcatagnnnnn

SEQ ID NO: 95929 - DNA, 736 bp, Homo sapiens
  misc_feature: GYAE6OF02G2S3Z.48.19.B08.1.454.CMB.1.raw
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
tcagagtatacatacacgaccggtgctcgatttagtgagtcagtaagggggggtctcaggaggtcggagcgactctcgggacgtctccaccatggccgtgggctctgctccgtcctcgagcctcctcacctcaggcacaggatcctgggcgtcagtcgtgccctggactcagcctcgcctcagtcgtccgggtctccgtggacaggtcgacgtccaccagtcctcgtgccacgtaggaaccngcagtcgagtgttggngttaataactagtgtcgtccgtagtaaccaacgtgcctaccgaggtaccaaaacgaccccaaacgtccaagttcgaactttacgagtacttacgtactaacggtaacgtccggtacccgttacgaacgggttccgtacggtacctccggtacctttcgtccgtcggtacttaccgtaacggttcgtaaccggaccctaaaccggtccggtaccccgttaccgtacgaaccctaccgtccgttacgtccgggtacccttccgtaacggtccgtaggtacggagttcggacggtactttagtaacgttacttaacgtcgttacttcggttaccttcgttaacgtttagttccgtacgttaccggtactaaccggttacgttaccgtacggtttacggtacggttaccggtacgggaaccgtaaccgtaccggtacgtacggtaaccggttcgtaaccggtaccgtaccgaccgtacccgg

SEQ ID NO: 95930 - DNA, 293 bp, Homo sapiens
  misc_feature: GYAE6OF02IAYZ2.48.19.B08.1.454.CMB.1.raw
  modified_base (290)..(293): a, c, t, g, unknown or other
  misc_feature (290)..(293): n is a, c, g, or t
tcagagtatacatacacgaccggtgctcgatttagtgagtcagtaaggggccctcagggtccctgatcgcttctctggctccaagtctggcaacacggcctccctgaccatctctgggctccaggctgaggatgaggctgattattactgctgctcatatgcaggcagctacacttgggtgttcggcggagggacaagctgaccgtctaggtcagcccaaggctgcccctggtcactctgttcccaccctcctctatgtatactctgagcgggctggcaaggcgcatagnnnn

SEQ ID NO: 95931 - DNA, 323 bp, Homo sapiens
  misc_feature: GYAE6OF02HC9WU.48.19.B08.1.454.CMB.1.raw
  modified_base (297)..(297): a, c, t, g, unknown or other
  misc_feature (297)..(297): n is a, c, g, or t
  modified_base (300)..(323): a, c, t, g, unknown or other
  misc_feature (300)..(323): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtctaggtcagcccaaggctcgccccctaggtcactctcgtcccaaccctcctcatgtatactctgagtcgggctggcaaggccgcatagngcnnnnnnnnnnnnnnnnnnnnnnnn

SEQ ID NO: 95932 - DNA, 576 bp, Homo sapiens
  misc_feature: GYAE6OF02IC0K9.48.19.B08.1.454.CMB.1.raw
  modified_base (220)..(220): a, c, t, g, unknown or other
  misc_feature (220)..(220): n is a, c, g, or t
  modified_base (259)..(259): a, c, t, g, unknown or other
  misc_feature (259)..(259): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
tcagagtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctctgcactggaaccngcagtgatgttggtgttatactatgtctctggtaccaangcacccagcaaacgcccaaactcatgattatgatgtcagtaacgcgcctcgacgggtcctgactcgcttctctgctcaagtctgcacncgcctcccgngaccatctcgtcggcctcgaggtcgtaggaggtatgggagtccgtaggtaattttacttacgtacggtcctgtccttcaagttacgtcgacgacggcaacgtacctacgtacgtttggggttcggtttcggggaccgggtaacggggacccgtaacggtccgtaccgggtaacccggttcccgttaacgggtaccgtaacccgggcccgtaaacccggg

SEQ ID NO: 95933 - DNA, 302 bp, Homo sapiens
  misc_feature: GYAE6OF02GUIBO.48.19.B08.1.454.CMB.1.raw
  modified_base (289)..(289): a, c, t, g, unknown or other
  misc_feature (289)..(289): n is a, c, g, or t
  modified_base (295)..(302): a, c, t, g, unknown or other
  misc_feature (295)..(302): n is a, c, g, or t
tcagagtatacatacacgaccggtgctcgatttagtgagtcagtaaggggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctcgccccctggtcactctcgttcccaccctctctatgtatactctgagcgggctggcaaggcncatagnnnnnnnn

SEQ ID NO: 95934 - DNA, 302 bp, Homo sapiens
  misc_feature: GYAE6OF02GUU2Z.48.19.B08.1.454.CMB.1.raw
  modified_base (270)..(270): a, c, t, g, unknown or other
  misc_feature (270)..(270): n is a, c, g, or t
  modified_base (297)..(302): a, c, t, g, unknown or other
  misc_feature (297)..(302): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctagtcagccaaggctcgccccctcggtcactctcgttcccaccctcctctatgtatactntgagcgggctggcaaggccgtcatagnnnnnn

SEQ ID NO: 95935 - DNA, 657 bp, Homo sapiens
  misc_feature: GYAE6OF02IPL0R.48.19.B08.1.454.CMB.1.raw
  modified_base (273)..(273): a, c, t, g, unknown or other
  misc_feature (273)..(273): n is a, c, g, or t
  modified_base (308)..(308): a, c, t, g, unknown or other
  misc_feature (308)..(308): n is a, c, g, or t
tcagagtatacatacacgaccggtgctcgatttagtgagtcagtaagggggggtctcaggaggcagcactctcgggacgtctccaccatggcctgggctctgctcctcctcagcctcctcactcagggcacaggatccgtggctcagtctgccctgactcagcctcgctcagtcgtcccggtctccgtggacctagtcagtccacctatcctcctgcacgtcggaaccagcagtgattggttcggtagttataactgtcgtctctgtaccacngcaccgagacaaccgccccaatcgatagtatttangatgtacagtaacgccgtaccctacggacgggtcctagaccgtcgtctttccgtcgtcgaccgttaccgtaagtcgtacgacctaaccgtccggtaccttcccgacgacctactcgtaccggttcggtctaccggagggtcccgttaggaacggtacgtagggtaccggtactaggttaacctttaacgttccgtaccgtacgttacggtacctacgttaacgtacgtcggaccgtaaggccctaaggtaccttaacgtcggtttcggggtcgttaaccgggggaccgacgggtaactacggttccgtaccgttaccggtaccgtacgggtacccaggaacccgtacgg

SEQ ID NO: 95936 - DNA, 304 bp, Homo sapiens
  misc_feature: GYAE6OF02GBXMB.48.19.B08.1.454.CMB.1.raw
  modified_base (182)..(182): a, c, t, g, unknown or other
  misc_feature (182)..(182): n is a, c, g, or t
  modified_base (297)..(304): a, c, t, g, unknown or other
  misc_feature (297)..(304): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacttgggtnttcggcggagggaccaagctgaccgtcctaggtcagcccaaggctcgcccctcggtcactctcgttcccgccctcctctatgtactactctgagcgggctggcaaggcgcatagnnnnnnnn

SEQ ID NO: 95937 - DNA, 300 bp, Homo sapiens
  misc_feature: GYAE6OF02FTPJD.48.19.B08.1.454.CMB.1.raw
  modified_base (293)..(300): a, c, t, g, unknown or other
  misc_feature (293)..(300): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagttacacttgggtgttcggcggaggaccaagctgaccgtctaggtcagcccaaggctgcccctcggtcactctgttcccaccctcctctatgtattacctctgagcggctggcaaggcgcatagnnnnnnnn

SEQ ID NO: 95938 - DNA, 665 bp, Homo sapiens
  misc_feature: GYAE6OF02IHTIW.48.19.B08.1.454.CMB.1.raw
tcagagtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcacatctctgcactgaaccagcagtgatgtggtgttataactatgtctcctggtaccaacagcaccaggacaaacgcccccaaactcatgtattatgatgtcagtaagccggcctcgagggtcctgactcgcttctcgtggctcaagtcgtacgacaaccgaccggtcccttccccgtagacccctattacccgtcgttacggggccctaccgacgggtctacggaacgggtacgtggaacggtcctaggttaaacttttacgttaacgtcggtacgttcgtaccgtttaccaagtttaacgtcggaccgtaacggggacctaacgggtacccttaaccgtacggttttaggggggtttccggtttaccgggggaccggggtaaggggtaaccccgaaaggttcccggttaccgggtaacccggtttaccccggtaagggttcccaccgggtaccccgaaaccgggg

SEQ ID NO: 95939 - DNA, 655 bp, Homo sapiens
  misc_feature: GYAE6OF02FGFDO.48.19.B08.1.454.CMB.1.raw
  modified_base (300)..(300): a, c, t, g, unknown or other
  misc_feature (300)..(300): n is a, c, g, or t
tcagagtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagccacccaggacaaacgcccccaaatcatgatttangatgtcagtaacgccgcctcgacgggtccctgactcgcttctctcggctaccgaagtcctaggaccaaaccgaccggtccctcccgtagacccgtatccgttacgtcggggtaccctcccgaacgggtccttaggacggtactgggaacggtccttaggtaactttaacgtttacctggtccgttagtacctttacgtaagttaacgtcggtaccgtagggtccagttaccgttaaccgttacggtttcgggggtacggtttaccgggggaccggtaacggggaaccctaacgggtcccgtaccgggtaccccggtttacccgtaacgggtacccaccggtaccccgtaaccggg

SEQ ID NO: 95940 - DNA, 302 bp, Homo sapiens
  misc_feature: GYAE6OF02F3DHQ.48.19.B08.1.454.CMB.1.raw
  modified_base (296)..(302): a, c, t, g, unknown or other
  misc_feature (296)..(302): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaaggctcgccccctggtcactctcgttcccaccctcctctatgtatactctgagcgggctggcaaggcgcatagnnnnnnn

SEQ ID NO: 95941 - DNA, 346 bp, Homo sapiens
  misc_feature: GYAE6OF02GWQWZ.48.19.B08.1.454.CMB.1.raw
  modified_base (263)..(263): a, c, t, g, unknown or other
  misc_feature (263)..(263): n is a, c, g, or t
  modified_base (281)..(281): a, c, t, g, unknown or other
  misc_feature (281)..(281): n is a, c, g, or t
  modified_base (299)..(300): a, c, t, g, unknown or other
  misc_feature (299)..(300): n is a, c, g, or t
  modified_base (304)..(346): a, c, t, g, unknown or other
  misc_feature (304)..(346): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaaggcctgccccctggtcacgtctcgttcccacctcctctancgtatctctgagccgggntggacaaggcgcagtagnncatnnnnnnnnnnnnnnnnnnnnnnnnnnnnnnnnnnnnnnnnnnn

SEQ ID NO: 95942 - DNA, 681 bp, Homo sapiens
  misc_feature: GYAE6OF02FI8PA.48.19.B08.1.454.CMB.1.raw
  modified_base (224)..(224): a, c, t, g, unknown or other
  misc_feature (224)..(224): n is a, c, g, or t
  modified_base (315)..(315): a, c, t, g, unknown or other
  misc_feature (315)..(315): n is a, c, g, or t
tcagagtatacatacacgaccggtgctcgatttagtgagtcagtaagggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtcagtcacatctcctgcacgtggaaccngcagtcagtgttggtagttactaactatcgtctccgtaggtaccaactacgccaaccgaggccaaacgcccccaaatcactagtactttangtattgtacgaagtaacggtccggtaccgtacggtaccggggtccctggactccgtctttccgtacgttcggccttaaccgacgtcgtacgtaccgaaaaccggtccggtccctacccgtcgtaaccctacgtaccgttccggtacgggcccttaccggaacgggtccgtacggtaggacgttagggacggtacgtacgttacttacgtttcgtacgtccgttacgtctacgttagtacgtcggtacgacgtcgtacgttacgtacgttacggttcgggttacggttacggggacggtaaccgggacgtacggtacggtacggtacccggtacggttacccggtacgtaccggtccgtaacccggg

SEQ ID NO: 95943 - DNA, 653 bp, Homo sapiens
  misc_feature: GYAE6OF02HWPCD.48.19.B08.1.454.CMB.1.raw
  modified_base (221)..(221): a, c, t, g, unknown or other
  misc_feature (221)..(221): n is a, c, g, or t
  modified_base (264)..(264): a, c, t, g, unknown or other
  misc_feature (264)..(264): n is a, c, g, or t
  modified_base (341)..(341): a, c, t, g, unknown or other
  misc_feature (341)..(341): n is a, c, g, or t
  modified_base (390)..(390): a, c, t, g, unknown or other
  misc_feature (390)..(390): n is a, c, g, or t
tcagagtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagtgatgttggtggttaataactatgtctcctggtaccaanagcacccaggcaaacgcccccaaactcatgatttactgtatcgtcagtaaacgccggcctcgaggggtccctgtacnccgtcttcttctcggctcctaaacgtcgtggacctaacgaccggtcccncccgtacggaaccctagtcccgttcgttaccggggtcctacccggtaggccggtacggtacgggtaaatcggggtaacggtcgttaacggtactttactttaaaccgtgttccgtccggtacctacgtaacgttagtcgtacgaacggtaccaacgtactaccgtacggtttcggggttcgtaccggggtccggaccggggtaacctaacggtcctacggtacccgttaccgtacggggttacaccggtaccccgtaaccggg

SEQ ID NO: 95944 - DNA, 360 bp, Homo sapiens
  misc_feature: GYAE6OF02I5OZS.48.19.B08.1.454.CMB.1.raw
  modified_base (309)..(309): a, c, t, g, unknown or other
  misc_feature (309)..(309): n is a, c, g, or t
  modified_base (314)..(360): a, c, t, g, unknown or other
  misc_feature (314)..(360): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacgttgggtgttcggcggaggaccaagctgaccgtctaggtcagcccaaggctcgcccctggtcactctcgtccccaccctctacctatgtaacttactctagacggcgggtcgtggcgaaacggcgacaagtagncgatnnnnnnnnnnnnnnnnnnnnnnnnnnnnnnnnnnnnnnnnnnnnnnn

SEQ ID NO: 95945 - DNA, 662 bp, Homo sapiens
  misc_feature: GYAE6OF02FQYH6.48.19.B08.1.454.CMB.1.raw
tcagagtatacatacacgaccggtgctcgatttagtgagtcagtaagggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggacagtcagtcaccatcctcctgcactaggaaccagctaggtgattggttggttggttaataactatgtctcctaggtaccaactatccaaccaggaccaaacgtccccaaggtctaattattatgtatgtcactacgccggccgtccgggtcctgactcgtcttctcgtgtcctacgtacgtcgtgaccaacgaccggtccctccgtcgaacctcgtccgttccgcggtacctccggacggtctacggaacgtcgtacggacgtcttagtaattttacgtacgtgtacctttgttactttacgttttaccttacgttttttcgttttttcggtaccgtttacggggaacttcggggttaaccgtacgttccgtacccgtttacggaccgttcgaacccgtacccggtaacgtacccccgtaaccgtcgtttccgtaccttaccgtcccgtttacccgtcccccgttacccg

SEQ ID NO: 95946 - DNA, 300 bp, Homo sapiens
  misc_feature: GYAE6OF02HTC36.48.19.B08.1.454.CMB.1.raw
  modified_base (296)..(300): a, c, t, g, unknown or other
  misc_feature (296)..(300): n is a, c, g, or t
tcagagtatacatacacgaccggtgctcgatttagtgagtcagtaagggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaaggctcgccccctggtccactctcgttcccaccctcctctatgtactactctgagcggctggcaaggcgcatagnnnnn

SEQ ID NO: 95947 - DNA, 719 bp, Homo sapiens
  misc_feature: GYAE6OF02HXOTU.48.19.B08.1.454.CMB.1.raw
  modified_base (212)..(212): a, c, t, g, unknown or other
  misc_feature (212)..(212): n is a, c, g, or t
  modified_base (251)..(251): a, c, t, g, unknown or other
  misc_feature (251)..(251): n is a, c, g, or t
  modified_base (455)..(455): a, c, t, g, unknown or other
  misc_feature (455)..(455): n is a, c, g, or t
tcagagtatacatacacgaccggtgctcgatttagtgagtcagtaaggggggggtctcaggaggcagcactctcgggacgtctccaccatggcctgggctctgctcctcctcagcctcctcactcgagggcacgaggactccgtgggctcagtctcgccctgacctcacgcctcgctacagtcgtcccggtctccgtgacagtcagtcaccntctctgcacgtagacagcagtgacttgttggtagttaanacttagtcgttctaccgtacggaaaccacgacgacccaaccggacgaaccaaaacccgtaccccaaacttcgaattacgtaatttagtactaacgtcgtacgtaacggtaaccgccgtaaccgtggtaccgggtcctagtacctcggtctcgtacgcgtacctacgaacgttcgacgtacaaccggtaccgtcccgtaccgtanaccgtaccgttcgttaccgggtcgtacccgtacggtacggtcgtaacggagggttacgacgggttacggtagttaacggttaactttaactcggtacggttacttaccgtacgtactaccggttagtacccgagttacccggacttaccggtaccttaccggttacggtttacgggtccggtaccgggggaaccgtaccgggaaacgttccggaccgtaccggttaccgtaaccggtcccggtatacccgtcccggtaaccggg

SEQ ID NO: 95948 - DNA, 799 bp, Homo sapiens
  misc_feature: GYAE6OF02H05O8.48.19.B08.1.454.CMB.1.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
tcagagtatacatacacgaccggtgctcgatttagtgagtcagtaagggggggggtctcaggaggcagcactctcgggacgtctccaccatggcctgggctctgctcctcctcagcctcctcactcagggcacaggactccgtggctcagtctgtcctgactcagcctcgctcaggtcggtccggtctaccgtggactagtcacgtcacctattcctcngctacgtcggaaccngacgtaggtnattgggttggttaggttaatttaacgttttcgccttaccgtacggtaacccaacgtcttacccgaaccgaggaaacccgtaaaccgtaaccccgtaaggttaccctttaattttaaccgttagtacggttaacgttccgtaaccgtaaccggttaaccgggtcccgggttaacccccggggttccgggttaccctaggaccggttaccgtcgttttaccgtcgtacccggtcttaccgacgtttccggtacggaccctaaccggtccgttcccctacccgtacaccttaccggtttacctcgggtcggtcctacgggtacgtcgtaacgtaacgtacgtaccggacggttcttaacgtttagtttaccttcgtccgttagtttactacgttttacgtttaacggttacgttttttaccggtttcttacggttaaccgggtcgtaccgggtacgttacgcccgtttacgtaccggtacggtaccgaaccgtacccggtaaccgaaccccttacgcttaacggttctaccctaccggttccccgttcccgactttac

SEQ ID NO: 95949 - DNA, 791 bp, Homo sapiens
  misc_feature: GYAE6OF02JH561.48.19.B08.1.454.CMB.1.raw
tcagagtatacatacacgaccggtgctcgatttagtgagtcagtaaggggggggtctcagggaggcagcactctcgggacgtctccacatggcctgggctctgctcctcctcagcctcctcactccagggcacaggactccgtgggctcacgtctcgcccttaggctacgacgcctcgcctacacgtggtcccgggtctccgtcggacaggtcacggtccaaccgtacttccgtccctaggcctacgtagaacccgagccgtaagtgtacgttcggttaggttacggttaataacgttagttcgtaccttaccgttaggtaacccaagcggtaccaaccccgtacggaaccctaaacccggaaccccctaaacttaccgtacggtaacgttaacgttttacacggttaacttacgaccgtaaaggttaaccggtcccgtaaccgtacggggtaaccggtcccgtacgtcgttaccgccgttttccgtacggtcgtaccggttacctaacggtcgtaccgtaaccgtaacggtaccccggtcctacccgtacgtacccggtacttacccggttcggtccggtaccgtaccgtacggtaccggtacgggacgttacggtaacggtacggtacgttacggttaattcgttacgtcggtactcgtacgtaacgtacgtagcgttacgaaggtcctagttcgtaacgttcggttcgggaacggttgggtaccggtaacggtccgtacgtacgttaccgtaccggttaccgcggttaccgacgggtacccgtaccgg

SEQ ID NO: 95950 - DNA, 342 bp, Homo sapiens
  misc_feature: GYAE6OF02FV4XJ.48.19.B08.1.454.CMB.1.raw
  modified_base (315)..(342): a, c, t, g, unknown or other
  misc_feature (315)..(342): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcacgacccaggcctcgcccccgtcggtctacgtctccgttccccgccctcctctctgtactactctgacggcggcgtggacgaaggccgacaagtacgtnnnnnnnnnnnnnnnnnnnnnnnnnnnn

SEQ ID NO: 95951 - DNA, 693 bp, Homo sapiens
  misc_feature: GYAE6OF02GI2BO.48.19.B08.1.454.CMB.1.raw
tcagagtatacatacacgaccggtgctcgatttagtgagtcagtaagggggggggtctcaggaggcagcactctcgggacgtctccaccatggcctgggctctgctcctcctcagcctcctcactcagggcacaggatcctgggctcgagtctgccctgactcagccctcgctcagttcggtccgggtctccgtggactgtcagtcaccatctcctgcacgtcggaaccagcagtgaattggttggtaggttaataactgttacgtctccgtacggtaaccaactagaccaacccgaggaccaaaaccgacccccaaactccgaattacgtaatttacgacgtaatcgtacgtacgtaacgccggcctaggaccgggttacctagacgttcgtacctttcgtcgtcggtcctaacgtaacgtcgtacggacctaaaccgtcccggtccctaccgtacgtaaccctcgttacccggtccggtacggtcccgtaaccgtaggggttcacggggtaacggtatacggggtaacgccgtttaagttaaccttaagtttaccgtggttacctcgtaccttaacgacgttaacggtcgaacgggtacgtacgtaacgtaccgtaccgttaggttacgggtcgtacgggacggaacggtaccaaggtctacggtccgtaggtacgacgtacgaccgtacg

SEQ ID NO: 95952 - DNA, 767 bp, Homo sapiens
  misc_feature: GYAE6OF02FFMJO.48.19.B08.1.454.CMB.1.raw
tcagagtatacatacacgaccggtgctcgatttagtgagtcagtaaggggggggtctcaggaggcagcactctcgggacgtctccaccatggcctgggctctgctcctcctcagcctcctcactcagggcaccgaggatcctgggctcgagttccaggcctgactcaggtccctgcctcagtcgtccgggtctcgtaggaccagtcaggtccactactcctaccgtgacacgtcggaaccagccgagtgattcggttggtacgttataacctgtcgttctaccgtcggaacctaacgacgaccaccgacggtaccaaccgaccccctaaacgtccgaacttcggtaactttacgtacgtacgttcggtactaacggtaacggtcccggtccccgtacgggtaaccgggtccttacggacgttacccggtaccgttccgtacgtccgggtacccgtaccgtaaccggttaccggtacgtacccggtaaaccgtcccggtacccgtacccgtaccgggtacctaccgtccgttcggttccggtacccgtaccgtacggggtcttacgggaacgtcgtacggtacgaccgttacggtacgttacgttactccgtcgttcgacgttacctaggtaactcggacgtaccgtacgacgtacctacgtacggttcggttaccggtaacggggtaccggaaccgggtaaccgttacggacccgttaccggtaccggttacccggtacggtacccgtaccggtacccggtacccgg

SEQ ID NO: 95953 - DNA, 303 bp, Homo sapiens
  misc_feature: GYAE6OF02FIDSD.48.19.B08.1.454.CMB.1.raw
  modified_base (297)..(303): a, c, t, g, unknown or other
  misc_feature (297)..(303): n is a, c, g, or t
tcagagtatacatacacgaccggtgctcgatttagtgagtcagtaaggggccctcaggggtccctgatcgcttctctggctccaagtctggcaacacggcctccctgaccatctctgggctccaggctgaggatgaggctgattattactgctgctcatatgcaggcagctacacttgggtgttcgggcggagggaccaagctgaccgtcctaggtcagcccaaggctcgcccctcggtcactctcgttcccaccctcctctatgtatactctgagcgggctggcaaggcgcatagnnnnnnn

SEQ ID NO: 95954 - DNA, 939 bp, Homo sapiens
  misc_feature: GYAE6OF02I9HF0.48.19.B08.1.454.CMB.1.raw
  modified_base (313)..(313): a, c, t, g, unknown or other
  misc_feature (313)..(313): n is a, c, g, or t
tcagagtatacatacacgaccggtgctcgatttagtgagtcagtaaggggggggtctcagggaggcagcactctcgggacgtctccaccatggcctgggctctgctcctccctacgacgtccctcctactaccgtacggacgggacaacggaaggtaccttccggtcggtcctacgtacgttaccgtaccgtacccgtacgtaaccgtaccgaccgtcccgtaccgtacctacggtacggttaccgggtaccggtccgtacggtacgacgtacgtcgaactaccaactctcctcgcgtacacgtaacgtaccngacgtagtataggttcggttagttagttaactagtcgtcgtcacgtacgtaacacgtcaccacgaacgtaccaacccgtaccaagtcagtaacgttaatcgacgtagtacgtaacgtaacggtaccgtcccggttaccggtacgggttaccgggtacctacggtaccgttccgttaccgttacgttcggtaaccgggttccctaaccgttttacggaccccgggttaacgtaaccccgttaacccgggttacccgggttaccccctttaaccggtaccgtaacccggttaaacccgtccggttttaacccgggacccggttaacccggtaccggttaaacccgggttcggttaaacggggttaacccgggtagggttaaccgggttacggttttaaccgttaaacggtttaccggttttaaacgtaccggttacggttaccgttaccggttaacgtaaccgttaacgttaccggtacggtaacggtaccgtaacgggtaccgttaggttaccgggttaggttcccgggttacgggttaacgggggaccggtaaacggtccgggtaacgtaccggttaccgtacggtttaccggtaaccgaccgggttaaccggccgttaaccccgg

SEQ ID NO: 95955 - DNA, 621 bp, Homo sapiens
  misc_feature: GYAE6OF01CQ1R1.49.6.A06.1.454.CMB.1.raw
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (253)..(253): a, c, t, g, unknown or other
  misc_feature (253)..(253): n is a, c, g, or t
  modified_base (299)..(299): a, c, t, g, unknown or other
  misc_feature (299)..(299): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcggtgtcgtttctaggtcggctaatttaaaggtgtcagtgtgaggtgcagctggtggactgtgggggagcgttggacngccgtgggggtcctgagctctctgngcagcctntggattcacctttagctagtttgccagtgggctgggccgccagtcnccgaggagggtggnggngtgtctacatagtagtgtagtagtactacacactactacgacacgacgtacgtacgacggacgtctacacctactcctaccgacgaacgtaactaactaacgaaacgaacgtaagttagttacgttacgtacgtaacgtaacgtagtacgacgtacgacgtacgacgacggaccggaacggaccgacggtacgtacgttacgttacgtacggtacggtaacggtaacggttacggtacggtacggtacgttacggttacgttacgttacgtacgtacggtaccgggtaccggtaacgggtaacgg

SEQ ID NO: 95956 - DNA, 539 bp, Homo sapiens
  misc_feature: GYAE6OF01DYQX1.49.6.A06.1.454.CMB.1.raw
  modified_base (300)..(300): a, c, t, g, unknown or other
  misc_feature (300)..(300): n is a, c, g, or t
  modified_base (428)..(428): a, c, t, g, unknown or other
  misc_feature (428)..(428): n is a, c, g, or t
  modified_base (466)..(466): a, c, t, g, unknown or other
  misc_feature (466)..(466): n is a, c, g, or t
  modified_base (482)..(482): a, c, t, g, unknown or other
  misc_feature (482)..(482): n is a, c, g, or t
  modified_base (494)..(494): a, c, t, g, unknown or other
  misc_feature (494)..(494): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtggtcgttttctaggtggctattttaaaaggtgtccagtgtgaggtgcagctggtggactcgtgggggaggcttggtacagcctggggggtcccctgagactctcctgtgcagcctctggattcacctttagctagtttgccatgggctgggtccnccaggctccgaggggaggggctggagtgggtctcaactattagcggtattggtactaccacatactacgcagactccgtgaacggccgcttcaccatcctccagagacaattccaagaactatggttntttctgacaaatgagcagcctagagacgccgaggaccncggacctatatactgnacgtaaagtcgngtgctaggtactagtttcgacttacgtggggccagggtaaacccg

SEQ ID NO: 95957 - DNA, 561 bp, Homo sapiens
  misc_feature: GYAE6OF01DMD5F.49.6.A06.1.454.CMB.1.raw
  modified_base (391)..(391): a, c, t, g, unknown or other
  misc_feature (391)..(391): n is a, c, g, or t
  modified_base (446)..(446): a, c, t, g, unknown or other
  misc_feature (446)..(446): n is a, c, g, or t
  modified_base (455)..(455): a, c, t, g, unknown or other
  misc_feature (455)..(455): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtgtcgttttctaggtggctaatttaaaaggtgtccagtgtgaggtgcagctggtggactcgtgggggaggcgttggtacaggccgtggggggtccctgagctctcctgtgcagcctctggattcacctttagctagtttgcctagtgggctgggtcccgcaggctccgagggagggcgtggagtgggtctcgaactatagcggtattggtaactacacatactacgcagactccggtagacgggccncttcaccatcctccagagaacacttccaaagaacatggtgttctgacaaattgancagctgagngccgagtacgacgtccgtataacttactgaggtacgaaacgtttcggacgtgtccgttagggtaacttagtttgacttagtcggggaccgtaagggtaaaccccgg

SEQ ID NO: 95958 - DNA, 654 bp, Homo sapiens
  misc_feature: GYAE6OF01DSYLC.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttcttgtggctattttaaaaggtgtccagtgtgaggtgcagctggtggactcgtgggggagcttggtacaaccgtgggggtccctgagactctcctgtgcagcctctggattcacctttagctagttttgccatgggctgggtcccgcaggctccgaggggaggggctgggagtgggtctcaactattagcggtattggtactaccactatactacgcagactccggtagaacgggcccgtcttcacctatcctaccagacgaaccaattacccaaagtaacctaagttggttcgttttacctggtacctaaaagtggtaacgcgaacgcccgttaggaacgacggacccggaagggacccgaccgggtacccgttaataacgtttacgtaggtacgtaccggtaaaacggtttccgggtacgtgtaccggtttaagggtaactagttttacggaaccttacgggtacgggggaaccctaaacggggtaaacccgttacgggg

SEQ ID NO: 95959 - DNA, 488 bp, Homo sapiens
  misc_feature: GYAE6OF01AKOLQ.49.6.A06.1.454.CMB.1.raw
  modified_base (147)..(147): a, c, t, g, unknown or other
  misc_feature (147)..(147): n is a, c, g, or t
  modified_base (168)..(168): a, c, t, g, unknown or other
  misc_feature (168)..(168): n is a, c, g, or t
  modified_base (170)..(170): a, c, t, g, unknown or other
  misc_feature (170)..(170): n is a, c, g, or t
  modified_base (172)..(172): a, c, t, g, unknown or other
  misc_feature (172)..(172): n is a, c, g, or t
  modified_base (174)..(174): a, c, t, g, unknown or other
  misc_feature (174)..(174): n is a, c, g, or t
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (210)..(211): a, c, t, g, unknown or other
  misc_feature (210)..(211): n is a, c, g, or t
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
  modified_base (236)..(237): a, c, t, g, unknown or other
  misc_feature (236)..(237): n is a, c, g, or t
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
  modified_base (369)..(369): a, c, t, g, unknown or other
  misc_feature (369)..(369): n is a, c, g, or t
tcagagtcgagagacacgaccggtgctcgatttagatctactgacaggggctgagagaggagcccagccctgggattttcaggttgttttcatttggtgatcaggactgagcagagagaactcaccatggagtttgggctgagcggngtgttcaggcgctattaaggncngngngagtgcagctgtgctgngggngctgangcgtgggcnngcnctcngtgnagctcngntctctnntgttncntgcgcgcgcngcgcgnggaggngngngtgtcnatgtgtgtgtcgtactacactactacacncacgcgcgacgacgcgtctcnctctcacacgacgactactactacgatagtcgtcgtcgtacanagagagacgacgacgcgacgacgacgacgacgacgtacgtacgtacgtcgtagtacgtacgtacgtcgtgtcgtcgtacgtacgtacgtacgtacgtacggtcggtacggtacggtacg

SEQ ID NO: 95960 - DNA, 639 bp, Homo sapiens
  misc_feature: GYAE6OF01EGOL3.49.6.A06.1.454.CMB.1.raw
  modified_base (394)..(394): a, c, t, g, unknown or other
  misc_feature (394)..(394): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttcttgtggctattttaaaaggtgtccagtgtgaggtgcagctggtggactcgtgggggaggcttggtacagccgtggggggtccctgagactctcctgtgcagcctctggattctacctttagctagttttgccagtgggctgggtccgcgaggctccgagggagggctggaggtgggtctcaactagttaggcggttattcggtactaccacatactacgcacgactcgtagaacgggccncttacaccatcctaccagagaactaacttaccaaagaactagttggttcgtttctagactaaagtggacacgacgccgtagacgtacggccggaacggaaccgaccgggtaccgttaagttaacgttaccgtggttacggaaccggttaaagggtttccggaccggttaggccgtttaacggtaacttaacgttttcggaaccgtttacggtcggggggaacccgtaacgggggttaaaccccgg

SEQ ID NO: 95961 - DNA, 605 bp, Homo sapiens
  misc_feature: GYAE6OF01BFHIG.49.6.A06.1.454.CMB.1.raw
  modified_base (167)..(167): a, c, t, g, unknown or other
  misc_feature (167)..(167): n is a, c, g, or t
  modified_base (170)..(170): a, c, t, g, unknown or other
  misc_feature (170)..(170): n is a, c, g, or t
  modified_base (173)..(173): a, c, t, g, unknown or other
  misc_feature (173)..(173): n is a, c, g, or t
  modified_base (175)..(175): a, c, t, g, unknown or other
  misc_feature (175)..(175): n is a, c, g, or t
  modified_base (178)..(178): a, c, t, g, unknown or other
  misc_feature (178)..(178): n is a, c, g, or t
  modified_base (180)..(180): a, c, t, g, unknown or other
  misc_feature (180)..(180): n is a, c, g, or t
  modified_base (182)..(183): a, c, t, g, unknown or other
  misc_feature (182)..(183): n is a, c, g, or t
  modified_base (189)..(189): a, c, t, g, unknown or other
  misc_feature (189)..(189): n is a, c, g, or t
  modified_base (194)..(194): a, c, t, g, unknown or other
  misc_feature (194)..(194): n is a, c, g, or t
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (300)..(300): a, c, t, g, unknown or other
  misc_feature (300)..(300): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcggtgtgttctaggcgctattaagntcngtngngtncngnngtgctntgggngntgtngcgtgggtccgtgagctctctgtgcngctcgtgtctctacttacgtctgttcgtcgtgtcggtcgtcggtccgcgcggcgtcggacgggacggcggtggnggtcggtcgtacgtaacgtacgtacgtacggtacgtacgtacgtacctaactacgtacgtacgacgacgtacgtacgtacggtacggtaccgtacctacctacctactacgtacgacgaacgtaacgtaacgtaactaactaacgtagtcgttacgttacgtacgtacgtaagtagtacgacgacgacgtacgacggacgacgtacgacgtacgtacgtacgtacgtacgtacgtagtacgtacgtcggtgtacggtcgtacgttacgtacgttacgtacggtacggtcggtacggtacggtacg

SEQ ID NO: 95962 - DNA, 569 bp, Homo sapiens
  misc_feature: GYAE6OF01AY5G6.49.6.A06.1.454.CMB.1.raw
  modified_base (173)..(173): a, c, t, g, unknown or other
  misc_feature (173)..(173): n is a, c, g, or t
  modified_base (263)..(263): a, c, t, g, unknown or other
  misc_feature (263)..(263): n is a, c, g, or t
  modified_base (321)..(321): a, c, t, g, unknown or other
  misc_feature (321)..(321): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (393)..(393): a, c, t, g, unknown or other
  misc_feature (393)..(393): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtgtcgtttctaggtggctaatttaaaggngtccagtgtcaggtgcagctggtggaggtggggggagcgtggtccagcctgggactccctgagctctcctgcgcagcctctggatttacnttcagttagttatgatatgctacttggtttcgccgacgggtccaggcgaagggctggngtgggtgntagttanatcgtatgagtaaggaaacaaatcagcagactcgagaacggcatcacatccgaccanactagtaccaagaacatacgttnttacctacngtactagaactgtaccagaagtacgtacgacacgacgcttacgtaatactcgaaccgtgtacggccgtggaaccggtacaaccggttaaccttaaccggaacccgaaggttaccctacgggtaccggggaccctaaacccgggg

SEQ ID NO: 95963 - DNA, 756 bp, Homo sapiens
  misc_feature: GYAE6OF01DEKHC.49.6.A06.1.454.CMB.1.raw
tcagagtcgagagacacgaccggtgctcgatttagatctactgacaggggctgagagaggagcccagccctgggattttcaggttgttttcatttggtgatcaggactgagcagagagaactcaccatggagtttgggctgagctggtcttttcttgtggtcttaattttaaaggtgtccagtgtggaggtgcagcgtggtggacgtcggtggggggaggtcgttggtacgacggtcccggtcggggggtcccctggacgtaccttcctccgtggtgccacgtcccttcgtggtacttcctaccgtttagtcttagtttcgacctaggtcgggtcgtcgggtcccgccgaggtccgtaccgggagggggacgggtcgtgggtagggttcggtctacgtaaacgttagttacggtacggttacgttacggtaacctaaccgacgtaactaaccgtacgacgtacgtacccgtccggtacgggaaccgggtcccgtacttacccaaccgtactacccgtaccgaagtaaccgtaaccttaaaccgttaccgaaaaacgtaaccgttaggttaccgggtttactttaccgtagaaacctaaagtcggaacgtaccgacgtcccgtaaggacggaaccggccggtaaacgggaccgtaaccggtacgttaagttacgttacgtagggtacgtaacggttaacgtcgtagttgtacgtagttactagttacgacgttaggacgggaccgtagggtaacccg

SEQ ID NO: 95964 - DNA, 572 bp, Homo sapiens
  misc_feature: GYAE6OF01ADEO4.49.6.A06.1.454.CMB.1.raw
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtggtgttttctaggtggctattttaaaaggtgtccagtgtgaggtgcagctggtggacgtcgtgggggaggcttgggtacagccgtggggggtccctgagactctcctgtgcagcctctggattcacctttagctagttttgcctagtgggctgggtcccgccgaggctccgaggggaggggctgggagtgggtctacgaactattaggcggtattggtaactaccgactatactacgcagactccgngacgggccncttcacatctcagagacatacaagacaccctagtactctagctaattcgaacagactcgaagacgcgtagacggacacggtctagtagttattagttgtagttagtaaacgttacgtttagtggaaggtaagtttaagtttcgggtttttacgagttacgtgtcttaaagg

SEQ ID NO: 95965 - DNA, 885 bp, Homo sapiens
  misc_feature: GYAE6OF01CLC0O.49.6.A06.1.454.CMB.1.raw
  modified_base (223)..(223): a, c, t, g, unknown or other
  misc_feature (223)..(223): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtgtcgttttctaggtggctaattttaaaaggtgtccagtgtgaggtgcagctggtggacgtgtgggggagcgttggacngccggtgggggtccctgagctctccgtgtcgcagtcctcgtaggtattcctaccttttagccttgttttcgcctagtgggtcgtcggggtccgccgacggcctccggaggggtaagggcgttaggaggtcgggtctactaaacgttagttaacggtccggttaagtttaccggtaaccttaaccaactaactttaacccgtaaccggacaacggtaaccccgtaccgggttacggaaaccgggggtccccgttcctttaaccgaaccccgttaacttcccgtacccgtaaaggaaccggtaaaacccttaaactttaaacccccgaaaaaggtaacgtaacgtttggggttttacctttaccgttaaccggaaacctaaaacgttgggaaaccggttccgaaaccggttcccggttaaggaaccgggtaaacgggtaccccgggtaaacggggtaccaaacccgggggtttaccccttaagtttaaccggtttaacgtaccgggtttaggaaaacccggtttaaacgggtttccccgggtaggtttaaccgggtacccgttttaaaaggggttaaccccttaaggtttttaaccgggtaaacccgtttaacggggggttacccggggtaaaacccgggttaacgggggttaaaaacccccgg

SEQ ID NO: 95966 - DNA, 713 bp, Homo sapiens
  misc_feature: GYAE6OF01EZEYW.49.6.A06.1.454.CMB.1.raw
tcagagtcgagagacacgaccggtgctcgatttagatctactgacaggggctgagagaggagccccagcccctgggattttcaggtgttttcatttggtgatcaggactgagcagagagaactcaccatggagtttgggctgagctggtctttttcttgtggcttattttaaaggtgtccagtgtgaggtgcagcgtggtggactcgtgggggagcgttggtacgagccgtgggggtccctgagactctcctgtcgcagcctcgtgtacttcctacctttagcttagttttcgcctagttcggggccgtcgggtcccgccgagggcctccggaggggaaggggcgtgggaggttgggtcctacgtaaacttacgttaggcggttagttcggtaactaacccgaactactaacgtacgacgaacggtaaccgttccggaggaaaccggggcccgtacgtttaccaacccgtactccgtacccaaggaacaactaaacgttacccgaaagaacctagttcggttgtttacgtaggactaaagtcggaacgaccacggaccgtaggaacgacggaccgggaaggaccgaaccgggtcgttaattacgtttacgtggttacgaacggttaaacggttccggtaggtcggtacgttaacggttaacttacgtttacgaaccgttaacggttcggggaacccgtaacggggtaaacccg

SEQ ID NO: 95967 - DNA, 876 bp, Homo sapiens
  misc_feature: GYAE6OF01DWE36.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttggctgagcgtgtcgtttctaggtggctaatttaaaggtgtcagtgtgagtgcagctggtggacgtcggtgggggagtcgttggtacacggtccggtggggggtccctggagcctctccgtgtcgcacgtcctcgtggtacttcctacctttagcgttagtttcgacctagtcgggtcgtcgggtcccgaccgtacggccgtacggagggggtacgggtcgtagggtacggtcggtactacgtaaacgttagttacggtcggttacgttacggtaacctaaccgtaactaacgtaaccgttacgaccgtaacgtacccgtccgggtaacggtaaccgggtccccgtaccgttacccgaaccgtacgttccctaaccggaaacgtaaccgtaacttaaaccgttaaccccgaaaagtaacccgttaggtttcggggttttaactttaccgtaacggtaaactaaacgttcggaacgtacgtaaccgggtaccgttaagggaaccggaccgggtaacccggtaacgggtaaaccccggtaacccgggtttaaccttaaacgtttaaccgtttaacggttaccgggtaaacccgggttaacggtaaaacccgggttttccgggtaaaccggttcgggttaaacccgtttaagggtttaacccgtttaaacggttttaccggtaaaccccgtttacgggggttacccgggggtaaaaccccggttaacccgggggttaaaaccccgg

SEQ ID NO: 95968 - DNA, 653 bp, Homo sapiens
  misc_feature: GYAE6OF01AJ3FF.49.6.A06.1.454.CMB.1.raw
  modified_base (222)..(222): a, c, t, g, unknown or other
  misc_feature (222)..(222): n is a, c, g, or t
  modified_base (253)..(253): a, c, t, g, unknown or other
  misc_feature (253)..(253): n is a, c, g, or t
  modified_base (282)..(282): a, c, t, g, unknown or other
  misc_feature (282)..(282): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcggtgtcgtttctaggtcggctaattttaaaggtgtcagtgtgaggtgcagctggtggactcgtggggagtcttggtacngccgtgggggtccctggagctctcctgtgcngtcctctggattctaccttgctgttttcncctgtcggctggtccgccgcggtcctcggagggtacgggtcgtggtaggtcgggtactcgtaacgtagttaggcggttaagttcggtaacttaccgaactagtacctaacgcgtacggtaccgtaccggtaggaaccgggtccgtccgttccaacgtacgttaccgacccgtaagacgaacctaacgttacccgaaagtaacccgtagtttaggttacgtttactacggtacctaaagtcgaacgtcaacgtcgtagacgacggtaccggaacggacgacggttacctacgtaacgtgtgtacgtacgtaagtcggtacgtagtcggttagtaccttggttcctaacttccggaggttcgacggtaaccgg

SEQ ID NO: 95969 - DNA, 691 bp, Homo sapiens
  misc_feature: GYAE6OF01B158L.49.6.A06.1.454.CMB.1.raw
  modified_base (221)..(221): a, c, t, g, unknown or other
  misc_feature (221)..(221): n is a, c, g, or t
  modified_base (342)..(342): a, c, t, g, unknown or other
  misc_feature (342)..(342): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcggtgtgtttctaggtcggctaattttaaaggtgtcagtgtgaggtgcagctggtggactcgtgggggagcttggtacngccgtggggggtccctggagacctctcctgtgcacgctctaggacttctacctttagcttagtttgccagttcgggcgtcgggtccgccgcgggtcctccggagggggacggggcgtgggngtgggtctcgtaacttagttagcggttattcggtaactaccactactactacacgacgtacctcggtacggaaccgggcccgtcttacccgacctacgttcctacccgaagaaccgaacctaacttaccccgaaaacgtaatattgggtttctttccgatacaaagtgaaccgtgaccgtgaggacgaacgggccgtagggaaccgtaccggtcttaattaccgttagggtcgtacggtaaccggttaaaggtttcccggagttacggtaccgttaagggtttaacccttaggttacggtaacccggtttaaggggccgggggttaaacaaaccgggggtttaaccccg

SEQ ID NO: 95970 - DNA, 804 bp, Homo sapiens
  misc_feature: GYAE6OF01B3TMU.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtgtcgttttcttaggtggctaattttaaaaggtgtccagtgtgaggtgcagctggtggactcgtgggggagcgttggtacacggccggtcggggggtccctggacgcctctccgtgtgcacgcctctggacttctacctttagctagtttcgcctgtgggctcgggtcccgccgaggccgtccggaggggaacggggcgtgggaggttcgggtcctacgtaacttacgttacgggtcggttaacgttacggtaacctaaccgtaacgtaacttaaccgtaacggaccgaacggtaacccgttcccgggtacgggaaacgggtcccctacgttaccctaacccgtaacttcccgtaccgaaacggtaacgaacttaaaccgttacccaaaaggtaactacggtttacgggtttacgtttaccggttacgaacgtaaaagtggaaccgtacgtaacggtccgtaacgggaacgaaccgggacccgggaacgggtaaaccggacccggggttaccgttaacttacggtttaccgttaggtaccggttaaccgggtaaacggtttccggtaccggttacggtccggttaacgggttaacttacggtttacgaacccggtttacccgggttacgggggaaccccgtaaacgggggtaaaccccgg

SEQ ID NO: 95971 - DNA, 779 bp, Homo sapiens
  misc_feature: GYAE6OF01C8AAU.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagttgggctgagctggtctttttcttgtggtctaattttaaaaggtgtccagtgtgaggtgcagcgtggtggactcggtgggggaggtcgttggtacaggccgtggggggtccctgacgactctcctgtgcacgcctctggtacttctacctttagctagttttcgcctagtcgggcgtcggggtcccgccgacggtccgtaccggaggggaacggggcgtagggaggtgggtctacgaacgttagttacggcggttagttggtacctaaccgaactacgtaacgtacgactaacgacgttcccggtaggaaacggggccctactttaccgaccctacgttacctacccgaagaacgtaacctaaacttacccgaaaagtaactaagtttcgggttacgtttttaccgaacggtaactaaaaggttggaaacgtccgaacgggtcccgtaagggaacgggtaaccggacccgggtaaccgggaacccgtacccgggttaaccccgttaatttaacgttaaccgttagggtaccggtaaacggttaaacgggtttcccggacggttacggtaccgtttaacgggtaaacttacgtttaacggtaaccgttacgggttaccgggggaacccgttaaaggggtaaacccccgg

SEQ ID NO: 95972 - DNA, 572 bp, Homo sapiens
  misc_feature: GYAE6OF01DGGM0.49.6.A06.1.454.CMB.1.raw
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
  modified_base (462)..(462): a, c, t, g, unknown or other
  misc_feature (462)..(462): n is a, c, g, or t
  modified_base (497)..(497): a, c, t, g, unknown or other
  misc_feature (497)..(497): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttcttgtggcttaattttaaaaggtgtccagtgtgaggtgcagctggtggactcgtgggggaggcttggtacagccgtggggggtccctgagactcctcctgtgcagcctctggattccaccttttagctagtttttgccagtgggctgggtcccgccgaggctccgaggggaggggctgggagtgggtctcaactataggcgtattggtactaccacatactacgcagactccgtagaacgggccgtcttccacctatcctaccagaacgacaacttaccaaagaacagttggttntttcngacaatgancagcagagacgccgagacacggacctatacttacnggtagacgtaaacgttcgagttgtcgtaggtactagtttcgaacttacggtacggggccctaaggggtaaacccg

SEQ ID NO: 95973 - DNA, 638 bp, Homo sapiens
  misc_feature: GYAE6OF01AUSYA.49.6.A06.1.454.CMB.1.raw
  modified_base (570)..(570): a, c, t, g, unknown or other
  misc_feature (570)..(570): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactcgtgggggagcttggtacagccgtgggggtccctgagctctcctgtgcagcctcgtggacttcctacctttagcttagttttcgcctagtcgggcgtcgggtcccgccgaggtcctccggaggggaacggggcgtgggacggtcgggtacctacgaaacttagttacggcggttagttcggtactaccgacactacctacgacagtacctccggtaggaaccgggcctccttaccacctactcctaccgaagacgaacctaacttacccgaaagaactaagttcggttactttacgtagactaaagtgaacgcgacgctaggaagaccggaccggaacggaccgtaccggaccgttattaacgttacgngtacggacgtaacgttcgacggtgcgtagtactagttcgacgttacggcggggacgaacgggtaaccg

SEQ ID NO: 95974 - DNA, 560 bp, Homo sapiens
  misc_feature: GYAE6OF01C4PYC.49.6.A06.1.454.CMB.1.raw
  modified_base (441)..(441): a, c, t, g, unknown or other
  misc_feature (441)..(441): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttcttgtggcttaattttaaaaggtgtccagtgtgaggtgcagctggtggactcgtgggggaggcttggtacagccgtggggggtccctgagactctcctgtgcagcctctggattccacctttagctagttttgccagtgggctgggtcccgccgaggctccgaggggaagggctgggagtgggtctcgaatataggtcggtattggtactaccacatactacgcagactcccgtgaacgggcctcttccacctatcctccagacgacaacttaccaagaacatggttnttctagacaatgagcagacctgagacggaccgaggacacggacgtatagttactgagtacgaaagttcgagtcgcgtagtactagtttcgaacttacggtcgggccgaagggtaacccg

SEQ ID NO: 95975 - DNA, 549 bp, Homo sapiens
  misc_feature: GYAE6OF01CS0GX.49.6.A06.1.454.CMB.1.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcggtgtcgtttctaggtggctaatttaaaggtgtcagtgtgaggtgcagctggtgactcgtggggngcgttgacagccgtgggggtccctgganctctccttgngctcgcctntggattcacctttgctagtttgcctatgggtctcgggtccncgaggccnccgagggacggcgtggagtcgggtctactaatagtagcggttattcggactaacnactancgangactcgtagacgggccncttacactntcctacganagacctaagtccaaggtaacagttggtntttacgngacagtcgacgcacgcgagacgacgacggagacgacgtactatactcgtgtagtacgtacgtcgtagacgtcgtagtacttagttacgacgtcggacggacgtaggtaccg

SEQ ID NO: 95976 - DNA, 644 bp, Homo sapiens
  misc_feature: GYAE6OF01AT6ND.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttcttgtggcttattttaaaaggtgtccagtgtgaggtgcagctggtggactcgtgggggaggcttggtacagccgtggggggtccctgagactctcctgtgcagcctctggattcacctttagctagttttcgcctagtgggctgggtcccgccgaggctccgaggggagggctgggagtgggtctcgaactagttagcggttattcggtacctaccactatactacgcaacgtacgtccggtagaacgggcctacttccacctatcctaccagaacgactaaacttaccaaagaactagttggttcgtttactagaactaagtcgagtccacgctaggaacgacggacccggaaggaccgtacgggacgttaacgttattaccgtaggtacgtacggtaaacggtttccggaggttacggtaccgttagggttaaccttaggtttacgtaacgttaaccgggtcgggggacccgtaagggggtaaaccccg

SEQ ID NO: 95977 - DNA, 697 bp, Homo sapiens
  misc_feature: GYAE6OF01B7QFP.49.6.A06.1.454.CMB.1.raw
  modified_base (317)..(317): a, c, t, g, unknown or other
  misc_feature (317)..(317): n is a, c, g, or t
  modified_base (328)..(328): a, c, t, g, unknown or other
  misc_feature (328)..(328): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttcttgtggcttatttaaaaggtgtccagtgtgaggtgcagcgtgggtggactcggtgggggaggtcttggtacaggccgtggggggtccctggacgactctcctggtgcacgtcctcgtggacttccaccttacaagtaactttggacatcgcacgtcgggtccnccgacggtccnccgaggccgacggggcgtgggaggtgggtcggcgtagttactctacgagtagtaggaagtaacggtaaaagtaaaaagtcttaagttaccggacttccgttaaggacgggtactacttaccgacctagttcctaccgaagaactaacgtaaaccttaccgaaaagtaaccctaccgttagaacctactaacctaataaacgttgaaccctaacgtacgtacgtaggaacgtaccgtagggaacgtaccggacggtctaggttacgttaaacgttacggtggtacgggaacgggggtaaggggggtaggtttaacgttttcggacgttaaggtacccggtaaccctggttacggaacccgttaccggggg

SEQ ID NO: 95978 - DNA, 723 bp, Homo sapiens
  misc_feature: GYAE6OF01ENIG2.49.6.A06.1.454.CMB.1.raw
  modified_base (141)..(141): a, c, t, g, unknown or other
  misc_feature (141)..(141): n is a, c, g, or t
  modified_base (289)..(289): a, c, t, g, unknown or other
  misc_feature (289)..(289): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgngcgtgtctttctagtggcttaatttaaaaggtgtcagtgtgagtgcagctggtggactgtggggaggcgttggtacagccgtgggggtccctgacgcttcgtcctgtgcacgtcctcgtggtattcctacctttagctagtttcgccngtggcgtggtcccgccgaggctcggagggtaacggggtcgagttggggacttgggtaaccttcgtaacaaccggttaagttcgggtaactttacggtactaacctaacctatactaaacggccacggtacgtaaccgggtccgaaaggttcccgaccttctaccctaccacgttaccgaccgaaaatttacccgaaaagttaaacccaaagtaacggttaaacgttttcgttacggtttaccttaaagtcgaaaacgtcgaagccctaaggaccgtaggccggaagggaaccgaacgggtaccctaaggtacccgttaacgttagttaacgtcgtaaaggtccgtaacgttcggaccgttaggtaccgttaagtttaccggaaacgttttaacggaccgggttaacccgtaagggggtaaccccgttaacgggg

SEQ ID NO: 95979 - DNA, 732 bp, Homo sapiens
  misc_feature: GYAE6OF01B3YM7.49.6.A06.1.454.CMB.1.raw
  modified_base (225)..(225): a, c, t, g, unknown or other
  misc_feature (225)..(225): n is a, c, g, or t
  modified_base (263)..(263): a, c, t, g, unknown or other
  misc_feature (263)..(263): n is a, c, g, or t
tcagagtcgagagacacgaccggtgctcgatttagatctactgacaggggctgagagaggagcccagccctgggattttcaggttgttttcatttggtgatcaggactgagcagagagaactcaccatggagtttgggctgagcgtgtcgttttctggtggcttaagttttaaaaggtgtccagtgtgaggtgcagctggtggactggtgggggagcgttggacnggtccgtggggggtccctgacgctctctgtgcagcctntggtacttctaccgtttagcgttagtttcgacctggtcgggtccgtcggggtcccgccgaacggccttacccgggaggggaacgggtcgtaggggtaggttcgggtactactaaacgtttagttaggtacggttaagtttcggaaccttaccaactaacgttacctacgacgtaacgtaccgtccggtacgggaacgggtccctaccttacaacccgtattccaccgaacggaactaacctaacgttaccccgaaagtaaccgtaacgtttgggtttactttccgaagaactaaaggtcgagttccacgtcgtaggaacgacggaacccgacggtaacccgacggttactacttagttaccgtaggtacgtaaccggttaggtacccggtggttaacgcgggtttaaacggtactttgttaaccggtaaccggtacgggtaccggggaacgaaccggggtttaaacccg

SEQ ID NO: 95980 - DNA, 715 bp, Homo sapiens
  misc_feature: GYAE6OF01DPG91.49.6.A06.1.454.CMB.1.raw
  modified_base (639)..(639): a, c, t, g, unknown or other
  misc_feature (639)..(639): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggtagtttgggctgagcgtggtctttttctgtggcttaattttaaaggtgtccagtgtgaggtgcagcgtggtggactcggtgggggaggtcgttggtacaggccggtggggggtccctggagctctcctgtcgcagcctcgtggacttctacctttagcttagtttcgcctagtcgggcgtcgggtcccgccaggccgtaccggaagggggacgggcgtgggaggtcggggtactcgtaaacgttagttacggcggttaagttcggtaacctaccaacgtataccgtaacgcaacgtccgtccggtacggaacggggtccctaccgttccaaccctacgtccctacccgaagaccgtaaactaaactaccgtaaaacgaacgtagtttggttacgttttacgtacgaacgtaaagtggacgtcaacgtccgacggaacggaccggtccggaaacggaccgtaccgggaccgttataacgtttcgaggtaccgtacgttaaacggttccggngttacggtcgttacgttaacgttcgtttacggtaacttaaccggggtcggggtaacccgtaacggggttaaacccg

SEQ ID NO: 95981 - DNA, 662 bp, Homo sapiens
  misc_feature: GYAE6OF01DPVZB.49.6.A06.1.454.CMB.1.raw
  modified_base (178)..(178): a, c, t, g, unknown or other
  misc_feature (178)..(178): n is a, c, g, or t
  modified_base (223)..(223): a, c, t, g, unknown or other
  misc_feature (223)..(223): n is a, c, g, or t
  modified_base (318)..(318): a, c, t, g, unknown or other
  misc_feature (318)..(318): n is a, c, g, or t
  modified_base (376)..(376): a, c, t, g, unknown or other
  misc_feature (376)..(376): n is a, c, g, or t
  modified_base (459)..(459): a, c, t, g, unknown or other
  misc_feature (459)..(459): n is a, c, g, or t
  modified_base (504)..(504): a, c, t, g, unknown or other
  misc_feature (504)..(504): n is a, c, g, or t
  modified_base (524)..(524): a, c, t, g, unknown or other
  misc_feature (524)..(524): n is a, c, g, or t
  modified_base (545)..(545): a, c, t, g, unknown or other
  misc_feature (545)..(545): n is a, c, g, or t
tcagagtcgagagacacgaccggtgctcgatttagatctactgacaggggctgagagaggagcccagccctgggattttcaggttgttttcatttggtgatcaggactgagcagagagaactcaccagtggtagtttgggctgagcgtgtcgtttctaggtcggtctaatttaaaggngtcagtgtgagtgcagctggtggacgtgtggggagtcgttggacnggtccggtcgggggtcctgacgctcctctgcgcagtcctgtcggtacttcctaacgtttagcgttagtttcgccgtagtcgggtctcggggtccnccgtacggccgtaccggaagggggacgggtcgtagggtggtcggtactactaaacgtnttacgggtagttacgtacggtacctaccgataacgttacgacgacgtaacgccgtacgtacggaacggtcctcctacaacctntccgacaagtacactaacgttaccaagtaactgttacggttcttnagaacaagtgaatcagtacngaacgtacgacccgaggaacncggtactagttactaccgtggacgtaaccgttagttcccgggattacggtaagttacgttaacgtacttttacggaaacgttccggggaaccgggtaaccggtaaccggttaaacgg

SEQ ID NO: 95982 - DNA, 832 bp, Homo sapiens
  misc_feature: GYAE6OF01B01LC.49.6.A06.1.454.CMB.1.raw
  modified_base (261)..(261): a, c, t, g, unknown or other
  misc_feature (261)..(261): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtggtctttttctgtggctattttaaaaggtgtcagtgtgaggtgcagctggtggactcgtgggggagcttggtacagccgtggggggtccctggacgacgtctcctgtgcacgcctntggattcctacctttagctagtttttcgcctagtcggggtctcggggtcccgccgacggcctcccggaagggggaacggggcgttaggggaggttcgggtctacaaacgttagttacggtaccggttaagttcggttaacctaacccgtaactaacgttaaccgtacgccgaaacggtacccttcccggggttacgggaaaccggggtccccggtaccctttacccgaaccccttacttaccccgttacccgaacggtaaacggaaacccttaaaacctttaaccccaaaaacgggtaaaaccgttaacggtttacggggttttcgtttttaccgtaaggtaaacccgtaaaacgttacgggaacgtaccgaacgggtcccgttacgggaacgggaccgggaacccgggaaacgggtaaccccgaccggggttacccgttaaacggttaactttaacccgttgggtaaccgtaaaccggttaaacggttccgggtaggttcggtacgttaacggttaacttagtttacgacccgttaaggtccgggggtaaccggtaacgggtaaacccgg

SEQ ID NO: 95983 - DNA, 751 bp, Homo sapiens
  misc_feature: GYAE6OF01APJQY.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtggtcgttttctgtggctattttaaaggtgtccagtgtgaggtgcagctggtggactctgggggagcttggtacagcctggggggtccctgagactctcctgtgcagcctctggattcacctttagctagttttgcctatcgggctgggtccgcgaggctccgagggaaggggctgggagtgggtctcgaacttagttacggcggttattcgggtaacttaccgaactactacgtaccgctagaccttacccggtaggaacgggtcccgtctttaccaccctacgttcctacccaacggacgtaactaaactttaccccaaaaggtaaaccgtaagttacgggtttcgttttaccgttaggaacctaaaagttcggtaacggaccaaaccgggtccccgtttaaggaacgggtaacggacccgggaacggggaaacccgtaccgggtaaccccggtttaattacgtttaaaccgtcgggttaacggtaaccgggtaaaacggttttccggagggttacgtacccggtttaagggttaaaccttacggttttacggaacccgtttacgggtaccgggggtacccgtaaacggggttaaaacccccggg

SEQ ID NO: 95984 - DNA, 735 bp, Homo sapiens
  misc_feature: GYAE6OF01EFH91.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttcttgtggctattttaaaaggtgtccagtgtgaggtgcagctggtggactcgtgggggagcttggtacagccgtggggggtccctgagactctcctgtgcagcctctggattcacctttagctagtttgccagtcgggctgggtcccgccgaggcctccggaggggaggggctgggagtgggtctctaatattaggcggttattcgggtactaccactataccgtacgcacgtacctccggtaggaacgggcccgtctttaccaccgtactcctacccgagaacgactaaactttacccgaaagaactagttggttacgttttaccgtacgaacctaaagttacggaacgtaccgaacggtcccgtagggaacggaaccggtacccgggaagggaaccccgtaaccggggcccgtttaaacgttaccgttaacgttagggtacggtaacccgggttaaaggttttccccgggacgggttacgtacccggtttaaaggggtaccctttaacggttttaccgggaaacccgtttaaccggggttcccgggggtaaaccccggtaaacgggggttaaaaccccggg

SEQ ID NO: 95985 - DNA, 810 bp, Homo sapiens
  misc_feature: GYAE6OF01EYMW3.49.6.A06.1.454.CMB.1.raw
  modified_base (756)..(756): a, c, t, g, unknown or other
  misc_feature (756)..(756): n is a, c, g, or t
tcagagtcgagagacacgaccggtgctcgatttagatctactgacaggggctgagagaggagcccagccctgggattttcaggttgttttcatttggtgatcaggactgagcagagagaactcaccatggagtttgggctgagctggtctttttcttgtggcttattttaaaggtgtccagtgtgaggtgcagcgtggtggacgtcggtggggggaggtcgttggtacacggtccggttcgggggggtcccctaggacgtaccttccttccgtgtcgccagtcctcgtggtacttcctacctttagcttagtttcgcctagttcgggccgttcggggtcccgccgtacgggtcccgtaccgggaagggggaacggggtccgtaggggtacgggttcgggtacctacgtaaacttagttacgggtacggttacgttacgggtaacctaaccgtaactaacgttaaccgtacgactaacggtacccgttaccgggttacgggaaccggggtccctaccgttacccgaaccctacgttaccctaacccgaaagtaaccgtaacctaaacgttaacccgaaaacggtaaaccgttaggttaccgggttttaactttaccggtaacgtaacgtaaaacgtcggtaaccgtaccgaccggtaccgtagggaaccgtaacgggacccgggtaacggtaacccgtacccgggtaccgtaattaccgttagtcgtagtaaccgggtaacgttcggtagtacggtntaacgggttactacgtttacgaccggttacggacgggtacccgaagggtaaccg

SEQ ID NO: 95986 - DNA, 799 bp, Homo sapiens
  misc_feature: GYAE6OF01CZSZW.49.6.A06.1.454.CMB.1.raw
  modified_base (179)..(179): a, c, t, g, unknown or other
  misc_feature (179)..(179): n is a, c, g, or t
  modified_base (243)..(243): a, c, t, g, unknown or other
  misc_feature (243)..(243): n is a, c, g, or t
tcagagtcgagagacacgaccggtgctcgatttagatctactgactaggggcgtgagagaggagcccagccctgggattttcaggttgttttcatttggtgatcaggactgagcagagagaactcaccagtggagtttcgggctgagcgtgtcttttctaggtggctaattttaaaggntcagtgtagtgtgcagctggtgctcgtggggacgtcgttggacagtccgtggggtcctggaacnctctccgtgtgcgacgtctccgtggtacttaccgtaccttttaggaccttttacgtttcggaccgtaggttcggggacgtttccggggaccgtaccgtaccggcgttacccgggaaagggggacgggtccggttgggtaacggttcgggtaaccctacggttaaaaacgttcggtaacggttcgggttaattacgggtaacttaaccgaacgtaagttaaaccgtcgactaccggtaaccgttccgggaacgtaaacggttcccgaacttacgaacccctagttaccctaccgggaaataccggttaaactaaacgtttacccgaaagtaaaaccggtgtttacgggtttcgttaccaggttaaaccaaagggttcgacggcgtaaccgcgttacggaggttaacccgccgggttaaacggcgtaccgggttaacctagttaaaccgtttacgacggtaaggttaccggtaacgttcgggacttaacggtccttaacgggttaacttcggtttacgtaacgtacccgggtaggacccggttaaacgaaaccccggg

SEQ ID NO: 95987 - DNA, 809 bp, Homo sapiens
  misc_feature: GYAE6OF01ALWE4.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttcttgtggctattttaaaaggtgtccagtgtgaggtgcagctggtggactcgtggggggagcttgggtacaggccggtcggggggtccctggacgacctctcctggtcgcagtcctcgtggtattcctaccttttagcttagtttttcgcctagtcggggtctcggggtcccgccgaggccgtcccggaagggggtaacggggtcgttagggagggttcgggttacctacgtaaacgttaagttacgggtacggttacgtttacgggttaacctaacccgaactaacgttaaccgttaaccgaccgtaacggtaccgttacccgggtaagggaaacccggggtcccgtaccctttacccgaacccgttaacgttcccgttaccccggaaaggtaacgtaaacccgttaaaccgtttaaccccgaaaaacggtaaccgttaaggttttcggggtttaccttttaccgtacggaaaccgtaaaagtcggaaccgtaccgtaacgtccgttaaggacggtaacgggcccggaaagggacccttacgggtaccgttataacgtttacgtagggtaccgaaaggtaacgttccgggacgtaggtcgttaacggtacttcgttacggaaccttgggtacggggaccgtaaagggtaaccccgg

SEQ ID NO: 95988 - DNA, 862 bp, Homo sapiens
  misc_feature: GYAE6OF01A4FLJ.49.6.A06.1.454.CMB.1.raw
  modified_base (323)..(323): a, c, t, g, unknown or other
  misc_feature (323)..(323): n is a, c, g, or t
tcagagtcgagagacacgaccggtgctcgatttagatctactgacaggggctgagagaggagcccagccctgggattttcaggttgttttcatttggtgatcaggactgagcagagagaactcaccagtggaggtttgggctgagctggtctttttcttgtggtcttaagttttaaaaggtgtccagtgtgaggtgcagcgtgggtggtacgtcggtggggggagtcgttggtacgacggtccggtcgggggggtccctaggacgtacctcctccgtggtgcacgccgtcgtggtacttcctacgtttagtcgttacgtttcnccgtagtcgggtcgtcgggtcccgccgacggccgtccgggaaggggacggggtcgtgggtaggtcgggtactacgtaacgttagttacggtacggttaacgttacggtaaacctacccgtaaacgtaacttaaccgtaaccggtacgtaacggtaacccgttacccgggttacgggaaccgggtccccgtacctacccgaaccgtactacccgtaccgaacgtaaccgtaacctaaaccgtttaacccaaaacggtaaccgttaacgtttacgggtttaccgttttacgtaacggaacgtaaacggtaggacccgtacgtaaccggtaccgtaagggaccggtaaccgggacccggggtaaacgggtacccggtacccgggttaaccgttaacgtttaaccgttaccgttagggtaaccgggtaaacggtttaacggtcccgggtcggttaacggtaccggtttaaccggttattaccggttttacggaaccgtttaaccgggtaccgggggtaaacccgtaacccgggggttaacccg

SEQ ID NO: 95989 - DNA, 706 bp, Homo sapiens
  misc_feature: GYAE6OF01DXYLE.49.6.A06.1.454.CMB.1.raw
  modified_base (206)..(206): a, c, t, g, unknown or other
  misc_feature (206)..(206): n is a, c, g, or t
  modified_base (351)..(351): a, c, t, g, unknown or other
  misc_feature (351)..(351): n is a, c, g, or t
  modified_base (376)..(376): a, c, t, g, unknown or other
  misc_feature (376)..(376): n is a, c, g, or t
  modified_base (432)..(432): a, c, t, g, unknown or other
  misc_feature (432)..(432): n is a, c, g, or t
  modified_base (680)..(680): a, c, t, g, unknown or other
  misc_feature (680)..(680): n is a, c, g, or t
tcagagtcgagagacacgaccggtgctcgatttagatctactgacaggggctgagagaggagcccagccctgggtattttcaggttgttttcattttggtgatcaggactgagcagagagaactcacagtggtaggtttgggctgagtcgtggtcgttttcgtaggtggtacttaagtttaaaggtgtcctagtgtgaggtgacgngtcgtggtggaccgttggtgggggagtcgtttagggtaccaggtcccgggttcggggggtccctagagccttcctcctggtcgcgcgcctcgtggtacttacctacctttagtctttagttccgcgaggtcggtcgttcggcccncgacggcgtacggaggggacggtgngggtgtcgtctacgattagtaacgtcgttagttagtaccacctatacgtaccacgngtacgtcgtaccgtacggtacggccttactacctctacgttccgaacgacggtaacactaaacgttaacgaaacgtaaacgttgtttcggtttaccgttgaacctaaaggtaacttggaacgactaccgggactaagggaccgtaaccgggaccgaaccggtccgaacgggttcctaattacgttccgtaggtacgtaggttacccgtggtccggaacttacggtacgtaacttcgttccgtaaacgngggttaaccgggacgaccgggtaacc

SEQ ID NO: 95990 - DNA, 732 bp, Homo sapiens
  misc_feature: GYAE6OF01DYE5K.49.6.A06.1.454.CMB.1.raw
  modified_base (204)..(204): a, c, t, g, unknown or other
  misc_feature (204)..(204): n is a, c, g, or t
tcagagtcgagagacacgaccggtgctcgatttagatctactgacagggtggaaggagactgggtcatccagatgacccagtctccttccacctgtctgcatctgtaggagacagagtcacatcacttcggccgggccagtcagtagttgtttctactacttagtttcggccttggtatcagactaagtaaaccgagggaaacncccaagaactctgactactatgactcgtccttacgtaggtttgggacggggttcgggtaccagtacgtaaggtcgaggcggcgtaaggtggtactcggtagggaactaaggtaacttacacctactacacctaactacaactacgtcctagacgtacggacgtaacgtaagttattttacgacctaaactaattacttaacgtagtaacctaaagtagtttagtaactactaccgtccgtacttacgtacggtttaccggacgggtaacgggtaaccggaagggttaggtaacgtaacgtaaacgaaacggtaacgttaggaccggtactaccgtaccgactacgttcgttacgttacttacggtaccttcccggttacccacgtaacttacgtaaccgtaacgttaccgttacttaacggtaccgtacgggtacgggtccgggttacgtacgggtaaccgggtaaaccgggtcgtaaccggtaacggttacgacgttaaccggacgtacgtacgtagacgtgtgtac

SEQ ID NO: 95991 - DNA, 747 bp, Homo sapiens
  misc_feature: GYAE6OF01DVZRQ.49.6.A06.1.454.CMB.1.raw
tcagagtcgagagacacgaccggtgctcgatttagatctactgacaggggctgagagaggagcccagccctgggattttcaggttgttttcatttggtgatcaggactgagcagagagaactcaccatggagtttgggctgagctggtctttttcttgtggtcttaattttaaaaggtgtccagtgtggaggtgcagcgtggtggacgtcgtgggggagtcgttggtacaggtccggtcggggggtccctggacgacctcctccgtgtcgcacgcctcgtggtacttcctaccgtttagcttagtttcgcctaggttcgggcgtcggggtcccgccggacggtccgtaccgggaagggggaacggggtccgtggggtacggtcgggttacctacgtaaccgttagttacgggtacggtttaagttcggtaaccctaccgtaactacgtaaccacgacgaacgtaccgtccgggtagaaccggggtccctcttaccacctactcccgtaccgaaggacgtaacctaaacttacccgaaaagaacgttagttcggtttacgttttcgagaactaaagtgaacgacacggtaccgtaggtaacggccggaacgggaacggtaccgtaccgggttaacttattaaccggttacgttggaaccggtaacggttaaacgtcgggtacgttcgtacgttaacgtaacttagttacggactaaccggggtcgggaacctaacggggttaaacccg

SEQ ID NO: 95992 - DNA, 725 bp, Homo sapiens
  misc_feature: GYAE6OF01CNDF2.49.6.A06.1.454.CMB.1.raw
  modified_base (548)..(548): a, c, t, g, unknown or other
  misc_feature (548)..(548): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagttgggctgagcgtggcttttctgtggctaatttaaaggtgtccagtgtgaggtgcagctgggtgactcgtggggggagtcgttggtacaggtccgtcggggggtccctgagtacctctcctgtcgcagcctcgtggtattccactttagctagtttcgcctagtgggtctggggtcccgcgacggcctccggaggggaacgggcgtagggagtcgggtctacgaacttagttaggcggttattcggtaactaaccactactaactacgacacgtaccgttaccggtagggaaaccgggtccctaccttaccgaacctacttacccgtacccgaaggaacgtaactaaaacctttacccgaaaaagtaaccgtaagttagggtttactttacgtagtaaccgaaattacggaacgtanaaccgtacgacggaaggtaccggaccggggtaacggaacccggtaccgggtaaccggttaattaaccgtttacggtacggtaggtaaacccgttaaggttaccgggtcgtaacgttcggttaacgggtacttagttacggaacgttcgggacggggtaccgaaacgggttaacccgg

SEQ ID NO: 95993 - DNA, 998 bp, Homo sapiens
  misc_feature: GYAE6OF01CUVT3.49.6.A06.1.454.CMB.1.raw
tcagagtcgagagacacgaccggtgctcgatttagatctactgacaggggctgagagaggagcccagccctgggatttttcaggttgttttcatttggtgatcaggactgagcagagagaactcaccatggagtttgggctgagctggtctttttcttgtggtcttaattttaaaaggtgtaccagtgtgaggtgacagcgtggtggacgtcgtgggggagtcgttggtacgacggtccggttcggggggtcccctggacgtaccttcctccgttggtcgcacggccttcgtacggtactttcctaccttttaacggcttagtttttcgcctagttcgggcgtccgggtccgccgacggtacctcccggaagggggtaacggggccgtaggggtacgggttcggggttacctacgtaaaccgttagttaacgggtaccggtttaacgtttacgggttaaccttaaccccgtaaacgtaaccgttaacccgtaaccggtacccgtaacgtaacccggtttaccccgggtcggtaaaaaccgggggcccccggttccctttacccaaaccccgttacgttccccgtaacccgtaacggtaaaccgtaaaccgttaaacctttaaaccccgaaaaacgggttaaaacgttaaccggtttacgggttttacgttttaaccgttaccgtaaacgttaaacggtacggtaaaccgtacggaaaccggtcccgggtaacgggtaccgggaaccgggtaaccccgggaacggggtaaccccgtaaacccggggttacccgtttaagttaaacggtttaaccggttacgggtaaccgttaaaccgggttaaaacccgggttttccgggtaccggggttttaaccgggtaccggttttaaaacggggtttacccgtttaaacggttttaaaccggtaaccccgggttttaaaccggggttaccgggggggtaaacccggtaaaaccgggggttttaaaacccccgggg

SEQ ID NO: 95994 - DNA, 764 bp, Homo sapiens
  misc_feature: GYAE6OF01EYI4O.49.6.A06.1.454.CMB.1.raw
tcagagtcgagagacacgaccggtgctcgatttagatctactgacagggggctgagagaggagccccagccctgggattttcaggttgttttcatttggtgatcaggactgagcagagagaactcaccatggagtttgggctgagcgtggtctttttctgtggcttaattttaaaaggtgtccagtgtgaggtgcagctggtggactcgtgggggaggtcgttggtacaggccgtggggggtccctggagtactctcctgtgcacgtcctctggtacttcctaccgttttagcttagtttgacctagtcgggccgtcggggtcccgccgaggtccgtaccggagggggacggggtcgtgggacggtcgggtctacgtaacttagttaggtccggttagtcggtaacctaccaactacttaccgtacgccaacgtaccgtaccggtacggaacgggtcccgtacttaccgacctactcctaccaaggacaacgtaacttacccaaaagtaactagttcggtttacgtttacgtagaaccgtaaagtgaacgacctaggtacccgtaggaacggtacggacccgggtaacggaccggtaacccgggttaccttaacgtttaacgttaacccggttggtaaccggtaaccgggttaaacgggttcccgtacgggtacggttaccgttaacgggttaccttaaggttttacccgggaacccggtttagggtacccgggggtaaccggtaaacccggggttaacccggg

SEQ ID NO: 95995 - DNA, 787 bp, Homo sapiens
  misc_feature: GYAE6OF01BBOF2.49.6.A06.1.454.CMB.1.raw
  modified_base (174)..(174): a, c, t, g, unknown or other
  misc_feature (174)..(174): n is a, c, g, or t
  modified_base (259)..(259): a, c, t, g, unknown or other
  misc_feature (259)..(259): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcggtcgtgtttctaggtggctaatttaaaggngtcagtgtgagtgcagctggtgactcgtggggagtcgttaggtacacggccgtgggggtccctgtacgtacctcgtccgtgtcgnacgtccgtcgtaggtacttccgaacctttaggccgtagtttttcgacccgtagtccgggtgttacgggttcccgtaccggtaaggccttacccggtaaggggaacgggttaccgtacgggttaaggtcggggttcctaacgtaaaccgtttaaggtttacggttaacgggttaacggtttcggttaaaccggttaacctaacgtaaccggttaaccttaacgccgtaaacgccgttaccgtacggacggttaccgcgtttaccaacgtattccgacgtaccggtataacgtaacttacccgaagtaaaccgtagtacggttcgttttacgacgtacgtaagtacgacggacctagtccgtaagggacgacgtaaccgggtacggacctaacccgggtacgttaacgttaccgttacgtacgttacggtaccgttaaaacggtccggttaagcggttaaaggtacccggttaattaccgtttaacgaaccggttccggtacggggtaacccgtaaaggggttaaccccg

SEQ ID NO: 95996 - DNA, 710 bp, Homo sapiens
  misc_feature: GYAE6OF01AJQS4.49.6.A06.1.454.CMB.1.raw
  modified_base (256)..(256): a, c, t, g, unknown or other
  misc_feature (256)..(256): n is a, c, g, or t
  modified_base (423)..(423): a, c, t, g, unknown or other
  misc_feature (423)..(423): n is a, c, g, or t
  modified_base (543)..(543): a, c, t, g, unknown or other
  misc_feature (543)..(543): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtgtcgttttctaggtcggctaattttaaaaggtgtcagtgtgaggtgcagctggtggactcgtgggggagtcgttggtacgagccgtcgggggtcctgacgctcctctgtcncacgcctgtcgtacttacctacgtttacgcgttagtttcgacctggtcggtcgtcggtcccgcgtacggtccgacggaggggtacgggtcgtagggtacggttcggtacctacgtaacgttagttacggtacggttagttacggtacctaaccactactaccgtacncgacgtacgtaccgaggacggtcctcctaccgtacctactccgtaccaagtaaccgtaataccccgttaacaagtaacttaggtttcgttagtttaccgagtaacctaaagtcggtaacnccggacgtccgtaggaccgtacggaaccgggtcggaacccggtccggtaacgttaacttaacgttcgtacggtaaccggtaacggttaaccggtcgttagtacttacggttacgttacttaccggtacgtacggttacccgggtcgggaaccggtaaacgttcccgg

SEQ ID NO: 95997 - DNA, 864 bp, Homo sapiens
  misc_feature: GYAE6OF01ETRNF.49.6.A06.1.454.CMB.1.raw
tcagagtcgagagacacgaccggtgctcgatttagatctactgacaggggctgagagaggagcccagccctgggtattttcaggttgttttcatttggtgatcaggactgagcagagagaactcacagtggagttgggctgagtcgtggttctttttcttggtggtacttaagttttaaaaggtgtaccaggtgtggaggtgcgagtcgtggtcggacgtcggtgggggagtcgttaggtacgacggtccgggttcgggggtccctagacggtaccttccgtccgtggtcgccgtacggtcccttcgtacggtacttaccgttaaccgtttacggtcctttaggttttcgaccgtaggtcggggtcggttccggggtcccgaccggacgggtccgtacggggaaggggacgggtcggtggacggttcggtactacgtaagttacgtacggtacggttacgttacggtaaccctacgtaaccgtacgttaaccgtacgacgtacggtaccgtcggtacgggaccgggtcctaccgttaccgacctacgtcccgtaccgaaagtacgtaacctaaacgttacccaaaaggtaaccttgggttacgtttacgtttaccgtaaggtaaactaacggtacggaacgtaccggaacggtaccgtaaggggaaccggtaaccggggacccgggaaacggtacccggtaacgggttaaccttagtttaaacgttaccgggtacggtacgggttaaaccgttaagggtttccgaacgggttccgttaacgggttaaacgttacgttaacgggttttaccgaacccgggtttaaggggcccggggtaaacccggtaacgggttaaaaccccggg

SEQ ID NO: 95998 - DNA, 703 bp, Homo sapiens
  misc_feature: GYAE6OF01EO48H.49.6.A06.1.454.CMB.1.raw
tcagagtcgagagacacgaccggtgctcgatttagatctactgacagggggctgagagaggagcccacgccctgggattttcaggtgttttccatttggtgatcaggactgagcagagagaactcaccatggagtttgggctgagcgtgtcgtttctaggtggctaatttaaaggtgtcagtgtgagtgcagctggtgactcgtggggaggcttggtacagccgtgggggtcctgagtactctcctgtgcagctactggacttcgacctttacgcttagttttcgacctagtgggctcggggtcccgacgacggtaccgttacccggaggggaacggggtcgtcggaggtcgggtactacctaagttagttacggcggttagttcggtaaccgtacaacgattaccgtacgacgacgtacctcgtacggaacgggtccgtacttaccaccgtactccgtaccagtaagacctaagtttacccaaagtaacctagttaggttacgtttactacgtaaccgtaaagttggaaacgtccaacgtccgtagggaacggaccggtaccgggaaggaccgtaacggtaccgttaaagttacgttaacgtggtacgtaacggtaaacggttccgtaggtcggtacgttaacggttacttaacgtttacggtaaccttacgggtaccgggtaccgtaaggggttaacccgg

SEQ ID NO: 95999 - DNA, 714 bp, Homo sapiens
  misc_feature: GYAE6OF01AJGD3.49.6.A06.1.454.CMB.1.raw
  modified_base (143)..(143): a, c, t, g, unknown or other
  misc_feature (143)..(143): n is a, c, g, or t
tcagagtcgagagacacgaccggtgctcgatttagatctactgacaggggctgagagaggagcccagccctgggattttcaggttgttttcatttggtgatcaggactgagcagagagaactcaccatggaggtttgggctgngctggtctttttcttgtgcttattttaaaaggtgtccagtggtgaggtgcgagcgtggtggacgtcggtgggggagtcgttggtacgaggtcccggtcgggggtccctggacgtacctctcctgtcgcacgcctcgtgacttcctacttacgcttacgtttcgccgtaggtcgggtcgtccggtccgacgcggccgtaccggaggggaacgggcgtgggtaggttcgggtactacgtaacgttagttagtacggtttagttacggtaacctaacccaacgtactacctaccgacgtaacgtaccgttcggacggaacccggtccgtactcccgtaacctactaccgtaccaagtaacaacgtaacctaaccgtaaagaaccgttagttcggtttagttccgtaacgacgttaaacgtacggtacgaccgaggtaccgtaggaaccggaacggaccggacggaccgaccggttaacttacgtactttacgtggtacgaccgtaaggtcgtagtaccggttgtaccgttagtagttacgtacgttaccgggacggtacggtaacgggtaaccg

SEQ ID NO: 96000 - DNA, 776 bp, Homo sapiens
  misc_feature: GYAE6OF01BZ5RG.49.6.A06.1.454.CMB.1.raw
  modified_base (213)..(213): a, c, t, g, unknown or other
  misc_feature (213)..(213): n is a, c, g, or t
  modified_base (599)..(599): a, c, t, g, unknown or other
  misc_feature (599)..(599): n is a, c, g, or t
  modified_base (606)..(606): a, c, t, g, unknown or other
  misc_feature (606)..(606): n is a, c, g, or t
tcagagtcgagagacacgaccggtgctcgatttagatctactgacaggggctgagagaggagcccagccctgggtattttcaggttgttttcatttggtgatcaggactgagcagagagactcaccatggtagtttgggctgagcgtgtcgtttctgtcgtctatttaaaggtgtcagtgtgagtgcagtcgtggtcggactcggtagggggngtcgttaggtacgtcggtccggttcgggggtccctagacgtaccttccgtcgtcggtacgcctacggcccttgtaggtacttaccttaaccgtttacgcgttagtttcggcgttaggtcggggtccgttccgggtcccgtccggtcggtacccggttacgggtaacggggaggggtcggtacgggttacggtcgggtacctttaaccgtaacggtttaggttaacggttacggtttagtaccggtaacctaccgaacgtaactaccgtacgacccgtaacggtaccgtaccggtagggtaacccggccgttaccttaccactacgttacgacccgagtaacgtaacaactacaaagtactaagttggtactttacgacaacgtagntacggcncgtacgaggaacggtaccgacgtcggaaaccgttcggattacggttaacttcggtaccggtagtaaaccgggttacgtcggttaccggacttaaggttaaccggttaagtttaccgggtaccgttacggggttacccgggtacggggtaaacccggtaaggttacccggg

SEQ ID NO: 96001 - DNA, 770 bp, Homo sapiens
  misc_feature: GYAE6OF01BAI6G.49.6.A06.1.454.CMB.1.raw
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
  modified_base (218)..(218): a, c, t, g, unknown or other
  misc_feature (218)..(218): n is a, c, g, or t
  modified_base (367)..(367): a, c, t, g, unknown or other
  misc_feature (367)..(367): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggaggtttgggctggagcgtcgtcgttttcgtaggtcggctaagttttaaaggtntcagtgtgagtgcngcgtggtggacgtcgtgggggngtcgttggacgacggccggtcggggggtccctgaagactccgtcctggtgacctgcctcgtaggtacttccgtactttagcgttagtttcgcctaggttcggtcgtcgggtacccgccgagggcctacggaggggtaacgggcgtgggngttacggtctactaacgttagttacggcgttagtcggtaaccaacctacgaacttaccgacgtacgaacgtaccgtttaccggcgggaaaccgggtcccttacgtaacccacccgtaactttcccgaacgtaacgaaccggtaacttaaaaccgttaccccggaaaaagttaccgttaaaggtttcggggttaccgttttatacggttaaacccaaaggtttccgggaaacgacgttaaccgtacggtaacggtaacggacccgggaaccgggtaaccggaacggtaccggttactttacggttacgttacgtggtaccggtaacggttaacgtccggtagtacggtgttaacggtacgttaggttaccggtacgtaacggggaccggtaccggtaacggtcc

SEQ ID NO: 96002 - DNA, 866 bp, Homo sapiens
  misc_feature: GYAE6OF01B1JAI.49.6.A06.1.454.CMB.1.raw
  modified_base (157)..(157): a, c, t, g, unknown or other
  misc_feature (157)..(157): n is a, c, g, or t
tcagagtcgagagacacgaccggtgctcgatttagatctactgacaggggctgagagaggagcccagccctgggattttcaggtgtttcatttggtgatcaggactgagcagagagaactcaccagtgggtagtttgggctgagcgtggtctttttntgtggcttatttaaaggtgtccagtgtgaggtgcagcgtggtggtactcggtggggggaggtcgttaggtacgacggtccggtcggggggtccctggacgaccttctccgtggtcgcacgtccgtcgtggtacttccgtacctttagcgttagtttcgccgtagtcgggtcgtcggggtcccgccggacggccgtaccggaagggggaacggggtccgtaggggtaacgggttcgggttacctacgtaaacgttagttacggtacggttacttacggtaacccgtaccgaactaacgttaaccgtacgtacgaaacggtaccttacccggggtagggaaaccgggtcccgttcccgttaacccaacccgttacttaccccgtaccggaaaacggaccggtaaaacctaaaccgtttaaacccgaaaaggtaaccgttaagggtttccgggtttacttttaacggtaccgtaaacgtaaacggtcggaacgtaaccgtcccgggttaacaaggggaaaccggtccggaccccgggtaaagggaacccggtaccggttaacccgttaaagttaccgttaaacgggtcggtaacgaacccgggtttaaacggtccgggttgttaccggtaaaccgttagggttaaaccgtttacggtaccggttaacgttaaccgggggccggggtaaaaccccggtcggggttaaaccccg

SEQ ID NO: 96003 - DNA, 727 bp, Homo sapiens
  misc_feature: GYAE6OF01ALMYZ.49.6.A06.1.454.CMB.1.raw
  modified_base (308)..(308): a, c, t, g, unknown or other
  misc_feature (308)..(308): n is a, c, g, or t
tcagagtcgagagacacgaccggtgctcgatttagatctactgacagggctgagagaggagcccagcccctgggattttcaggtgttttcatttggtgatcaggactgagcagagagaactcaccatggaggtttggctgagcgtggtctttttcgttgtggtcttagttttaaaaggtgtccgagtgtgaggtgcagctgggtgactcgtgggggagtcgttgtacgcgccggttgggggtccctggacgacttcctccgtgtcgccgtacgccttcgtggtacttcgtaccttaggcttagtttcncgtagtcgggtcgtcggtcccgcgacggcgtccgaacgggagggtacgtggaggtcggtactcgtaacgttagtacggcggttacttacggtaacctaccgaactaactacgtaacgtacgacgtaccgtaccgtacggacgggtccgtcccgtacctaccgtacgccgtaccgtagaaccgtaactaaaccgttaccgaaacgtaaaccgtagttcggtttacgttaactacgtaacgtaacgtacggacgacccgtacgtacgtacgacggaccgtaccggacgaccggtaacgtccgtaagtacgttacgtcggtacgtaacggtaaacggtccggtactacggaccgtttaacggtaactttacgttacggtaacttaccccggggacgggtaacccggtaaacggttaacccgg

SEQ ID NO: 96004 - DNA, 848 bp, Homo sapiens
  misc_feature: GYAE6OF01D06IG.49.6.A06.1.454.CMB.1.raw
tcagagtcgagagacacgaccggtgctcgatttagatctactgacaggggctgagagaggagcccagccctgggattttcaggttgttttcatttggtgatcaggactgagcagagagaactcaccagtggtaggttggctgagcttggttctttttcgttgtggtacttaagttttaaaaggtcgtccagtggtggaggtgcagtcgtggtggacgtcggtgggggaggtcgttggtacgacggtccggttcggggggtcccctaggacgtaccgttccgtccgtggtacgcctaccggtcccttcgtaggttacctttacccgttaaccgttttacggtacgtttacgttttcggaccgtaggtccggggtccgtccggggtccccgtacggaccggtcccgttaccggggaaagggggtacggggtacggtaggggtacgggttcggtaccgtactaacgtttaagttacggtacggtttagttaccggttaactaaccgtaactaacgttaacccgtaacgtaccgtaaccggtaaccgttacccgggtaacgggtaaccccgggtcccgttacccgttaccctaaccccgttaccttacccgttaacccgaacggtaacctaaaccttaaaccgttaaacccgaaagtaaacgttacgttgggtttactttacggagtaaacgtaaagtcgtacgaacctacggtccgaaggacgaccggtaaccgggacgaaacccggtcccggtaacgtattaaaccgttgtaacgtacggtaacgtacggtcgtcggtagtacgttaagtactagttaacgacgtagggtaccggacgtaacccggtacg

SEQ ID NO: 96005 - DNA, 558 bp, Homo sapiens
  misc_feature: GYAE6OF01DR9OY.49.6.A06.1.454.CMB.1.raw
  modified_base (170)..(170): a, c, t, g, unknown or other
  misc_feature (170)..(170): n is a, c, g, or t
  modified_base (184)..(184): a, c, t, g, unknown or other
  misc_feature (184)..(184): n is a, c, g, or t
  modified_base (187)..(187): a, c, t, g, unknown or other
  misc_feature (187)..(187): n is a, c, g, or t
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
  modified_base (346)..(346): a, c, t, g, unknown or other
  misc_feature (346)..(346): n is a, c, g, or t
  modified_base (442)..(442): a, c, t, g, unknown or other
  misc_feature (442)..(442): n is a, c, g, or t
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
  modified_base (469)..(469): a, c, t, g, unknown or other
  misc_feature (469)..(469): n is a, c, g, or t
  modified_base (502)..(502): a, c, t, g, unknown or other
  misc_feature (502)..(502): n is a, c, g, or t
  modified_base (558)..(558): a, c, t, g, unknown or other
  misc_feature (558)..(558): n is a, c, g, or t
tcagagtcgagagacacgaccggtgctcgatttagatctactgacgaggggctgagagaggacgcccagcccgtgggtattttcgaggttgttttcagttttggtgatcgaggactggagcagagagaactcactagtggtggttggctgagcggtgttacgttcgtagngtactaagttaagntcngtgngagtncgngngtgtgacgnggtgggctgtggacgcgcggtagggtccngacgtctctcgtgngcacgtctgtnacttcctagtcngttnttcagtgtcggtcgtcggaacncgcgccggnggagggtcggtgagcggtaagttcgacgtatacgnggtacttagtaacgttctaccatacgaagtcgtacacgtccgaggacgtcgcggtccaactcgactcgacgtagccaatcgaacagtactacgttnttcggacntaagngancgttaagccgnacgtagacgcgtacggctacgtattcgtagtancggtagtacgtcgtgactgtacgtgttacagtacgacggacgacgtacgtacggtn

SEQ ID NO: 96006 - DNA, 739 bp, Homo sapiens
  misc_feature: GYAE6OF01CAWJK.49.6.A06.1.454.CMB.1.raw
  modified_base (552)..(552): a, c, t, g, unknown or other
  misc_feature (552)..(552): n is a, c, g, or t
tcagagtcgagagacacgaccggtgctcgatttagatctactgacaggggctgagagaggagcccagccctgggattttcaggttgttttctatttggtgatcgaggactgagcaagagagaactcaccagtggtagttgggctgagtcgtggttctttttcgttgtggtacttaagttttaaaaggtcgtcctagtgtgaggtgcgtagcgtgggtggtacgtcggtgggggacgtcgttggacgacggtccggtcgggggtcctgacgtctcgtccgtgtcgacgacgtccgtcgtaggtacttccgtacgtttagcgttagtttcgaccgtggtcgggtaccgtcgggtacccgacgtacggtccgtaccgggaagggacgggtcgtagggtacggtcggtactacgtaacgttagtacggtacgttacgtacggtaacctaccgaactacgtaactacgacgtacgtaccgtcggtacggacggcctacgtacacctattccacgagtaaccgaactaacgtaccgaaagtacgtgtcgttattcganaactaagtgaacacgcgtcgtaggacgaccggtaacggaacgaccggtacgtaccgttaataccgttaacgtgggtaacccaaacgggtttacggtacggtaggttaccggtaagttaaccggtttataaaccgggtttcgaaacccgggtttagggaaccccgttacggggaaacggttaccccgg

SEQ ID NO: 96007 - DNA, 878 bp, Homo sapiens
  misc_feature: GYAE6OF01BHZAQ.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttcttgtggctattttaaaaggtgtccagtgtgaggtgcagctggtggactcgtgggggagcttggtacagccgtgggggtccctgagactctcctgtgcagcctctggattctaccgtttagctagttttcgcctagtcgggcgtcgggtcccgccgacggccgttccggaagggggtaacgggggtccgtggggaagggttcggggttacctaccgtaaacgtttagtttaacgggtccgggtttaacgtttacggggttaaacccttaacccgaacgtaacgttaaccgttaaccggaccgtaacggtaacccgttcccgggttaagggaaaccgggggtccccggtaccctttacccgaacccttaacgttaccctacccgtaacggaacgtaaccgtaaaccgtttaaccccgaaaacggtaaaccgtaacggtttacgggtttacggttttaccgttaacggtaaccgtaaaaacgttcggaaacggtaccgaacggtacccgtaagggaaccggtaaccggtacccgggaacgggtaacccggtaacccgggtaccgtttaacgttaaccgtttaacggttacgggtaacggtaaccgggtaaacgggtttcccggtacgggttacggtaccgttaaacggggtttaacccttaggttttacggaacccgtttaccggggtaaccggggtaccccggtaaaagggggttaaacccccggg

SEQ ID NO: 96008 - DNA, 819 bp, Homo sapiens
  misc_feature: GYAE6OF01BXQ93.49.6.A06.1.454.CMB.1.raw
  modified_base (673)..(673): a, c, t, g, unknown or other
  misc_feature (673)..(673): n is a, c, g, or t
  modified_base (742)..(742): a, c, t, g, unknown or other
  misc_feature (742)..(742): n is a, c, g, or t
tcagagtcgagagacacgaccggtgctcgatttagatctactgacgagggctgagagaggacgcccagcccgtgggtattttcgaggttgttttcagtttggtgagtcgaggactgagcagagagaactcactagtggtaggttggactgacgtcgttcggtttctttttgtaggtggtactttaaagttttaaaggtcgttaccgtaggtgtaggtaggtcgacgtagtcggtaggtacggtccgttcggggtggggacgtcgttaggtaccgcggtccgggtcgggtccagtcgtacctcgtcgtgcgctcgtcgtgtagtcttacgtacgttagtcgttagttcgcgtagtcggtcgtaccggtccgacggacggtaccggtacgggaaggggtacggtcggttacgggtacggttaccggtacttaacggtaacgttaggttacgttacggtttaacgtccggtaacctaacgtaacgttaccgttaacccggtacgaccgtaaccgttaccggtcggtaaacgggtacccgtccgttccgttaacccacgtaccgttacgtaccgtaaacgtaaccgtaaaccgttaaccgtaaacgaaacggttaacgttcggttttacggttacgttaacacggtaaacgtacgtacggaacgtaccggacgtagngaaccgggtacgaacgtacggaccgtacttggtacctacggtcgtacggtaacgtaaccgtggttccgngtttacgtaggttaacccgttagttacccggttacgggacgtaccggggtaccggaaaccggttaccggtaacccgg

SEQ ID NO: 96009 - DNA, 900 bp, Homo sapiens
  misc_feature: GYAE6OF01ERJMS.49.6.A06.1.454.CMB.1.raw
  modified_base (311)..(311): a, c, t, g, unknown or other
  misc_feature (311)..(311): n is a, c, g, or t
tcagagtcgagagacacgaccggtgctcgatttagatctactgacaggggctgagagaggagcccagccctgggattttcaggttgttttcatttggtgatcaggactgagcagagagaactcaccatggtagtttgggctgagctggtcttttcttgtggcttattttaaaggtgtccgagtgtgaggtgcagtcgtggtggacgtcggtggggggagcgttggtacaggtccgtggggggtcccctgacgccttcgtccgtgtcgacagtcctcgtaggacttcctaacctttaggccttaggttttcnccgtaggtcgggtcgttccggggttcccgtaccgacggggtcccgttaccgggaagggggggtaacgggggtcgtaggggacgggtttcgggttaccttacgaacgttttaagttaccgggtaccgggtttaacttcggggttaaacctaaccgacgtaacttaaccgtaccgtacgaacgtaacccgtaccgggtagggtaaaccgggcccgtccggtttacccaaccgtacttttacccgacccgtaagaccgtaaactaaccccgtttaccgaaaaacgttaacgtagtttcggggtttacgttttacgtacgtaaccgtaaaacgggttgaggtaacccgtacgggtaaccccttggggaaaaccgggttacccgggacccggtaaaacgggaccccgttaaaccccggggtaccgttttaaagttaacccggttaacccgttagggtttacccggaaaaccggtttttaaacggggtccgggtacgtaagggttaccccttaagggttaccgttttaccgggttacgtaaaccccggtttaccggggtaacgggggtaaccctttaaagggggggtaacccccg

SEQ ID NO: 96010 - DNA, 961 bp, Homo sapiens
  misc_feature: GYAE6OF01BMFX1.49.6.A06.1.454.CMB.1.raw
tcagagtcgagagacacgaccggtgctcgatttagatctactgacaggggctgagagaggagcccagccctgggattttcaggtgttttcatttggtgatcgaggactgagcagagagaactcaccatggtaggtttggactggagcgtggtcttttttcttgtggtacttaagttttaaaggtgtccagttgtggaggtgcagcgtggtggtacgtcggtggggggagtcgttagggtacacggtcccgggttcggggggttccctaggacgtaccttccgttccgttggtcgtccttccggtcctcgttaggtacttttcccgtacccgtttcggtacgggttaccttaagtacggaacctgttcgtccggtacggtcccggggtccgacccggtacggtccccgtaccgggaaggggtaccgggaagggggttccggtaggggttagggttcggggttcggtacttaacgtttttacgacgtttacaagttacggtaaggtacggtaagggaaacgtaacgtaaacggtaactttaaacgttaaaccttaaggtaccggttaaccggtaccgttaccggggtaacgggtaaccggtaaccgtacgtttaacgtaccttacgtaaccgtttacctaacccggtaaacgtaacggtaaaccccttaaacggtaccccgaaaggtaacccgtacgtacccttaacgggttacctacgtaaccggtaacggtaaaacgttacgggtaaacccgtaaggggtagttaaagggtaacccgggttaaacggttaccgttaaaaccgggggaaaccgtaacccgggtttaacggggttttttaaaccttttaccgggttaaacgttttaaccgggaaacgtttacccggtaaaaaccgggtttaaaacccttttaaccgggaaaccccgggggttaacgggaaaacccgggttaaaccccccgggg

SEQ ID NO: 96011 - DNA, 607 bp, Homo sapiens
  misc_feature: GYAE6OF01DE22F.49.6.A06.1.454.CMB.1.raw
  modified_base (98)..(98): a, c, t, g, unknown or other
  misc_feature (98)..(98): n is a, c, g, or t
  modified_base (170)..(170): a, c, t, g, unknown or other
  misc_feature (170)..(170): n is a, c, g, or t
  modified_base (177)..(177): a, c, t, g, unknown or other
  misc_feature (177)..(177): n is a, c, g, or t
  modified_base (399)..(399): a, c, t, g, unknown or other
  misc_feature (399)..(399): n is a, c, g, or t
  modified_base (440)..(440): a, c, t, g, unknown or other
  misc_feature (440)..(440): n is a, c, g, or t
  modified_base (465)..(465): a, c, t, g, unknown or other
  misc_feature (465)..(465): n is a, c, g, or t
  modified_base (507)..(507): a, c, t, g, unknown or other
  misc_feature (507)..(507): n is a, c, g, or t
  modified_base (518)..(518): a, c, t, g, unknown or other
  misc_feature (518)..(518): n is a, c, g, or t
  modified_base (568)..(568): a, c, t, g, unknown or other
  misc_feature (568)..(568): n is a, c, g, or t
  modified_base (582)..(582): a, c, t, g, unknown or other
  misc_feature (582)..(582): n is a, c, g, or t
tcagagtcgagagacacgaccggtgctcgatttagatctactgacaggggctgagagaggagcccagccctgggattttcaggttgtttcatttggtnatcaggactgagcagagagaactcacatggagtttgggctgagcgtgtgtttctaggtgctaatttaaaggntcagtgngagtcgcagcgtggtcgactcgtaggggacgtcgttggacaggtccgtgggggtaccctgaacgctcgtcctgtcggactacgcctagtacggactttccgaacttaacgcgttaagtttgacctaaggtcggtccgtacggtccgaacgacgtctaccggaagggtaacggctcggacggtggtacttacgaacgttatacggctagttacgacctacganaacgtcctagtccaagtaccgtcgaggaacgcgtaccttanaccttcactacgacgtaagactaanaccgtagtaacgatcggttacttgtaactataaactggtacncgacgtacganaggacgtaccgaggtacacgtcgtatactgtagtgatagtactgtacggntacggtatacgtanacgtataccgggaactgggtaaacc

SEQ ID NO: 96012 - DNA, 586 bp, Homo sapiens
  misc_feature: GYAE6OF01AJ0MP.49.6.A06.1.454.CMB.1.raw
  modified_base (457)..(457): a, c, t, g, unknown or other
  misc_feature (457)..(457): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtggcttttctgtggctattttaaaaggtgtcagtgtgaggtgcagctggtggactcgtgggggaggcttggtacagccgtggggggtccctgagactctcctgtgcacgcctctggacttcctacctttagctagtttttgccagtgggctgggtcccgccgaggctccgaggggaaggggctgggaggtgggtctacaacttattaggcggttattcggtactaccacactactacgcagactccggtagaacgggccgactcacctatcctcagacacactaccaagactgtggtgttctgactaatgacncgacgtctacgagacgccggagaccgacggcgtatacgttacgtggtacgacggttaacgttcgtcgtaggtctacggttactacgtttacgacgttaccgggcgggtacccggtaacgggtaacccgg

SEQ ID NO: 96013 - DNA, 931 bp, Homo sapiens
  misc_feature: GYAE6OF01DV87B.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggtagttggctgagcgtgtcttttctgtgtactaagtttaaaggtgtacagtgtgaggtgcagcgtggtcggactcggtgggggaggtccgttggtaccgacggtccggtacgggggtcctggacgtaccttcctccgttgcgcgtacggtccttcgtcgggttaccttccgttaacccgttttaaggacccgttagtttttaccgccgttagggttcggggtccggttaccggggtccccggtaccggtacggggtcccgttaaccggggaaggggggtaccggggtcggttaggggtacggttcgggtaccctaacgtaaacgttaggtaacgggtacgtttacgttacgggtaacctaaccgtaactagtaaccgtacgaaccgaacgtacccgtacggtacggacggtcccgtacttacccgaacctcttacccacgtaacggaaccttaacctaaaacgtttcccgaaaagttaaaccgtgtttaaccgggtttcgtttaacggtaccggtaaaacttaaacggtacggtaaacgtaccgtaaacccgggtcgtaaaccgggagaacccgggtaccgggtaaaccgggaaccgggtttaacccggtaaccgtttagtttaaacccggttaccggttaagggttaaccggtaaacccgggttaacggtttaccccgggtagggtttaacccggggttaacggtttaaaccgttaaaccggtttaaggttttacccggaaaccccgggttttaaacgggggacccgggggtaaacccggttaaaccgggggtaaaccccgg

SEQ ID NO: 96014 - DNA, 932 bp, Homo sapiens
  misc_feature: GYAE6OF01EBI8N.49.6.A06.1.454.CMB.1.raw
tcagagtcgagagacacgaccggtgctcgatttagatctactgacaggggctgagagaggagcccagcccgtgggtattttcaggttgttttcatttggtgatcaggactgagcagagagaactcaccagtggtagtttgggctgagtcgtcgttcttttcgtggtaggtacttaagtttaaaggtcgtccgtaggtgtgaggtgacgaggtcgtggtcggtacgtcgggtgggggagtcgttaggtacgacggttccggtccgggggtaccctaggtaccgtaccttccgtaccggtcgtacgaccgtcggtccctttcggtacggttacctttaccgttaacccgtttacggtacgtttacggtttccgaccggttacgggtcggggtccgttacccgggggtacccgaccggtaaccggggtcccggtaacgggggtaacggggggtacggggtccggttaggggtaccggttacgggttaccttaacgtaaaccgttaggtttacgggtaacgttacgttaccggtaacctaccgtacgtaccgtaccgtacggacgtaacggtaccgtaggtacggaacggtccctacgtaactaccgtacgtacctacgaacgtacgtaactaacgttaacgaagtaacgttggtttaggttacttacgtaacgaaaccgttaaggtacgtacggaccgttacccgggaagtacgggtaacggacccgggtaaacccggtaaaggggttacccgtaacgggttaaccccgttttaaagtccgggttttaaaccttcggggtaaaaccgtaccggggtttaaccggtacccgggttacgggttacccgttaggttaaaacccggtttcgtttaacgggtttaacccgtaccgggttaccgggggtaaacggtacggggtaaaccccgggtaaacccg

SEQ ID NO: 96015 - DNA, 729 bp, Homo sapiens
  misc_feature: GYAE6OF01BLT46.49.6.A06.1.454.CMB.1.raw
  modified_base (290)..(290): a, c, t, g, unknown or other
  misc_feature (290)..(290): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttcttgtggcttaattttaaaaggtgtccagtgtgaggtgctagctggtggactcgtgggggagcttggtacgaggccgtgggggtcctggacgactctcctgtagcacgcctactggtattcctacttagctagttttnccatcgggctcggtccgcgaggcgtaccgaggggaagggcgtgggacgtgggtcctacgtaaactagtaggtcggtattacggtacctaaccgaacattaaccagtacaagtacgtcccgtggaaccggcctacttacacctagtccacctagaacgtacaaacttaccgaaagaaccgtattaggtacgttttacgtagtacaaagtaggacgtacacgtacgtacggaacggtaacggaccggtaagggaaccgtacccgggtaacccggttattaaaccggtttacgtacggttacgggtaaaccggttaaaacgggttcccgggtaaggttacgggtaacgtttaaaccgggttaaccgttaacggttttaacggtaacccggttaaccggtaaacggggggggtaaccccgttaaagggggtaaaacccccggg

SEQ ID NO: 96016 - DNA, 739 bp, Homo sapiens
  misc_feature: GYAE6OF01CM2O3.49.6.A06.1.454.CMB.1.raw
  modified_base (229)..(229): a, c, t, g, unknown or other
  misc_feature (229)..(229): n is a, c, g, or t
  modified_base (544)..(544): a, c, t, g, unknown or other
  misc_feature (544)..(544): n is a, c, g, or t
tcagagtcgagagacacgaccggtgctcgatttagatctactgacaggggctgagagaggagcccagccctgggattttcaggtgttttcatttggtgatcaggactgagcagagagactcaccagtggtagtttggctgagtcgttggttctttttcgtggtggtacttaaagtttttaaaaggtcgtaccgtagtgtggaggtgcgacgcgtggtaggacgttcggngggggtagtcgttggtacgacggtccggttcgggggtcctggaacgtcctcgtccgtgtcgactacgtccgttcgtacggttacttccgtaccgtttaacgcgtttacggttttcgaccgtaacggttcgggccgttaccgggtacccgtacggacggtaccgttaccgggaaggggggtaacgggtcggtagggtaacggtcggggtacctaacgtaacgttagttacggtacggttagttcggtaacctacgaactacgtaaccgtcgacgacgtacgtccggaggaccggctcctacacctactcgacgaanacgtaacttaacgtacgaaacgtacgtagttcgttacgttaccgagacctaaaggtacgacgtcgacgttcgaggaacggtaccggaccgtaggaacccggttcggtaacttacgtcttaacggcgtaacgacgttacgtcggtagcgtacgtacgtcttagttccgaacgtacgggtcggaaccgtacggtacc

SEQ ID NO: 96017 - DNA, 527 bp, Homo sapiens
  misc_feature: GYAE6OF02HT2WW.49.6.A06.1.454.CMB.1.raw
  modified_base (431)..(431): a, c, t, g, unknown or other
  misc_feature (431)..(431): n is a, c, g, or t
  modified_base (468)..(468): a, c, t, g, unknown or other
  misc_feature (468)..(468): n is a, c, g, or t
tcagagtcgagagacacgaccggtgctcgatttagatctactgacagggctgagagaggagcccagccctgggattttcaggtgttttcatttggtgatcaggactgagcagagagaactcaccatggagtttgggctgagcgtgcgtttctagtggctatttaaaggtgtccagtgtgaggtgcagctggtggactctgggggaggcttggacagccctggggggtccctgagactctcctgtgcagcctctggattcacctttagcagtttgccatgggctggtccgccaggctccagggaagggctggagtgggtctcaactattagcggtattggtactaccacatactacgcagacctccgtgaacgggccgcttcacccatctccagagacaattccaaagaacataggtgtttctgcaaatgancagcctagagagcccgaggacacggccgtatattacngtgcggaagtcgcgtgcttaggtactagtttgacgttacgtcggggaccagggtaaccg

SEQ ID NO: 96018 - DNA, 638 bp, Homo sapiens
  misc_feature: GYAE6OF02HD4C4.49.6.A06.1.454.CMB.1.raw
  modified_base (172)..(172): a, c, t, g, unknown or other
  misc_feature (172)..(172): n is a, c, g, or t
tcagagtcgagagacacgaccggtgctcgatttagatctactgacagggctgagagaggagcccagccctgggattttcaggtgttttcatttggtgatcaggactgagcagagagaactcaccatggagtttgggctgagcggcgtggttctaaggcggctatttaaaggngtcagtgtgagtgcagctgtggactctggggaggcgtgtacgagcgtcggggtccgtgagacgtctcgtgtgcgacgcctcgtgtattctaccttacgtcgtagttcgtcgtagtcggtcgtcggtccgtccgacgtcgtcgacgggacgggtcggtggtaggtcggtcgtacgtaacgtagtagtacggtagttacgtacgtacctactactacgtacgtacgacgacgtaccgtacgtaacggaccgtcgtaccgtacctactaccgtaccgacgaacgtaacgtaacgtaaccgtaaacgaaacgtaacgttacgttacgttacgttacgtacgtaacgtagtacgacgacgacgtacgacgacgacgacggacgacgacgtacgtacgtacgtagtgtacgtacgtcgtcgtcgtacgtacgtacgtacgttacgtacgtacgtacggtacggtacggtacg

SEQ ID NO: 96019 - DNA, 536 bp, Homo sapiens
  misc_feature: GYAE6OF02GF0IB.49.6.A06.1.454.CMB.1.raw
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (440)..(440): a, c, t, g, unknown or other
  misc_feature (440)..(440): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtggcgttttctagtggctattttaaaaggtgtccagtgtgaggtgcagctggtggactctgggggaggcttggtacagccgtggggggtccctgagactctcctgtgcagcctctggattcacctttagctagtttgccatgggctgggtccgccaggctccgaggggaaggggctgggagtgggtctcaactattagcggtattggtactaccacatactacgcagactccgtgaagggccgcttcaccatctccagagacaattccaaagaacatggtntttcngacaaatgancagcctgagagccgaggaccacggccgtatattactgtgacgtaagttcgcgtgcttaggtactagtttgacttacgtggggaccaagggtaaccg

SEQ ID NO: 96020 - DNA, 602 bp, Homo sapiens
  misc_feature: GYAE6OF02GOD8J.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagcggtgtgtttctagtggctatttaaaggtgtcagtgtgaggtgcagctggtggacgtcgtgggggaggcttgggtacaggccgtggggggtccctgagactctcctgtgcagcctctggattcacctttagctagtttgccatgggctgggtccgcgaggctccgagggaagggctggagtgggtactcaacgtattagcggttaattcggtactacacatacgtacgcagactccgtagaacggccgcttccacctatctaccacgagactaaacttccaaagaacgatacggttgtttaccgagtactaaagtgaagtcaacgctgaagcggaccgagaccgacggaccgtagttacgttacgtgtagtaacggtaaagttcggacgttaggaccgttaagggtaaccttaggtttacggaccgttaacggtcggggtacccgtaaggggtaaacccg

SEQ ID NO: 96021 - DNA, 602 bp, Homo sapiens
  misc_feature: GYAE6OF02I4RLA.49.6.A06.1.454.CMB.1.raw
  modified_base (335)..(335): a, c, t, g, unknown or other
  misc_feature (335)..(335): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtggcgttttctgtggtctattttaaaaggtgtccagtgtgaggtgcagctggtggactctgggggaggcttggtacaggcctggggggtccctgagactctcctgtgcagcctctggattcacctttagctagtttgcctatgggctgggtccgccaggctccgagggaggggctggagtggtctcaactntagcgtattggtactacacatactacgcagactccgtgaacgggccgcttcgaaccctatcctaccagacgaacaacttacccaaagaaacagttcggtacgtttactagacaaattgaacgtcgagcctagacgagccgaggacacgggtaccgtagtaacttacgtgtacggacgtaaacggttcggtaccggttggtaccgttaagggttacctagttttacggaaccttaacggtcgggggtacccgaagggggtaaacccgg

SEQ ID NO: 96022 - DNA, 604 bp, Homo sapiens
  misc_feature: GYAE6OF02GGROV.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactctgggggaggcttggtacagccgtggggggtccctgagactctcctgtgcagcctctggattcacctttagctagtttgccatgggctgggtcccgccagggcctccgaggggaaggggctgggagtgggtctacaacgttagttaggcggttattcggtactaccactatacctacgcagactccgtagaacgggccgcttccaccatcctaccagacgaactaactaccaaagaactagtggttacgtttctagactaaatgagacagtccgtagaagacggaccgacggaacgaccgggtaccgtaataacttacgtgtagacggtaaacggttcggacgttggtacgttacggtacttagtttgaccttacggtacggggtaccgaacgggtaacccgg

SEQ ID NO: 96023 - DNA, 543 bp, Homo sapiens
  misc_feature: GYAE6OF02H9JJE.49.6.A06.1.454.CMB.1.raw
  modified_base (258)..(258): a, c, t, g, unknown or other
  misc_feature (258)..(258): n is a, c, g, or t
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
  modified_base (350)..(350): a, c, t, g, unknown or other
  misc_feature (350)..(350): n is a, c, g, or t
  modified_base (407)..(407): a, c, t, g, unknown or other
  misc_feature (407)..(407): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtggtcgttttctggtggctattttaaaaggtgtccagtgtgaggtgcagctggtggactgtgggggaggcttggtacagccgtggggggtcctgagactctcctgtgcagcctntggattcactttagctagtttgccntgggctgggccnccaggctccgagggaaggctggagtcggtctcaatatagcgtattggactaccanatacacgcagactcgagaacgggctctacacctatctccagacgacaacttccaaanaacaatagtgttcgttacgactaatagagacacgctgacgagacgacggacgacgacggtactactaactgtagacgaacgtacgtcgtcgtcgtagtacgtattacgtactacggtaggacggacggtaaaccgg

SEQ ID NO: 96024 - DNA, 532 bp, Homo sapiens
  misc_feature: GYAE6OF02HHRL6.49.6.A06.1.454.CMB.1.raw
  modified_base (384)..(384): a, c, t, g, unknown or other
  misc_feature (384)..(384): n is a, c, g, or t
  modified_base (423)..(423): a, c, t, g, unknown or other
  misc_feature (423)..(423): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactctgggggaggcttggtacagcctggggggtccctgagactctcctgtgcagcctctggattcacctttagctagtttgccatgggctgggtccgccaggctccgagggaaggggctggagtgggtctcaactattagcggtattggtactaccacatactacgcagactccgtgaacgggccncttcaccatctccagagacaattcccaaagaacatggtntttctgacaaatgagcagcctgagagccgaggacacggccgtatattactgtagcgtaagttcgcgtgctaggtactatttcgacttacgtcggggaccagggtaaccg

SEQ ID NO: 96025 - DNA, 542 bp, Homo sapiens
  misc_feature: GYAE6OF02IE6GI.49.6.A06.1.454.CMB.1.raw
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggcttttcttgtggctattttaaaaggtgtccagtgtgaggtgcagctggtggactcgtgggggaggcttgggtacagcctggggggtccctgagactctcctgtgcagcctctggattcacctttagctagttttgccagtgggctgggtccgccaggcctccgaggggaagggctgggagtgggtctcaacttattagcggtattggtactaccacatactacgcagactccgtagaacgggccgcttcaccatcctccagagacaatcaaagaacatggtntttcngacaaatgagcagctgagacgcgagacacggccgtatatactgtgacgtaagttcgacgtgacgttaggtacctagtttcgacttacggtcgggacccgagggtaaccc

SEQ ID NO: 96026 - DNA, 583 bp, Homo sapiens
  misc_feature: GYAE6OF02GYUE9.49.6.A06.1.454.CMB.1.raw
  modified_base (256)..(256): a, c, t, g, unknown or other
  misc_feature (256)..(256): n is a, c, g, or t
  modified_base (298)..(298): a, c, t, g, unknown or other
  misc_feature (298)..(298): n is a, c, g, or t
  modified_base (395)..(395): a, c, t, g, unknown or other
  misc_feature (395)..(395): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcggtgtgtttctaggtcggctatttaaaggtgtcagtgtgaggtgcagctggtggactcgtgggggaggcttggtacagccgtggggggtccctgagctctcctgtgcagcctntggattcacctttagctagtttgccagtgggctgggtccgcnggctccgaggggaagggcgtggagtgggtctacgaactagttagcggtattggtactacactatactacgcagactcgtgaacggtccgcttcaccnctctccagacgactaacttaccaaagaacattgggtctttacagtactaaagttgacgacacggtacctaggacgtacgccggaaggaccgttacggccgttaatacgtactgtacgacgtaagttcgcgtcgaccgttaggtacctatttcggaacttacgggtcgggtacccgtagggtaacccgg

SEQ ID NO: 96027 - DNA, 532 bp, Homo sapiens
  misc_feature: GYAE6OF02GOEKC.49.6.A06.1.454.CMB.1.raw
  modified_base (295)..(295): a, c, t, g, unknown or other
  misc_feature (295)..(295): n is a, c, g, or t
  modified_base (425)..(425): a, c, t, g, unknown or other
  misc_feature (425)..(425): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactctgggggaggcttggtacagcctggggggtccctgagactctcctgtgcagcctctggattcacctttagcagttttgccatgggctgggtccnccaggctccgaggggaaggggctgggagtggggtctcaactattagcggtattggtactaccacatactacgcagactccgtgaagggccgcttccaccatctccagagacaattccaaagaacatggtntttctgcaaatgagcagcctgagagccgaggaccacggcctatattactgtgcgtaaagttcgcgtgctaggtacagtttgacttacgtggggtaccagggtaaccg

SEQ ID NO: 96028 - DNA, 555 bp, Homo sapiens
  misc_feature: GYAE6OF02IB1RX.49.6.A06.1.454.CMB.1.raw
  modified_base (362)..(362): a, c, t, g, unknown or other
  misc_feature (362)..(362): n is a, c, g, or t
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactcgtgggggaggcttggtacagccgtggggggtccctgagactctcctgtgcagcctctggattcactttagctagtttcgccagtggctgggtccgccaggctccgaggggaagggctggagtgggtctacgaacttagttagcggtattggtactaccanatactacgcagactccgtagaacgggcctnttcaccatcncagagacaattcaagacagtgtnttcagacaaatgagcagctagagagccgaggaccacggtcctataacttagtgtacgacgtaagttccggcgtacgtcgttaaggtactagtttcgaaccgttaccggtcgggacccgaagggtaacccg

SEQ ID NO: 96029 - DNA, 704 bp, Homo sapiens
  misc_feature: GYAE6OF02HC6M2.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtgtcgtttctaggtggctatttaaaaggtgtcagtgtgaggtgcagctggtggactcgtgggggaggcttggtacagccgtggggggtccctgagctctcctgtgcagcctctggattcacctttagctagtttgcctagtgggctgggtccgaccgaggcctccgaggggaaggggctagggagtgggtactcgtaactagttacgcggttatggtactaccacatactacgcagactcgtagaaggccgcttaccacagtcctccgaagacgactaaacttacccgaaagaaacctagttacgggttagtttacgtacgtaacgaaagttcggaacgtacgtaggacccgttagggaacggacggacccggaacgggaaccgtaccgggtaccgttaaacgttaacgtttaaccgtaggttacggtaaccggttaaaacggggttttcccgaacgggtttacggtaaccggttttaacgggtaaacctttacggttttacggaaaccggtttaacccgggtacgggggtaaccccggtaacggggttaaaaccccggg

SEQ ID NO: 96030 - DNA, 594 bp, Homo sapiens
  misc_feature: GYAE6OF02IBUP5.49.6.A06.1.454.CMB.1.raw
  modified_base (193)..(193): a, c, t, g, unknown or other
  misc_feature (193)..(193): n is a, c, g, or t
  modified_base (216)..(216): a, c, t, g, unknown or other
  misc_feature (216)..(216): n is a, c, g, or t
  modified_base (260)..(260): a, c, t, g, unknown or other
  misc_feature (260)..(260): n is a, c, g, or t
  modified_base (400)..(400): a, c, t, g, unknown or other
  misc_feature (400)..(400): n is a, c, g, or t
tcagagtcgagagacacgaccggtgctcgatttagatctactgacaggggctgagagaggagcccagccctgggatttttcaggtgttttcatttggtgatcaggactgagcagagagaactcaccatggagtttgggctgagcgtggtcgttttctaggtggctattttaaaaggtgtcagtgtgaggtgcngctggtggactcgtgggggaggnttggacagccgtggggggtccctgagactctcctgtgcagcctntaggattccacctttagctagttttgcctagtgggctgggtccgccaggctccgaggggaagggctggaggtgggtctacaacttaattaggcggtattggtactaccatatactacgcagactcgtagacgggcgcttnaccatctacagaacgactaacttaccaaagaactagtggttagtttctaggacaaaattggaacgcaacgtcctaggaacggacgccgggaagaccgacggtcccgtaattacttaacgtgtacgtacgtaacgttcgacgtgaccgttaggtactagtttacgacttacggtcgggtaccgaagggtaacccg

SEQ ID NO: 96031 - DNA, 580 bp, Homo sapiens
  misc_feature: GYAE6OF02JM2DQ.49.6.A06.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
  modified_base (298)..(298): a, c, t, g, unknown or other
  misc_feature (298)..(298): n is a, c, g, or t
  modified_base (359)..(359): a, c, t, g, unknown or other
  misc_feature (359)..(359): n is a, c, g, or t
  modified_base (385)..(385): a, c, t, g, unknown or other
  misc_feature (385)..(385): n is a, c, g, or t
  modified_base (444)..(444): a, c, t, g, unknown or other
  misc_feature (444)..(444): n is a, c, g, or t
  modified_base (454)..(454): a, c, t, g, unknown or other
  misc_feature (454)..(454): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcggtgtcgttttctaggtcggctaattttaaaggtgtccagtgtgagtgcagctggtggactgtgggggagnttggacagccgtggggggtccctgacgactctcctgtgcngcctntgattcacttagctagtttgccngtgggctgggccacgnggctccgagggacgggctggagtgggtctacgacgtattggcggttattggtactaaccanatactacgcagactcgtgaaggcctnttccactatcctcgacgagaactaacgttaccaaagaacgaatggtacgtttacgcganaaagttcgancaagtccagacgacgacgacggacgacggtaccatacgttacgtgtcgacggttaaacgttcggacgttacggcgttaggtacctaagtttcgaccgttaacggtcgggaccgtaaggtaacccgg

SEQ ID NO: 96032 - DNA, 628 bp, Homo sapiens
  misc_feature: GYAE6OF02FYRTY.49.6.A06.1.454.CMB.1.raw
  modified_base (389)..(389): a, c, t, g, unknown or other
  misc_feature (389)..(389): n is a, c, g, or t
  modified_base (417)..(417): a, c, t, g, unknown or other
  misc_feature (417)..(417): n is a, c, g, or t
  modified_base (490)..(490): a, c, t, g, unknown or other
  misc_feature (490)..(490): n is a, c, g, or t
tcagagtcgagagacacgaccggtgctcgatttagatctactgacaggggcgtgagagaggagcccagccctgggattttcaggtgttttcatttggtgatcaggactgagcagagagaactcaccatggagtttgggctggagcgtggcgttttcttaggtggctattttaaaggtgtacagtgtgaggtgcagctggtggactcgtgggggaggcttggtacagccgtggggggtcccctgagactctcctgtgcagcctctaggtacttctaccgtttagctagtttcgcctagtcgggtcgtcggggtcccaccgacggtccgtaccggaagggggtaacggggcgtggggaggttcggggtacctaacgtaacgttagttacgnggttattgggaactacgatatactacgnaggacctcggtaggacggtccgtcttaccacgtactcctacgaagacacgtaactaccaaagaactatcggtntttcgtagactaaagtgaactcgagcctagagacggaccgtaggaccgacggtctaacgtagttcagtgacgaacggttcgagtacgtcgttaacggtctagtttcggaccgtacggtcggacggtaacggtaaccgg

SEQ ID NO: 96033 - DNA, 664 bp, Homo sapiens
  misc_feature: GYAE6OF02GVUUH.49.6.A06.1.454.CMB.1.raw
  modified_base (256)..(256): a, c, t, g, unknown or other
  misc_feature (256)..(256): n is a, c, g, or t
  modified_base (313)..(313): a, c, t, g, unknown or other
  misc_feature (313)..(313): n is a, c, g, or t
  modified_base (344)..(344): a, c, t, g, unknown or other
  misc_feature (344)..(344): n is a, c, g, or t
  modified_base (531)..(531): a, c, t, g, unknown or other
  misc_feature (531)..(531): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtgtcgttttctaggtggctatttaaaggtgtccagtgtgaggtgcagctggtggactcgtgggggaggcttgggtacagccgtggggggtccctgaggactcgtcctgtgcngcctctggattcacctttagcttagtttgcctagtgggtcgtcggggtcccgaccgngggccttccgaagggggtacgggcgtagggnggtcggggtcctactaacgttagtacggtcggttagttcggtacctaaccactataacgtcgacctacggactccggtaggaacgggtcccgcttaccacactcctaccgagacgactaaacttaccaaagtaactagtcgggttctttccgacggtaactaaagttgaacgactacgcctaggganaccgggacccgagggacctaacgggaccttagttaacttacgtggttacgaacggttaacgttcggaccgtgaacggttacggtactacgttttggaaccgttagggtaccgggtaccggaaggttaacccgg

SEQ ID NO: 96034 - DNA, 589 bp, Homo sapiens
  misc_feature: GYAE6OF02JV3LN.49.6.A06.1.454.CMB.1.raw
  modified_base (448)..(448): a, c, t, g, unknown or other
  misc_feature (448)..(448): n is a, c, g, or t
  modified_base (464)..(464): a, c, t, g, unknown or other
  misc_feature (464)..(464): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttcttgtggctattttaaaggtgtccagtgtgaggtgcagctggtggactcgtgggggaggcttggtacagccgtggggggtccctgagactctcctgtgcagcctctggattcacctttagctagtttgcctagtgggctcgggtccgccgaggcctccgaggggaacggggcgtgggaggtgggtctcaacttagttaggcggtattggtactaccgactactactacgcacgactccgtaggaacggccgacttccacactcctaccagacgacaacttaccaaagacatggttnttctgactaaagtgancgacgctagagacgaccgaggaccgacggcgtacttagtacgtgagtacgtaacgtcggtacgtaggtctaacggtactacgtttacgaaccgttacggtacggggacccgtaaggggtaacccg

SEQ ID NO: 96035 - DNA, 618 bp, Homo sapiens
  misc_feature: GYAE6OF02I4QAH.49.6.A06.1.454.CMB.1.raw
  modified_base (396)..(396): a, c, t, g, unknown or other
  misc_feature (396)..(396): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtggtcgttttctggtggctattttaaaaggtgtccagtgtgaggtgcagctggtggactcgtgggggagcttggtacagccgtggggggtccctgagactctcctgtgcagcctctggattcacctttagctagtttgcctagtgggctgggtccgccaggcctccgagggaggggctgggagtgggtctcaacttagttaggcggtattcggtactaccgactatactacgcagactccgtgaacgggccncttcacctatcctaccagacgaactaacttaccaaagaacagttggttcgtttacgtagactaaagtggaacgtccgaacgcccgtaggaacggtacggaccggtaacgggaaccgaccgggtacccgttaataacgttacgtggtacgacggtaaacggttcggacggttgtacgttaggtactagtttcgacttacggtcgggtaccgaagggtaacccg

SEQ ID NO: 96036 - DNA, 579 bp, Homo sapiens
  misc_feature: GYAE6OF02HDZNV.49.6.A06.1.454.CMB.1.raw
  modified_base (461)..(461): a, c, t, g, unknown or other
  misc_feature (461)..(461): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactctgggggaggcttggtacagccgtgggggtccctgagactctcctgtgcagcctctggattcacctttagctagtttgcctagtgggctgggtcccgccgaggcctccgaggggaggggcctgggagtggggtctcaactagttaggcggtattggtactaccgactatactacgcagactccgtagaacgggcccgcttccacctatcctccagacgacaacttacccaaagaaccagtggtgtttctgacaaatcgancagcctgagacgccggaaggacgaccgggtaccgtatacttacgtgtagacgtaaaggttccgacgtgacgtaggtactagtttcgaccgttacggtacgggaccgtagggtaacccg

SEQ ID NO: 96037 - DNA, 531 bp, Homo sapiens
  misc_feature: GYAE6OF02FSQ4D.49.6.A06.1.454.CMB.1.raw
  modified_base (146)..(146): a, c, t, g, unknown or other
  misc_feature (146)..(146): n is a, c, g, or t
  modified_base (171)..(171): a, c, t, g, unknown or other
  misc_feature (171)..(171): n is a, c, g, or t
  modified_base (177)..(177): a, c, t, g, unknown or other
  misc_feature (177)..(177): n is a, c, g, or t
  modified_base (196)..(196): a, c, t, g, unknown or other
  misc_feature (196)..(196): n is a, c, g, or t
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcggngtgttctaggtcgctatttaaaggntcagtntgagtgcagctggtgactntgggggagcttggacagcctggggggtccctgagctctcctgtgcngctctggatcnccttagcngtttgccntggcgtggtccgccncggctccgagggaagggcgtggagtgggtctcactattagtcgtagttggtacttaccacatactacgcagactccgtgaaggcggcttcaccatctccagagacacttacaacaacaatgtgttcttgtacaatagagcacgcctagagagccgacggacgacgaccgtatattacgtgtgacgtaacgttcgtcgtcgcgtacgtacgtacttacgtacgtacgtacggtacgacggtaacccgg

SEQ ID NO: 96038 - DNA, 558 bp, Homo sapiens
  misc_feature: GYAE6OF02IGS22.49.6.A06.1.454.CMB.1.raw
  modified_base (298)..(298): a, c, t, g, unknown or other
  misc_feature (298)..(298): n is a, c, g, or t
  modified_base (372)..(372): a, c, t, g, unknown or other
  misc_feature (372)..(372): n is a, c, g, or t
  modified_base (413)..(413): a, c, t, g, unknown or other
  misc_feature (413)..(413): n is a, c, g, or t
  modified_base (476)..(476): a, c, t, g, unknown or other
  misc_feature (476)..(476): n is a, c, g, or t
tcagagtcgagagacacgaccggtgctcgatttagatctactgacagggggctgagagaggagcccagccctgggattttcaggtgttttcatttggtgatcaggactgagcagagagaactcaccatggagtttgggctgagcgtgtcttttctgtggctatttaaaaggtgtccagtgtgaggtgcagctggtggactcgtgggggaggcttggtacagccgtcggggggtccctgagactctcctgtgcagcctctggtatttacattcaagtagttatgctatgctatggttcnccgagggtccaggcgaagggctgggagtgggtggctagttatatcgtatagataggaaaacaaaatactaacgntagactccgtaggaacggccattaccaactatccacccganaactaataccaaagaacactattcgttactactgctagaacacgtcagagatgacgacacgtntagtataatcacgttgcgcggaccaaggaacaacgtaattaccggaaccggtaagaccgttacggacggggacctaaccggg

SEQ ID NO: 96039 - DNA, 529 bp, Homo sapiens
  misc_feature: GYAE6OF02JZSU7.49.6.A06.1.454.CMB.1.raw
  modified_base (332)..(332): a, c, t, g, unknown or other
  misc_feature (332)..(332): n is a, c, g, or t
  modified_base (439)..(439): a, c, t, g, unknown or other
  misc_feature (439)..(439): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttcttgtggctattttaaaggtgtccagtgtgaggtgcagctggtggactctgggggaggcttggtacagcctgggggtccctgagactctcctgtgcagcctctggattcacctttagctagtttgccatgggctgggtccgccaggctccgagggagggctggagtgggtctcgaacgtnttagcggtattggtactacgacatactacgcagactccgtgaaggccgcttccacctatctccagagacaatccaagacatgtgttctagcaaatgagcagcctganacgccgagacacggctatagtactgtgacgtaagttcgacgtgacgttaggtactagtttacgacgttagtcgggaccgtaggtaacccg

SEQ ID NO: 96040 - DNA, 671 bp, Homo sapiens
  misc_feature: GYAE6OF02GNCPD.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttctgtggctattttaaaggtgtccagtgtgaggtgcagctggtggactcgtgggggaggcttggtacagccgtggggggtccctgagactctcctgtgcacgcctctggacttctacctttagctagttttgccctatgggctgggtcccgccgaggcctaccggaggggaacggggcgtgggagggtcgggtactacgtaacgttagttacggcggttagttacgggtaactaaccctaactaacgtaacctacgacaacgtacctccgggtaagggaaccggggccgtccgttaccaacctatccctaccgaagaacgaaacctaaacttaccaaaacgtaactagttacgggtttctttcgtagacttaaaagtggaacgcgacggtccgtaggaacggacgaccgggaaggaccgaccgggtccgtaattaacgttacgtgtagacgtaaggttcgacggtgtaccgtaagttactagtttacgacgttacggtcggggacctacgggtaacccgg

SEQ ID NO: 96041 - DNA, 831 bp, Homo sapiens
  misc_feature: GYAE6OF02GZV4X.49.6.A06.1.454.CMB.1.raw
tcagagtcgagagacacgaccggtgctcgatttagatctactgacagggctgagagaggagcccagccctgggatttcaggtgttttctatttggtgtatcaggactgagcagagagaactcaccatggagtttgggctgagctggtctttttcttgtggcttatttaaaggtgtccagtgtgaggtgcagctggtggactcgtgggggagtcgttggtacagccgtggggggtccctggacgacgtctccgtgtgcagccctcgtggtacttctacccgtttagccttagtttcgacctagtgggtcctggggttccccgccaggtccctaccggaaggggaaggggtcctggggaggtcggggtcctacggaacttacgttaggcggttaagttcggtaactaccgaactactactaacggtccaagtaccctcggtacggaacggtcccggtacttaccacccgtaacttcccaaccgagtaacgtaacctaaacttacccgaaaacgtaaaccgtaggttaccgggtttacgttttcggtaaccgtaaacgttaaaaacggtgtaaaccggtaaccgacgtaccccggtaaagggtaaaccggccgggtaaaacccggtaacggggaacccctaaccgggggtaaccccggttaaaatttaacccgggtttaaccgttggtacgggtaaacccggttaaaacgggtttccggaaccgggttacgtaacccgggtttaaagggtaacccctttaaggttttacccggtaaacccggttcccggggttaacgggggggtacccctaaaacggggggtttaaacccccgg

SEQ ID NO: 96042 - DNA, 821 bp, Homo sapiens
  misc_feature: GYAE6OF02ILIYQ.49.6.A06.1.454.CMB.1.raw
tcagagtcgagagacacgaccggtgctcgatttagatctactgacagggggctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactcgtgggggagcgttggtacaggccgtggggggtccctgagactctcctgtgcacgcctctggattccaacctttagctagtttgcctagtggggctcggggtcccgccgacggtccgtaccggagggggaacgggggtcctaggggtacggtcggggttcctaccgtaacttagttacggcggttattcggtacctaaccactatactacgacgaacgacgtaccggtaggaaccgggccgtccttaccacctatcctaccaaggacgtaacctaacgttaacccaaaaggtaaactagttacgggttcgttttacgacggtaaacctaaaagttcgggaaccgtaccgtaacggtaccccgttagggtaaacgggaacccgggaccccgggaaagggaaaccccggtaccgggttaacccggtttaaaggtttaaaccgttttaaccggttacgggttaccgggaaaccgggttttaaaaccggggtttccggtaccggggtttacggtaacccggtttaaacgggttaaacccgtttacggtttttaacccgggtaaccggtttaaacccggggtacggggggtaacccccggtaaacggggggttaaaacccccgg

SEQ ID NO: 96043 - DNA, 715 bp, Homo sapiens
  misc_feature: GYAE6OF02GTOKM.49.6.A06.1.454.CMB.1.raw
  modified_base (172)..(172): a, c, t, g, unknown or other
  misc_feature (172)..(172): n is a, c, g, or t
  modified_base (255)..(255): a, c, t, g, unknown or other
  misc_feature (255)..(255): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcggtgtgtttctaggtggctatttaaaggngtcagtgtgaggtgcagctggtggactgtgggggaggcttggtacagccgtgggggtccctggagactctcctgtgcagcctntggattcacctttagctagtttgcctagtggcttgggccgcgaggctccgagggaagggctggagtgggtctcgaactagttaggcggttattcggtaacctaccgaactagtacctaacggcaacgtactaccggtagaacgggcccgtactttacaacccgtatccgttacccgtaagggaacgtaaacctaaacgtttacccgaaacgtaaaccgttaaggttcgggttacgttttcgtacgtaaacccgtaaagttcgggaacttaccgaaacggtccccgttaggaaaccgggtacggaaccgggtaacggaaccggtaccgggtaacccggtattaaacgttcgtcggttagtaaccggttaaagtccggtacggttacgtaccgtttaacggtacttaacggtttcggtaaccgttacgggtaaccgggtaccggtaacgggttaaacccggg

SEQ ID NO: 96044 - DNA, 860 bp, Homo sapiens
  misc_feature: GYAE6OF02INR17.49.6.A06.1.454.CMB.1.raw
  modified_base (262)..(262): a, c, t, g, unknown or other
  misc_feature (262)..(262): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactcgtgggggaggcttggtacagccgtggggggtccctgagactctcctgtgcagcctctggnttcacctttagctagttttgcctagtgggctcggggtcccgccgacgggcctacccggagggggtaaacgggggctacggggaggtcggggttccgtcaaacgttagttaagggtcgggttaagtttggggtaaccttaacccgtaactacgttaaaccgtttaccggaaccgtaaggtaacccgttacccgggttaggggaaaaccggggggtccccggtaccttttacccggaaccccgtaacgtttacccgttaccccgaaagggtaaaccggtaaacccgtaaaaccgtttaaccccgaaaaacgtaaaacccgtaaaggtttaacggggttttcggtttttaaccgttacggtaaccctaaaaaggttcgggtaaacgtaccggaccgtacccggttagggaaacggttaccgggaaccccggggtaacggaacccggtaaccgggtacccccgggttaaattaaccgtttacgttacggttacgggaaccgggtaaacgttccgggaccggttacggtacgttaacggttaacgttactttacgggaaaccgtttacgggtacgggggtacccgtaaggggttaaaccccgg

SEQ ID NO: 96045 - DNA, 918 bp, Homo sapiens
  misc_feature: GYAE6OF02I77BG.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttctgtggctattttaaaggtgtccagtgtgaggtgtagctggtgactcgtgggggagcttggtacagcgtggggggtccctgagactctcctgtgcagcctcgtggattccacctttagctagtttttgaccctagtggggtcctggggtcccgtccgagggcctcccgtaggggaacgggggtcgttacgggtacggtgggggttcctacgtaaacttacgtttaaggacgggtttagttttacgggtaacccttaaccgaacgttaacgttaacccgttaaccggtacccgtaaaggttaacccgttcccggttaagggtaaaccggggggtcccccggtaccgttttaccccaaaccccggttatttaccccgttaccggaacggtaaaccgaaccgttaaaaccgtttacccgaaaacgtaaaccgtaagttcggggtttaaccgttttcccggtaggtaaacctaaagttacggtaaacggtacccgttaagaccccggttaacgaggggtaaaccgacccggggtaaacgggtaaaccgtacccgggggttacccggtttaaaacgtttaacggtttttaacccgttacggggttaagtacccggggttaaaaacggttttccgggaaccgggtttaccggtaacccggttttaaacggggttaccgttaaccgttttttacgggaaacccggttttaaccgggttaaccggggggggtaaccccgtaacgggggggttaaaccccttttaacccgggggg

SEQ ID NO: 96046 - DNA, 678 bp, Homo sapiens
  misc_feature: GYAE6OF02JHN9U.49.6.A06.1.454.CMB.1.raw
tcagagtcgagagacacgaccggtgctcgatttagatctactgactaggggctgagagaggagcccagccctgggattttccaggtgttttcatttggtgtactcaggactgagcagagtagaactcgaccagtggagtttgggctgagctggcttttctgtggctatttaaaggtgtccagtgtgaggtgcagctggtgactctggggagcttggtacagccgtgggggtccctgagactctcctgtgcaggcctctggacttcgacctttagcagttttgcctatcgggctggtccgcaggctccgagggacgggctggacgtgggtcctacgaacttagttagcggttagttcggtaactacccagtactacctacgactacgaccttccggtaggaaacggggcctacgtttccgaaccctaagttccgttacccgaaggaacggtaaccaaactttaccccgaaaaggtaacccaggtttagggtccgtttttacggtagacgtaaaacgttgacgaccaacggtccctagggacgacggaccggaacggaaccgaccgggtacgtacttaattacgtcgtaggtacgtaaacggtttccgacggtcgtacgtacgggtaacctagttttacgaaccgttacggtcggggtacccgaaggggttaaaccccgg

SEQ ID NO: 96047 - DNA, 624 bp, Homo sapiens
  misc_feature: GYAE6OF02GR1J1.49.6.A06.1.454.CMB.1.raw
  modified_base (462)..(462): a, c, t, g, unknown or other
  misc_feature (462)..(462): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactcgtggggggaggcttggtacagccgtggggggtccctgagactctcctgtgcacgcctctggattctacctttagctagtttgccagtgggctcgggtccgccgaggcctccggaggggaaggggcgtagggaggtcgggtctacgaacttagttaggcggttagttcggtacctaccactactacctacgcagactccgtaggaacggccgtcttccacctatcctaccagacgactaactaccaagaactagttcggtntttctgactaaatcgagcacgccgtagacgacggaccgtaggaccgaccgggtaccgtacttaacgttaccgtggtacgacggtaaacggttcggacggttcggtacgtacggttactacgtttacgtacgttacggtcggggaccgtaacgggtaacccgg

SEQ ID NO: 96048 - DNA, 651 bp, Homo sapiens
  misc_feature: GYAE6OF02JVXEN.49.6.A06.1.454.CMB.1.raw
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (295)..(295): a, c, t, g, unknown or other
  misc_feature (295)..(295): n is a, c, g, or t
tcagagtcgagagacacgaccggtgctcgatttagatctactgacagggggctgagagaggagcccagccctgggattttcaggtgttttcatttggtcgatcaggactgagcagagagaactcaccatggagtttgggctgagctggtcttttcttgtggctattttaaaaggtgtccagtgtgaggtncgagntggtggactcgtgggggagcttggtacaggcctgggggtcctgagactctctgtgcancctnggtatcacttagcctagtttcgctagtggctcggtccncgagctccgagggtagggcgtggagtgggtactacgaacttacgttagtaccggtagttacggtaacctaccacgtatacgtacgactaacgacctcggtaagtaacggggccctcgttaccaactcgtaccctaccgtaacggactaaccgaaacttacccgaaagtaaacttagtcgggtttactttaccgttacgaacgttaaagtcgaactacgacgtactaggacgacgaccgggacggaacgaccgggtactaagtacgttacgtgtaccgaagttaaccggtgtaccggtagtaccgttaggtacctagtttaccgagttaccggtgggtacccgacgggttaacccgg

SEQ ID NO: 96049 - DNA, 800 bp, Homo sapiens
  misc_feature: GYAE6OF02I8QXT.49.6.A06.1.454.CMB.1.raw
tcagagtcgagagacacgaccggtgctcgatttagatctactgacaggggctgagagaggagcccagccctgggattttcaggtgtttcatttggtgatcaggactgagcagagagaactcaccatggagtttgggctgagcgtggtcgttttcttaggtggtcttatttaaaggtgtccagtgtgaggtgcagctggtggacgtcgtgggggagtcgtggtacgacgccgtgggggtccctgagtactctccgtgtagcgtcgcctgtggacttaccaccgttagacttacggtttcgccgtagtcggtcgtcgggttccgcgtacggtccgtaccggaaggggtacggggtctacggggtacggttcggtacttaccgaaacgttagttaacgggtacggttaacgttaggttaaccctaacccgtaactaacgtttacctaacgggtactaaccggtaaccgtccgggtacggtaaaccgggtcccgtaccgttacccaacggtactcccgtaaccggaacgtaacggtaacctaaaccgtttacccgaaaacggtaaactaccgttgggttacgttacttaacgaacctaaaagttccgaaacgtacaccggttacggtaacgacgggtacgtacccggaaagggacccgttaaaccggccgttaaaatttaccgttacgttaacgtacgggtaaaccgttacggtccgggtaacggttcggttaaccgttacggttaacgtacgttttaccgaaccggttaccggggtacgggtacccggttaacggtaacccgg

SEQ ID NO: 96050 - DNA, 720 bp, Homo sapiens
  misc_feature: GYAE6OF02JI1ZM.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggcttttctgtggctatttaaaggtgtcagtgtgaggtgcagctggtggactcgtgggggaggcttggtacagccgtgggggtccctgacgactctcctgtgcagcctcgtggtacttcctaaccgtttacgcttagttttcgccgtagtcggggtcgtcgggtcccgccgaggcctccggaaggggacgggcgtgggaggttcgggtcctacgtaacgttagttacgggtacggttagttacgggtaacctaacccgaactaacttaccgtacgacaacggtaccgtaccggtaggaacggggtcccgtaccgttaccaaccctacgtacccttaccgaaacggaacgtaaacccgttacgttaacccgaaaagtaaactagtttacgggttacgttttccgtagtaactaaagttcgtaacgcctaaacggtccgtaaggacggaccggtaccggaacggtaaccgaccggtacgttaattaacgtactagggtacgacggtaacgttcggtacgtagtacgttaggtaccttagttcggtacgttaccggtcgggtaccgtaagggtaacccg

SEQ ID NO: 96051 - DNA, 727 bp, Homo sapiens
  misc_feature: GYAE6OF02HRP50.49.6.A06.1.454.CMB.1.raw
  modified_base (227)..(227): a, c, t, g, unknown or other
  misc_feature (227)..(227): n is a, c, g, or t
  modified_base (643)..(643): a, c, t, g, unknown or other
  misc_feature (643)..(643): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtggtctttttcttggtggtctaagttttaaaaggtgtccagtgtgaggtgcagctggtggactcgtgggggagcgttggtacnggccgtcggggggtccctgagtactctccgtggtgcgtacgcctcgtggtacttcctaccgtttagcttagtttcgcctagtcggggtctcgggtcccgcccgaggtcccgtaccggaggggaacggggtcctagggacggttgggtacctacgtaaacgttggttaagtaccgggttattacggtaacctacctaacgtactaacgttacgaccgacggtaacctccggtaggaaccgggtcccgtaccttacaacccgtatcccgtacccgaagtaacggtaacctaacgtttaccgaaaacggtaaactcggttcgggtttaactttaccgagtaacaaaacggttcgaacgactaaccggtcgtaggaacgaccggaccgaacggacgtaccgggcgtaaacttagttacgngtacgtacggtaacggttcggcgttaacgcgttaacgtacttcgttacgaccgtttacgggcggtaccggtaacgtaacccggg

SEQ ID NO: 96052 - DNA, 638 bp, Homo sapiens
  misc_feature: GYAE6OF02I1X0J.49.6.A06.1.454.CMB.1.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcggtgtcgtttctaggtcggctaatttaaaaggtgtcagtgtgaggtgcagntggtggactcgtgggggagcttggtacngccgtgggggtcctggagctctccgtgtgcagcctntggtattcacctttagctagtttcgccagtggtcgtcgggtccaccgacggcctccggaaggggaacggggtctagggtaggtcgggttacctacctaacgttagttaggtcggttagttacggtaacctaccactaagtaccttacggctaaacgctaccggtagaacggggtcctacttccgaacctctcctacgaagacgactaacttccaaagtactagttgtagtttcagtataagtgaacgcacgaccttagagacgaccgtagcctaaccggtcgtataacgttgtacggtacgtaacgtagttccggagtggtaaccttaaggtactacgtttcggaacccttgggacccgggtacggaacggttaacccgg

SEQ ID NO: 96053 - DNA, 743 bp, Homo sapiens
  misc_feature: GYAE6OF02HM0K5.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttcttgtggctattttaaaaggtgtccagtgtgaggtgcagctggtggactcgtgggggaggcttggtacagccgtgggggtccctgacgactctcctgtgcacgcctctggattcacctttagctagtttcgcctatggggctgggtcccgccgaggcctccggaggggaagggggcctgggaggtgggtcctacaacgtagttaggcggttagttggtaacctacacatacacgcagactcgtagaacgggccgtcttcacctactcctccgaagaacgactaaacttacccgaaagtaaacctagttgggttagttttccgtagtaaccgtaaagtgggaacgtaccgacgtccgtacgggaaacggtaccgggacccgggaacgggaacccggtaaccggggtacccgttaaagtttaaacgttttacccggttaggttacgggtaaccggttaaacgggttttcccggtaccgggttcggtaaacccggttaacggggttttaacctttacggttttaccgggtaaacccgtttaacccgggggttaccggggggtaaccccggtaaacggggggttaaaacccccgg

SEQ ID NO: 96054 - DNA, 621 bp, Homo sapiens
  misc_feature: GYAE6OF02HSM1U.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttcttgtggctattttaaaaggtgtccagtgtgaggtgcagctggtggactcgtgggggaggcgttggtacagccgtggggggtccctgacgactctcctgtgcacgcctctggattcctacctttagctagttttcgcctatggggctcggggtcccgccgagggcctccggagggggaacggggcgtgggaggtgggtctacaacgtattagcggtattcggtaactaccaactactaacctacgacagaccgtccggtaggaacggggcccgactttccgaaccctactcctacccgaagaacgaactaaacttacccaaagaaacacgttaggttcgtttctgtaacaaataggacgacagcctaggacgacgaccggacggacgaccggtcgtaataacttacgtgagtacgaaaggttcgcgtgactaggtactagttcgactggtacgggaccgaggtaaccg

SEQ ID NO: 96055 - DNA, 601 bp, Homo sapiens
  misc_feature: GYAE6OF02I3R4Y.49.6.A06.1.454.CMB.1.raw
  modified_base (222)..(222): a, c, t, g, unknown or other
  misc_feature (222)..(222): n is a, c, g, or t
  modified_base (299)..(299): a, c, t, g, unknown or other
  misc_feature (299)..(299): n is a, c, g, or t
  modified_base (323)..(323): a, c, t, g, unknown or other
  misc_feature (323)..(323): n is a, c, g, or t
  modified_base (451)..(451): a, c, t, g, unknown or other
  misc_feature (451)..(451): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttctgtggctattttaaaaggtgtccagtgtgaggtgcagctggtggactcgtgggggaggcgttggtacnggccgtggggggtccctgagactctcctgtgcagcctctggattcacctttagctagtttgccatgggctgggtccncgaggctccgagggagggctgggngtgggtctcaactattagcggttattggtactaccacatactacgacacgactccgtaggaacgggcccgcttccaaccatcctaccagaacgactaattacccgaaagaaccagttggtacgtttcngtacaaagtcgaagcaacgtccgtaggacgacgcccggaagggaccgaacgggtacccgtaattaacttacgtgtacggacggttaagtccggtacgtgccgttagttactagtttcgacttacggtcggggacccaaggggtaaccccg

SEQ ID NO: 96056 - DNA, 672 bp, Homo sapiens
  misc_feature: GYAE6OF02FZ4BL.49.6.A06.1.454.CMB.1.raw
  modified_base (595)..(595): a, c, t, g, unknown or other
  misc_feature (595)..(595): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttcttgtggcttaattttaaaaggtgtccagtgtgaggtgcagctggtggactcgtgggggagcttggtacagccgtggggggtccctgagactctcctgcgcacgcctctggattcaccttttagctaggttttcgcctagtgggaccgtcggggtcccgccgacgggcctcccggaggggacggggtctagggaggtggggtcctacgaaccttagttacggccggttaattcgggtaacctaaccactaattaccgtacgactaacgaccgtaccggtaggtaaacgggcccgtacttacccaaccgtacttcctaccgagaacgacctaaacttaccaaagtaactagtcgggttcgtttacgtcgaactaatgagaccacgtacccgtggaacggacggaccggtaaggacccgaacggtccgttaaatacgtttacgngtacggacgtaacgttccggcgttcgacgttaggttactagtttcgacgttacggacggggtaccgagggtaacccg

SEQ ID NO: 96057 - DNA, 699 bp, Homo sapiens
  misc_feature: GYAE6OF02HQ8DQ.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttcttgtggctaattttaaaggtgtccagtgtgaggtgcagctggtggactcgtgggggaggtcgttggtacagtccggtggggggtcccctaggacgtacctcctcctgtgcacgcctctggtattcctacctttagcttacgtttacgccagtggccgtgggtcccgccgaggccgttaccggaagggggaacgggtcgtagggaacggtgggttctacgtaacgttacgttacgacggttagttaggtaacctaccgaacaattaaccgacgtacgagtaccgttccgtaggaaccgggtcctcctttaccgaaccctactacctccgaaacgtacgtaaaccaaacgttacccaaaagtaaacagttacggttacgtttacgtacgtaacgtaaaagttacgaccgtacgcgtaccgtagtaaggaccgacggaacggaccgaaccgtacgtaacgtaacttacgtacggtagtaacgtaacgttcggacgtcgtagttacggtaattgtttcgacttacgggtaccggaggtaccgtaaccgg

SEQ ID NO: 96058 - DNA, 746 bp, Homo sapiens
  misc_feature: GYAE6OF02ICHOT.49.6.A06.1.454.CMB.1.raw
  modified_base (701)..(701): a, c, t, g, unknown or other
  misc_feature (701)..(701): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtggtctttttcttggtggctaagttttaaaaggtgtccagtgtgaggtgcagctggtggtactcgtggggggaggctttggtaacacggccggttcgggggggtccctgacgacctctccgtgtgcagtcctctggtatttcctacctttagcttagtttcgcctagtcggtcgtcgggtccgcccgaggtccgtaccggaaggggaacggggtcgtagggtacggtcgggtactacgaaacttagttacggtacggttagttacggttaacctaccgtactaacgtaaccgtaccgactaacgaccgttaccggtaacgggtaacgggtcccgtaccgttaccacccgtacttcccgtacgtaacgaacgaaactaaccttaaccgaaaataaccgtaagttcggtttgttttaccgtagtaaacgtaaagtcggaacgtacgaacggtccgtaggaacggaccgacgggtaacggaccgtaaccggtaccgttaattacgttacgtgtacggtaacgttaacggtcggtacggtctaccggttaagtaaccgttntttacggacgttaccggggtacgggacccgtaagggttaacccgg

SEQ ID NO: 96059 - DNA, 717 bp, Homo sapiens
  misc_feature: GYAE6OF02JHQEP.49.6.A06.1.454.CMB.1.raw
  modified_base (299)..(299): a, c, t, g, unknown or other
  misc_feature (299)..(299): n is a, c, g, or t
tcagagtcgagagacacgaccggtgctcgatttagatctactgacaggggctgagagaggagcccagccctgggattttcaggtgttttcatttggtgatcaggactgagcagacgagaactcaccatggagtttgggctgagctggcttttctgtggctatttaaaggtgtccagtgtgagtgcagctggtggactcgtggggagcttggtacagtccgtgggggtccctgacgactcgtcctgtcgcagtcctctggacttcaccgtttgctagttttcgccagtcggctgggtccncgaggcctcgagggaggctggagtcggtctacgaactagttgtcggtatggtaccacctagtagtacctacgcacgacgtaccgtggtaacggccgtccttaccacgtacttaccgtaccgtaagaaccgtaaccgtaaacgttaccccgtaaaagtaaccgtaacgttcgggtttaccgtttaccgtacggtaacttaaaccggttacggaccgtacgtaaccgggacccgttagaacccgggttaacgacccggtaacgggtaccgtaaaccgggtcgttaaaccgttaacgtttacgtcggttaccgacggttaaacgttccggttaacggttcgaaccggttttacgtaacgttaccgttttacggtaacccgttaacgggttcccgggaacggttaacccgggttaacccggg

SEQ ID NO: 96060 - DNA, 965 bp, Homo sapiens
  misc_feature: GYAE6OF02HVJ9Q.49.6.A06.1.454.CMB.1.raw
  modified_base (226)..(226): a, c, t, g, unknown or other
  misc_feature (226)..(226): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagttgggctgagctggtcttttctgtggtacttattttaaaaggtgtccagtgtgaggtgcagcgtggtggactcgtgggggacggcgttgggtacncggcccggtggggggtcccccgaagtaccgtcctccgttgtgcgacgtcccttcgtggtactttcctacctttagcttacgttttcgaccctaggttcgggccgttcggggttcccgaccgtacggtccgtaccggaagggggtaacggggtcggtgggtacgggtcggggtcctaacgtaaacgttagtttacggtacggtttacgttaccgggttaacctaacccgtaactaacgttaacccgtaacgcccaacgtacccgtaccggtaacggggaaaccgggtcccgttacctaccgacccgtacttacccgtaccgaaacggaaccggtaacctaaaaccgttaacccgaaaaacgtaaccttaacggtttacgggttttacggttttacccgtacgtaaaccgtttaaaacggtcgggtaaacggtaccccgtaccgggtaccccgttagggtaaaccgggtaacccggacccggggtaaaccgggaccccggttaaaccggggttacccggtttaaaacggttttaaaccgttaacccgggttagggttacccgggtaaacgggtttaaaccgggtttcccgggtaacccggtttaccggggttaacccggtttaaaccgggtttaaccgtttaacggttttttaacccgggaaccggtttttaaacccggggggtaaccgggggttaacccccggtaaaccgggggtttaaaccccccggtttaccgggggg

SEQ ID NO: 96061 - DNA, 873 bp, Homo sapiens
  misc_feature: GYAE6OF02HWH02.49.6.A06.1.454.CMB.1.raw
  modified_base (265)..(265): a, c, t, g, unknown or other
  misc_feature (265)..(265): n is a, c, g, or t
tcagagtcgagagacacgaccggtgctcgatttagatctactgacaggggctgagagaggagcccagcccctgggattttcaggtgttttcatttggtgatcaggactgagcagagagaactcaccatggagtttgggctgagcgtgtctttttctgtggcttattttaaaaggtgtccagtgtgaggtgcagctggtggacgtcgtgggggaggctttggtacaggccgtggggggtccctgagacctctcctgtcgcagcctntggtacttcctaccttgctagtttcgccagtgggcgtcgggtccgcccgaggccgtcggaggggagggcgtggaggtcgggttctacgtaacgttaagttaggtacggttacgttacgggttaccttacctaaccgtacttaaccgtaccgtacgtaccggtaacccgtacccgggtaacgggtaaacccggggtccccgttacccgtttcccgaacccctacgttaaccccgttacccgtaaacggtaaaccggtaaaccttaaacccgtttaacccggaaaacgtaaaaccctaggttttcggggtttactttttaccggtaccgtaaacgtaaacgttggaaccgtaccggtaccgtaccggtaggtaaaccgggacccgggaaccggaaccggggtaaaccggcccccgggttaaaccgttaaacggtttaaacccttaaccggtttgggtaaccggttaaacgggttaaccggttcccggggttaacggttcggtaaaccggtttaacccggggttaacttttaacgggttttacccgtaacccggggtttaccgggttaacccggggggtaaccccgggttaacgggttaaaaacccccggg

SEQ ID NO: 96062 - DNA, 766 bp, Homo sapiens
  misc_feature: GYAE6OF02I4HFD.49.6.A06.1.454.CMB.1.raw
  modified_base (701)..(701): a, c, t, g, unknown or other
  misc_feature (701)..(701): n is a, c, g, or t
tcagagtcgagagacacgaccggtgctcgatttagatctactgacagggggctgagagaggagcccagccctgggattttcaggtgttttcatttggtgatcaggactgagcagagagaactcaccatggagtttgggctgagctggtctttttcttgtggacttaattttaaaaggtgtccagtgtgtagtgcagtctggtcggactcggtgggggacggtacgttggacacgccggttcggggggtccctgagacctccgtccgtgtcgcacggtcctacgtcggtacttcgtacctttagctagtttcgaccagtgggcttcggggtccacgacggtctaccggagggaacggggctagggtggtcgggtactacgaattaggttacggtacggttaagttacggtaacctacccaaacgtactaaaccgttaccgacctaacggaccgtttccgaacggggtaacggtccccggttccttaccctaacgtaactcccgtaacgtaacgtaacggaaccttaacgtaacccgtaaaaccggaactaaggttacggtttccgtttaaccgtagtaaccgtaaaagttcgaagtacctacggtacccggtagtaaccggaccggtaccggaacgggaacgtaacccggtacgtaaattaccgttacgttagtacggtaaccgttaagggttccgtaccgnggttaccttaggtactttagtacggtaaccttacgggtaccggggtaccgtaaagggttaacccg

SEQ ID NO: 96063 - DNA, 826 bp, Homo sapiens
  misc_feature: GYAE6OF02HNDOE.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttcttgtggcttattttaaaaggtgtccagtgtgaggtgcagcgtggtggactcggtgggggaggtcgtttgggtacaggccggtcggggggtcccctggagtacctctcctgtgcacgcctcgtggtattctacctttagctagtttcgcctagtcgggcgtcgggtccgccgaggcctccggagggggacggggcgtgggtaggtcgggtacctacgtaacttagttaacggtcggttagttacggtaacctaccaactaacgttaacctacggaccgtaacgtaccgttaccggtaggaaaccggggtcccgtacctttaccgaaccctacttacccgtacccgaaggaaccgaaacctaaacgttaacccgaaaagtaaaccgtaggtttacgggtttacgttttaccgtacggtaaccgtaaaagttcggaacgtaccgtaccggtaccggtagggaacgggaccgggaacccgggaacgggtaacccggtaaccgggtacccggttaaattaacggttttaaccgtacggttacgggtaaaccggtttaaacgggtttccggtacggttaccggtaccggtttaaacgggtttaaccgttaacggtttttacggaacccggtttacgggggtaccgggggtaacccgggtaacccggggttaaacccgg

SEQ ID NO: 96064 - DNA, 597 bp, Homo sapiens
  misc_feature: GYAE6OF02GK6QL.49.6.A06.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (414)..(414): a, c, t, g, unknown or other
  misc_feature (414)..(414): n is a, c, g, or t
  modified_base (524)..(524): a, c, t, g, unknown or other
  misc_feature (524)..(524): n is a, c, g, or t
tcagagtcgagagacacgaccggtgctcgatttagatctactgacagggggctggggtctcaggaggcagcgctctcaggacgtcaccaccatggcctgggctctgctcctcctcaccctcctcactcagggcacagggtcctgggcccagtctgccctgactcagccgccctccgcgtccgggtctcctggacngtctgtcacntctcctgcactggaaccagcagtgacgttggtgattataactatgtctctggtaccaacagtacccagcaaacgcccccagactcatgtatttatgtcgtcaaggtaacgccggtaccctcgacggggttccctgactccgcttctcgtcggctaccaagtcgtaggactaacgcgtccctcctcgaccgtctcgtcgggcgtccgggnacgaagagtcgaggtcctgttatttacttcctagctagtcctactattagcgcgtacgcgacgtaactaaacgttgtttacggtattaacgttcgtacgggtaccggggnggtaaacccgagtccggtaccgtcccggtaccggttaggacccgtacgcccggtaacggtcccttaccccggg

SEQ ID NO: 96065 - DNA, 786 bp, Homo sapiens
  misc_feature: GYAE6OF02G5V0U.49.6.A06.1.454.CMB.1.raw
  modified_base (178)..(178): a, c, t, g, unknown or other
  misc_feature (178)..(178): n is a, c, g, or t
  modified_base (191)..(192): a, c, t, g, unknown or other
  misc_feature (191)..(192): n is a, c, g, or t
  modified_base (196)..(196): a, c, t, g, unknown or other
  misc_feature (196)..(196): n is a, c, g, or t
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
tcagagtcgagagacacgaccggtgctcgatttagatctactgacagggggctgagagaggagcccagccctgggatttttcaggttgtttttcatttggtgatcaggactgagcagagagaactcaccatggagtttgggctgaggcgtgtgtttctaggtcggctaatttaaaggntcagtgtgaggtnnagtntggtaggctgtagggggngcttaggtaccgnggtccggtggggtacctgacgtactcgtcgtggtcgacgtacgtaccttcgttaggtactttcgttaaccgtttagtacgtttacgtttcaccgtaggttcgggtcggtccgggtaccgcccggtacggacccgtacgggaacgggggtacgggtccggtaggggtacggttcgggttacctaaccgtaacgttacggttacggtacgtttaacgttaccggttaaacgtaccgaactaacgttaacggttaaccgacgttaaacgttaccggtacgggtaacgggaacccggtcccgttacccgttaaccaaccgtacgtaccgtaaccggaacgtaacggttaaaccctaacgtaaaccgtaaaacgtaacgttacgttttacggttacgtttaataaccgtaaatacgtagtaacgtccgaacgtcggaaacggacggtaaccgggacgacggtaccggttacgttaagttactaacgttagacgttaacgtaccgtaagtcggtagttcgacgttacgttatagttaccggacgtacgggacggttacgtacggc

SEQ ID NO: 96066 - DNA, 804 bp, Homo sapiens
  misc_feature: GYAE6OF02I16DH.49.6.A06.1.454.CMB.1.raw
  modified_base (613)..(613): a, c, t, g, unknown or other
  misc_feature (613)..(613): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggaggtttgggctgagctggtctttttctgtggcttaattttaaaggtgtccagtgtgaggtgcagcgtggtggactcgtgggggaggcgttggtacagccggtcggggggtccctggacgaccgttctccgttggtcgacacgtcccgttcgtaggtattccctaaccgttttacggcgttaggttttcggacccgtaggttcggggccgttcgggggtcccaccggtacgggtccgttacccgggaagggggtaacggggtccgttaggggtacggttcggggttacctaacgtaaaccgtttagttacgggtaccgggtttaacttacgggtaaccctaacccgtaactacgttaacccgtaccgtacgtaacggtacccgttacgggttacgggaaccggggtcccgtccttaccaaccgtactccgtaaccctaaggaacgtactaaacggttaccaaaagggaaccttagttccgggttntttacgcgtaaactaacgtggacgacacgtcgtaggacgaacggccggaacggaaccgacggtccgtttaaatacggtttaccgtgggtacctaacggtaacgggttccaccggttacgggtaaccttaccgggttaattaccggtttacgaccggttacccggacccgggggtacgtaaccggtaaccgg

SEQ ID NO: 96067 - DNA, 829 bp, Homo sapiens
  misc_feature: GYAE6OF02HXRJY.49.6.A06.1.454.CMB.1.raw
tcagagtcgagagacacgaccggtgctcgatttagatctactgacaggggctgagagaggagcccagccctggggattttcaggttgtttttctatttggtgatcagggactgagcagagagaactcaccatggtagtttgggctgagtcgtggttctttttcttggtcggtactttaagtttttaaaaaggtcgttcctaaggtggttggaggtggcgaggtcgtgggtcggtaccgttcggtggggggtagtcgtttacggtacgaggtcccgggttcggggggttccctaggacgtaccttccgttccgtggtgccgtacgtccttcgtggtactttacctaccgtttagtcttacggtttcgacctaggtcgggtcggttccgggtcccgcgtacggtccggtaccgggaaggggacggtcgtggtacggtggtacctactagttaagtggtgttacgttaccgtaaccacctacgtaataccgtagacgtactaccgtacggtaggaaccggtccctacgttaccacccgtaactcccgtaacgaacgtaccgaaaccttaacgtaaccgaaacgtaactacggttggttacctttaacggtagtaaccgtaataggtaaccgacgtaaccggtacgttaacgggaacggaccggacgggaaccgggaaccgtaccgggttaccgttaaagttccttaacgggttacgttaacgggttaccggtaacggttccggtaacgttacggttaaccggttaacgtagttttacggttacggtaaaccggtttacggggtaccggtaaccgggttacccgtaacccggg

SEQ ID NO: 96068 - DNA, 731 bp, Homo sapiens
  misc_feature: GYAE6OF02HF39Y.49.6.A06.1.454.CMB.1.raw
tcagagtcgagagacacgaccggtgctcgatttagatctactgacgaggggctgagagaggagcccagccctgggattttcaggtgttttcatttggtgatcaggactgacgcagagagaactcaccatggagtttgggctgagctgctttttctgtggctattttaaaggtgtccagtgtgaggtgcagctggtggactcgtgggggagtcttggtacaggtccgtggggggtcccctggagtacctcgttcccgtgtacgcgagcctccgttaggacgtttcctaaccgttttaagccgtaaggttttcgcccgtaagttcggggccttcggggttcccgaccgagggtaccgttacccgaaggggaacgggggtccttaggggacggttcgggtctacgaaaccttagttaaggtcggttatttcggtaaccttaccgactaatacccgtacgcctaaggaccttaccggaggaacggcccgtcttaccacccgtacgtacctacccgaagacgaactaacttaccgaaagaactagtcggttacttcgagtactaaagttgacgtcacgtcctagaacggtcgacccgaagggtaaccgacgggtaccgttaacttaacgttacgttacggtacggtacgtaaacggttcgtaccggttggtaaccgttaggtaacttacgtttacggaaccgttacggtcggggtacccgtaacggggtaaacccg

SEQ ID NO: 96069 - DNA, 899 bp, Homo sapiens
  misc_feature: GYAE6OF02GKVZU.49.6.A06.1.454.CMB.1.raw
tcagagtcgagagacacgaccggtgctcgatttagatctactgacagggctgagagaggagcccagcccctgggattttcaggttgttttcatttggtgatcaggactgagcagagagaactcaccagtggtagtttgggctgagcgttggtcgtttttcttggtggtcttaagttttaaaaggtgtccagtgtgaggtgcagtctggtggtacgtcggtgggggagtcgtttggtaccaggtccggtcggggggtccctggacgtaccgtcctcgtgtcgctacgccgttccgtggtacctttaccgttaccgtttagtcgtttagttttcgccgtagttcgggtccgttccgggcccggtaccgaccgggtaccgtaccgggaacgggggtacggggtcggtagggtacgggttcggttaccgtaacgtaaacgtttacggttacgggtaccggttacggttaccggtaaccttaaccgaaaccgtaacttaacccggtaaccggtaccgaaccgttaccggtacccgggttaacggggtaacccgggcccggtttaccctacccgtaaacccgttaccgttccccgttaacgaaaccggtaaaccgtaaaacccgttaacctttaaaccgaaacgtaaacgttacggtttggttttcccgttaacgtaacgtaaacgttaaacgtacggaacgtaccgtaccgtacggttaccggaaagggtaccccgaacggggtacggaaccccggtaacgggtttccttaaacggtttacccgtttagtacggttaccgtaacgggttagtttcccggagttacccggtacgtttaaggtaaaccctttgtttaccggttaaccgtaccggggttcgggtaaccccggtaaggttaaccccgg

SEQ ID NO: 96070 - DNA, 836 bp, Homo sapiens
  misc_feature: GYAE6OF02IYH2Q.49.6.A06.1.454.CMB.1.raw
  modified_base (176)..(176): a, c, t, g, unknown or other
  misc_feature (176)..(176): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtggtcttttctaggtggctaattttaaaggtntcagtgtgagtgcagctggtgactcggtgggggacgtcgttggtaacgcgtcccggttgggggtccccttaggacggtaccttccttccgttggtacgccgtacggtccttcgtcggtactttaccgtaacttttaggaccgttaaggttttccggaccttaagttcggggtcttcggggtcccacgtacggtccgtaccgggaaggggtaacggggtctaacggggtacggttcgggtaccgttactaaaccgtttaggttacggtacggtttacgttacggttaaccctaacgtaactaccgttaccgttaacgccgaacgttaccggttaccggttaaggaccgggtcctaccgtttaccaccgtacgtaccgtacgacgtaacgtaaaccttaacgttaccaaagtacccgttaggttacgtttaccgttacgtacgtaaacgttaacgttacgaacgctaccggtcgttaacggaacggttaaccgggaccgtaagggtaaccgtaaccgggttacgtttaaaccgtacgtttaacgggtaccgtacgggtaacgggttacgttccggtcgggttacgaaccgttttaacggtacctttagggtttacccgtaccggtaaccggtttccgggaacccggttaacggtaaccccgg

SEQ ID NO: 96071 - DNA, 750 bp, Homo sapiens
  misc_feature: GYAE6OF02GU8TD.49.6.A06.1.454.CMB.1.raw
  modified_base (164)..(164): a, c, t, g, unknown or other
  misc_feature (164)..(164): n is a, c, g, or t
tcagagtcgagagacacgaccggtgctcgatttagatctactgacagggggctggggtctcaggaggcagcgctctcaggacgtcaccaccatggcctgggctctgctcctcctcaccctcctcactcagggcacagggtcctgggcccagtctgccctgactnagccgccctcgcgtccgggtctccgtggaccaggtctgtcaccgatcctcctagctacgtggaaaccagctagtgaccgttggacgtattaataactatgtctccgtggtaccaactagtaccctaggacaaacgcccccagtactacactgactttaatcggtacggtacaacgtaacgtccggtaccctacgagggggtcccctaggtactccgtcgtttctcgttcgggacttccgtaaacgtcgttcgggaccaaaccgaccggtcccgtaccccgtaggtaacccggttccgtaccggtcgggtcccgttacgggccgtagggaacgtacgtagggacgtcgtagtaagtttgtttcgtacgccgtaagtccctaacgttaacttacgtccgtaacggaacggccgtaaccgggtaactaaacccgtttaaaggtttttaccgggtagttaaacggttaccggttttaccgggaccggggaaccgggtaaaccgtaacgggtaccggttaccgggttaacccgttaccggtaaccggttaccggaacccggtacccggtaaccggtacccggttcccccgg

SEQ ID NO: 96072 - DNA, 907 bp, Homo sapiens
  misc_feature: GYAE6OF02FLAHD.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttcttgtggctatttaaaggtgtccagtgtgaggtgcagtctggtggactcgtgggggagcttggtacagccgtggggggtcccctgacgacctccctcgtgtcgacgtccgtccgtggtacgttacttaccgtttaaccgttcgacgttttggtaccgacgttgggtcggtcgggtcccggcccgacggtccggtaccgacgggtaaggggcggtacgggtagggtcgggttcggtacctaacgttaagttacggtacggtacgtttacggttacgtaaccctaactacgtaaccttaccggtaccgtaacgaccgttacccggtaacgggtaaggggacccgtcccttaacgtacccaccgttctacccgtaaccggaaggtaacccaaacgtttaaccccgtaacgaaaaccgtaaccgttacgggtttagggttttacccttacggaaccgtaaaacggttagtaaccggccgttaaacggtcccgttacggggtaaccgaacgggtaccccgggggaaaccggggttaaccgaaaccccggggtttaccgggtaaaccttttaaaggttaaccccgttttaaggggtacccgttaacggggttaaaaccgggttccgggtttaaccgggtacccgggtaaactttaacccgggggttacgttaaacccggtttttaggttaaacccgttaaccccggggttaccgggggtaacccggggttaaacccggggaaaccccgtttaacccggggg

SEQ ID NO: 96073 - DNA, 746 bp, Homo sapiens
  misc_feature: GYAE6OF02JEKOW.49.6.A06.1.454.CMB.1.raw
  modified_base (315)..(315): a, c, t, g, unknown or other
  misc_feature (315)..(315): n is a, c, g, or t
  modified_base (569)..(569): a, c, t, g, unknown or other
  misc_feature (569)..(569): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtggtctttttcttgtggctattttaaagtgtccagtgtgaggtgcagctggtgactcgtgggggagtcttggtacaggccgtggggggtcccctggagacctctcctgtgcagcctcgtaggtacttccaccttttagctagtttcgcctaggtcgggcgtcggggtcccnccgaggcctccggaaggggtacggggctagggacggtcgggtactacaacgttagttcggacggttacttagggtaccttaacccgactaatacctacggctaacgtccgtacccggtagggaaccgggcccctacttacccaacccgtattcccgtaccgaacggaaaccgtacttaaacccgttacgaaaacgtaacctaaggtttcgggttacttttacccgagtaacctaaacggttgaccggttaaacnccggtaactacggggaaccgaccgggtaccgaaccggggtaaccgaccgggttaacgtaactttacgtttaaccgtgggtacgaaacggtaacggtttcggccggttagtaaccgggttagtaacgtttattaccggaaccgttggggtaccgggtaccgaacgggttaaccccggg

SEQ ID NO: 96074 - DNA, 777 bp, Homo sapiens
  misc_feature: GYAE6OF02GXA6D.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggctttttcttgtggctattttaaaaggtgtccagtgtgaggtgcagctgggtggactcgtgggggagcttggtacagtccgtggggggtccctgagactctcctgtgcacgtcctcgtcggactttcctaaccgttttacgacgttagttttcgccctaggttcggggtaccttcggggttcccgacccgacgggtaccgttcccgggaaagggggaaccgggggtcgtacgggggtagggttcgggggttaccttaccgtaaaacgtttacgttaacggggttaccgggtttagtttacggggttaaaccctaacccggtaactaacgttaacccgttaccgaacgtaacggtaccgttaccggtaacgggaaacggggtcccgtaccgtttccaaacccgttacgtaccctacccggaacggtaacgaaaccgtaaactttaacccgaaaacgtaaaccgtacgtttacgggttacgttttaccgtacgtaactaaagtcggaacgtcgacgtccgaggacggacggaccgaacgggaccgacgggtaccgtattaacgtcgtagtacgacgtaacggttcgaggttgacgtagtatacgttgacttccgggcggtaccgaggtaaccgg

SEQ ID NO: 96075 - DNA, 679 bp, Homo sapiens
  misc_feature: GYAE6OF02GPVVT.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttcttgtggctattttaaaggtgtccagtgtgaggtgcagctggtggactcgtgggggaggcgttggtacaggccgtggggggtccctggagtactctcctgtcgcacgcctcgtggtacttccgtacctttagcgttagtttcgcctagtggcgtcggggtccgccgaggctccggaaggggtaagggcctagggaggtcggtctactaaacgttgtaggtcggttagttacgtacctaacctactaacgttactaacgcgaagtaaccgtccgttagggaaccgggtcccgtacttaccgaactactcctaccgaagtacgacttaaacttaccgaaaacgtaactaagttggttacgtttaccgtaggtaacctaaagttacgacgtactacggtcctaaggacgacgtacccggagaccgtacggcccttaaagtacgttacgtggtacgtacggtaacgttcggacgtcggtacttaacggtactattcggtaaccgtggtacgggaccgtaacgggtaaccg

SEQ ID NO: 96076 - DNA, 864 bp, Homo sapiens
  misc_feature: GYAE6OF02H08SG.49.6.A06.1.454.CMB.1.raw
tcagagtcgagagacacgaccggtgctcgatttagatctactgacaggggctgagagaggagcccagcccctgggattttcaggtgttttcatttggtgatcaggactgagcagagagaactcaccatggagtttgggctgagctggtctttttcttgtggtacttaagttttaaaaggtgtccaagtgtggaggtgcagcgtgggtgaccgtcggtgggggaggtcgtttggtaacaggtcccggttcggggggttacccctggacggtacccttcctccgttggtcgccgacgtccgttccgtagggtactttaccctaacccgtttaggtccttaacggttttcgacccgtaagggttcgggtaccggttcggggtccccgacccggtacgggtacccgttacccggggaagggggtaaccggggtccgttaggggtacggtttacggggttccttaaccgtaaaacgtttacggttaacggtaccggttttaacgttacgggttaaacccttaaccgaaaccgttaacgttaaccgtacccgaacgtaccggtacccgttaccggtacgggaaccggggtcccctacccgtttaacccgaaccctaccgttaccctaccggaagtaacccgtaaacttaaccttaaacccgaaaacgtaacgttaggtttccgggtttaccttttaaccgacggtaaactaaaggttcgaacggtccgaacggtaccgtaaggaaccggacccgggtaacgaccggacggtaccggttaccgtaattaccgttagtacgtacgacgtaccgtggcgttagtacgttacgtattacgttcgaaccgttgggtaccgaccggtaacggtacg

SEQ ID NO: 96077 - DNA, 777 bp, Homo sapiens
  misc_feature: GYAE6OF02JERA5.49.6.A06.1.454.CMB.1.raw
  modified_base (184)..(184): a, c, t, g, unknown or other
  misc_feature (184)..(184): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagttgggctgagctggtcttttctgtgtctaatttaaaggtgtcagtgtgaggtncagcgtggtggactcggtgggggaggtcgttgggactacggtccggttcggggggtccctggacgtacctccttccgtaggtcgcacgtcctcgtaggtaacttccttaccttgtaccgttagtttcggcctaggtcggggtcgtccggggtacccgcggtacggtccgtaccgggaaggggtaaggggtccgtgggtacggttcgggtacctacgtaactacgttggtacgttagttacggtactaccaactactacgtacgacgtacgtacgtcggtacggacgggtcctactccgactctcgtacagacgtaacctacgtaaccaaagtaccgtggtttacgttgtttaccgaacgtactaaacggtcgtaccgtactaccgggtactaacgggaacgggtccggaacccgggtaaggaaccccgggttaaccgttacccgttaaagtttaaccggttacgttagggtaccttaaaccggggttaattcccgggttacggaacggtttacgttaaacgtaacgttttcccggtttacgtaaccgggttacccggggtacggggtaacccggaaccgggttttaacccggg

SEQ ID NO: 96078 - DNA, 871 bp, Homo sapiens
  misc_feature: GYAE6OF02JFEDG.49.6.A06.1.454.CMB.1.raw
  modified_base (334)..(334): a, c, t, g, unknown or other
  misc_feature (334)..(334): n is a, c, g, or t
tcagagtcgagagacacgaccggtgctcgatttagatctactgacaggggctgagagaggagcccagccctgggattttcaggtgttttcatttggtgatcaggactggagcagagagaactcaccatggagtttgggctgagctggtctttttcttggtggtcttaagttttaaaaggtcgtccaggtgtgaggtgcaggcgtggtggactcggtgggggacgtcgttggtacgacggtccggtcggggggtccctggacgtaccgtcttccgtggtacgcctacggcccttcgtacggtacttcctaaccgttttacgcgttaaggttttcncccgtagttcggggccgtcgggttcccggaccgtacggtaccgttacccgggaagggggtaacggggtcgtacgggtaacgggttacgggtaccttacgtaacgttaacggtttacgggtaccggttaacgtttacggtaaccctaacccgaacgttaaactaacccggttaacgacctaacggttaccggtacccggttacgggaaaccggggtcccgttaacccttacccgaaccgtaccttccgtaaccccgtaaagtaaccggtaaacctaaactttacccgaaaaacggtacctagggtttagggtttacgtttaacagtaaacctaaacggtacggacgtactacccggtagaacggtacggacggacccggtaaacgggaacccgaccggttacgttaaacttacgttaccggtaggttacgaacccgggttaggttaccggtaccggacgttacggtttaaccggtaacgtttacggttaccgtaacccgggttccgggaaccggggtaccctaaacgggggtttaacg

SEQ ID NO: 96079 - DNA, 774 bp, Homo sapiens
  misc_feature: GYAE6OF02HB0G4.49.6.A06.1.454.CMB.1.raw
  modified_base (181)..(181): a, c, t, g, unknown or other
  misc_feature (181)..(181): n is a, c, g, or t
  modified_base (200)..(200): a, c, t, g, unknown or other
  misc_feature (200)..(200): n is a, c, g, or t
  modified_base (480)..(480): a, c, t, g, unknown or other
  misc_feature (480)..(480): n is a, c, g, or t
  modified_base (561)..(561): a, c, t, g, unknown or other
  misc_feature (561)..(561): n is a, c, g, or t
tcagagtcgagagacacgaccggtgctcgatttagatctactgacagggggctgagagaggagcccagccctgggattttcaggtgttttcatttggtgatcaggactgagcagagagaactcaccatggtaggtttgggctgagcgtcggtcgttttcgtggtggtactaatttaaaggngtcagtgtagagtgcagtntggtacgactcggtgggggagtcgttaggacgacggtccggttcgggggccctggaagtacctcgttcccttgtcgacgcggttccctagtgggtaccttaccgtacctttagtcttaggtttcgaccgtagtcgggtccgttacggggcccgtacctaacgggccttaacccgggaaggggaacgggtccgtagggtgggttcgggtaccttaacccgtaaagttaggtttccggaacggttacgttacggtacccttaacccataacgtacgtaccgngaaaccgtcgtcggtaacgggaacgggtcctcttacgacctactaccgtacgtacgacaactaacgtaaccgagtaaacgngttacgtacgttacgacgtacaaagttcggaactcgtaacggttacgacggaaccgacggacccgggtaaggaccggtaaaccggttaaccgttaggttaaaccttccggtaaggtacggttaacgtaacggttacggtcgttaaccgggtaactacggttaactacggttacccggaacgttccggtaacgggtaccgtaaggggtaacccg

SEQ ID NO: 96080 - DNA, 634 bp, Homo sapiens
  misc_feature: GYAE6OF02GIM2H.49.6.A06.1.454.CMB.1.raw
  modified_base (175)..(175): a, c, t, g, unknown or other
  misc_feature (175)..(175): n is a, c, g, or t
  modified_base (181)..(181): a, c, t, g, unknown or other
  misc_feature (181)..(181): n is a, c, g, or t
  modified_base (222)..(222): a, c, t, g, unknown or other
  misc_feature (222)..(222): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (360)..(360): a, c, t, g, unknown or other
  misc_feature (360)..(360): n is a, c, g, or t
  modified_base (436)..(436): a, c, t, g, unknown or other
  misc_feature (436)..(436): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcggtgtcgtttcgtaggtcgctaatttaaaggntcagtntagagtgacagctaggtgactcgtaggggagcgttaggacncgcggtggggtacctgacgctctctagcancgctacngtacttctacttgtctgttacgctagtcggtacgtcggccacgacggcgtacggaggggacggtcgtagtacggtcggtctactacgttaagttgacgttnttaggacctacactaatctacacacgtaccgtcggaacgtacgtacctacctacgctacgtacctacgaaccgtanaacgtactacgaaagacttgtagttcgttacagtaactagtgacaggtaccgcgtaagacgtacggaccggaacgtaacgccggttactaaagttcgtaacgttggaacggtaaccgtaagggttccgtacgtaccgtaacgttacgtaagttcttaccgggaaacgttcccggaacgggtacgacggggttaacccg

SEQ ID NO: 96081 - DNA, 740 bp, Homo sapiens
  misc_feature: GYAE6OF02GAN86.49.6.A06.1.454.CMB.1.raw
  modified_base (707)..(707): a, c, t, g, unknown or other
  misc_feature (707)..(707): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagcgtggtcttttcttgtggctaattttaaaggtgtccagtgtgaggtgcagctggtggactcggtgggggacggcgttggtacgaggtccggttcggggggtccctggacgaccttcctccgttggtcgcgacgtcccttcgtacggtactttccgtaaccgttttagccgttaggttttaccgcccgtagttcggggtccggttccgggtcccgtaccggacgggtccgtacccgggtaagggggaacggggtcggtacggggtaggttacgggtcctaaccgtacgttaagttacgggtcggtttacgttacggttaaccctaccgaacttacgttaaccgtagccgtaacgtaccgtaccggttagggaccgggtcccgttaccgttccaaccgttacttccgactaagaccgtaactaaccgttaaccaacggtaaacgtgtttagggttcgtttacgacgtaactaaagtcgtacgactacgccgtagaacgtacgccgaaggccggaacgtccgttaatcgttacgtgtacgacggttaagtcggacttgtacgtacgtnttagttcaccgttgggtcgacggtaggtaaccg

SEQ ID NO: 96082 - DNA, 775 bp, Homo sapiens
  misc_feature: GYAE6OF02H9OOX.49.6.A06.1.454.CMB.1.raw
  modified_base (571)..(571): a, c, t, g, unknown or other
  misc_feature (571)..(571): n is a, c, g, or t
  modified_base (590)..(590): a, c, t, g, unknown or other
  misc_feature (590)..(590): n is a, c, g, or t
  modified_base (621)..(621): a, c, t, g, unknown or other
  misc_feature (621)..(621): n is a, c, g, or t
  modified_base (632)..(632): a, c, t, g, unknown or other
  misc_feature (632)..(632): n is a, c, g, or t
  modified_base (676)..(676): a, c, t, g, unknown or other
  misc_feature (676)..(676): n is a, c, g, or t
tcagagtcgagagacacgaccggtgctcgatttagatctactgacgaggggctgagagaggagcccagccctgggatttcaggtgtttcatttggtgactcaggactgagcagagagaactcaccagtggtagtttgggctgagctggtctttttcgttgtggtacttaagttttaaaaggtgtccgtagtggtaggtacggtgcgagtctgggtcggtacgtcggtggggggaggtctttacgggtaacgcggtcccgggttcgggggggtccctggacgtaaccgttccgtccgttacggttgccacggtccctagttcgggtacctttaccgtaaccctttttaggccgtttacgttttcgacccgtggttcggggtccggtttcgggtccgtacccggacggcccggttaccgggaaaggggggacggggtagtacggggtagggttcgggtacctacgtaaaacgttagttacgggtaccgggttaagttcgggtaacccttaacccgactaacgtacgtaacgaccgagtaccgtcggtacgacggcctactacgacctgtaccntacgacactaactacgaanacgtagttggttctctaagactaaggtcganccgactacggngaaaccggcgacgttagaccgacgggttaccaagttcttaaggntaccggttacggttaacggtctacggtggtaaccggttacgtaccgtttgttaaccggtcggttaaccgggacggggttaacccggtagggtaaccccg

SEQ ID NO: 96083 - DNA, 839 bp, Homo sapiens
  misc_feature: GYAE6OF02G519Y.49.6.A06.1.454.CMB.1.raw
tcagagtcgagagacacgaccggtgctcgatttagatctactgacaggggctgagagaggagcccagccctgggattttcaggtgttttcatttggtgatcaggactgagcagagagaactcaccagtggagtttgggctgagctggtctttttctgtggcttaagttttaaaggtgtccagtgtgaggtgcagctgggtcggacgtcggtgggggaggtcgttgggtacgacggtccggttcggggggtcccctggtaacgaccttccgtaccgttggtcgctacgtccttcgtaggtactttccgtaaccgtttacgtaccgttagttttcgaccgtaggttcgggtccgtcggggttccccggacccggtacgggtacccgtacccggggaaggggggtaacgggggtcggtacggggtacgggtttggggtacctaccgtaaacggtttacggttaacggtacgggtttaagttaccggtaaccttaacccgaactaacgttaaacgtaacccgtacgtaacgtaacccggttacggtaaacggaaccggggtcccgtacctttacccgaccgtaacgtcctaacccgaaaggtaacctaaccgttaaaccgttaaccaaacgtaaacgttagttacgggtttacttaccgttaagtaacgtaaacgtacggaacgactacggtacctaggaccggacggaccggtacgaaccgtacggtaccgtaagttacttacgtgtaacgtaacggtaacgttccgggcgtaggtaccgttaacggttaacttaggtttcggtaaccgacgggtttacggggaccgtaacgggttacccgg

SEQ ID NO: 96084 - DNA, 903 bp, Homo sapiens
  misc_feature: GYAE6OF02F23WD.49.6.A06.1.454.CMB.1.raw
  modified_base (764)..(764): a, c, t, g, unknown or other
  misc_feature (764)..(764): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggtagtttggctgagctggtcttttcttgtgtcttaatttaaaaggtgtccagtgtgaggtgcagcgtggtcggtactcggtggggggaggtcgttggtacgacggtccggtcggggggtccctggacgactccttccgtgtgcacgtccctcgtcggtaacttccttaaccgtttacgtacgtttacggtttcgaccctaggttcgggtccgttccggggtcccgcggacggtccgtccgggaagggggtacggggtcgtcggggtacggttacggggttacctacgtaaaccgtttagttacggtacggttacgtttaccggtaacccttaacccgtaacgtaaactaccgtaaccggacctaacggtaaccgtaccggggttacgggaacccggggtacccttccgttaacccgaaccctacgttacccgaccggtaaacgaaacgaacccttaaacgtttacccgaaaaacggtaaaccttagggttacgggttttacttttacggtacgaaacgttaaaagcggtaacgtaccgaccgggttaaccgaggaaaccggggtacccgggaaaccggggtacgggaaccgggtacccgggttaacccgttttaaagttaaacggttttaacccgngggttaaccggtaacggtttaaacgggtttccgggaaccgggttacggtaaccgggtttaaagttaaccgttttacggttaccgggttaaaccggtttacggggaacccgggggaaccttaaacccgggggtaaccccg

SEQ ID NO: 96085 - DNA, 823 bp, Homo sapiens
  misc_feature: GYAE6OF02IO121.49.6.A06.1.454.CMB.1.raw
tcagagtcgagagacacgaccggtgctcgatttagatctactgacaggggctgagagaggagcccagcccctgggattttcaggtgttttcatttggtgatcaggactgagcagagagaactcaccatggagtttgggctgagcgtggtctttttcttgtggcttaattttaaaaggtgtcagtgtgaggtgcagcgtgggtggacgtcgtgggggacggtcgttggtacgacggtccggttcggggggtcccctggacgtaccttcctcctggtcgcacgccttctggtacttcctaccgttttacgcgttacgttttgacccgtggttcgggccggttcggggtcccgtacccgacgggtcccgtacgggaaggggggtacgggggtcgtagggggtacggttcggggttcctaccgtaaacgtttacgttaacgggtaccggttagttacggtaacccgtacccgtaactacttaccgtacacgaacgtaccgtcggtacgggaaccggggccctacctaccgaccctatcccgttaaccgagtaaccggaactaaacgttaccaaaacggtaaccttagttcgggttttaacctttgtaaccggaaacttaaaggtcggaaccgttcgtaaccggtccgtaggaacccgggacgggtaaccgcggaccgttaaccgggttcttaaagtttaacgttaacgttcggtagtaacccgggttaaacggtttcggtaccggtaccgttaacggtttaacggtacttttaaggtttcccgtaacggtacgggggttacccgggacccgtaagggttaaacccgg

SEQ ID NO: 96086 - DNA, 752 bp, Homo sapiens
  misc_feature: GYAE6OF02GP1B0.49.6.A06.1.454.CMB.1.raw
  modified_base (192)..(192): a, c, t, g, unknown or other
  misc_feature (192)..(192): n is a, c, g, or t
tcagagtcgagagacacgaccggtgctcgatttagatctactgacaggggctgagagaggagcccagccctgggattttcaggtgttttcatttggtgatcaggactgagcagagagaactcaccatggagtttgggctgagctggtctttttcttgtggtcttaattttaaaggtgtccagtgtgtaggtncagctgggtgacgtcggtgggggaggtcgttaggtacgacggtccggtcggggggttcccctaggaacgtaccttccgttccgttggtacgccgtacgtccttacgttacggttaacctttaccgttaaccgtttacgtacgtttacgtttacgaccgtaggttcggggtccggttaccgggtcccgaccggtacggtaccgtacgggaacggggacgggtcggtagggtaggttcggtacctacgtaacgtagtacggtacgttacgttacgtactaccgactactacgtacgtacgacgtacgtacggacgtaccggtccgtactacgacgtactaccgtacgagtacgtactaactaccgaaagtacgtaggttacgttacgttacgtactaacgtaagtcggacgtacacggtaccgttaaggacgacggaccgaacgtaccgtaacgtaccgttaagtaacgttacgagttacggtaacgtacggttcgacggttacgtaggttaacgtacgttacggttacgtaccgttacgggtacggtaccggtaacggtcg

SEQ ID NO: 96087 - DNA, 293 bp, Homo sapiens
  misc_feature: GYAE6OF01BV49X.12.37.D04.1.454.CMB.1.raw
  modified_base (290)..(293): a, c, t, g, unknown or other
  misc_feature (290)..(293): n is a, c, g, or t
tcagatacgacgtacacgaccggtgctcgatttagtagcatactgttgggtttgggagaagggtccctcaagatttcatggcgacttttctgggacaatttcaccctctccatcagcggtctggaacccgatgactttggaaagtattactgccatcagactcacattttccctccgacgttcgaccaagggaccatagtggctctcaggcgaactgtggctgcaccatctgtcttcatcttcccgccatctgatacgtcgtatctgagcgggctggcaaggcgcatagnnnn

SEQ ID NO: 96088 - DNA, 293 bp, Homo sapiens
  misc_feature: GYAE6OF01DRY8J.12.37.D04.1.454.CMB.1.raw
  modified_base (292)..(293): a, c, t, g, unknown or other
  misc_feature (292)..(293): n is a, c, g, or t
tcagatacgacgtacacgaccggtgctcgatttagtagcatactgttgggtttgggagaaggggtccctcaagatttcatggcgacttttctgggacaaatttcaccctctccatcagcggtctggaacccgatgactttggaaagtattactgccatcagactcacattttccctccgacgttcggccaagggaccatagtggctctcaggcgaactgtggctgcaccatctgtcttcatcttcccgccatctgatacgtcgtatctgagcgggctggcaaggcgcatagnn

SEQ ID NO: 96089 - DNA, 516 bp, Homo sapiens
  misc_feature: GYAE6OF01DQWOO.12.37.D04.1.454.CMB.1.raw
  modified_base (278)..(278): a, c, t, g, unknown or other
  misc_feature (278)..(278): n is a, c, g, or t
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
  modified_base (480)..(480): a, c, t, g, unknown or other
  misc_feature (480)..(480): n is a, c, g, or t
  modified_base (509)..(509): a, c, t, g, unknown or other
  misc_feature (509)..(509): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaatggtttcagcagaaaccagggaaancccctagactcctgattcacgaggcatccaattcggaaataggggtcccacgaaggttcagtggaggtggagctgggacagacttttacccncaccatcagcagcctgcagcctagaagntcttgacaacattaattactgtacaacagtaataataactcctacccgtactacttttggacctaggggaccaagctagganatacaaacgactggtgctgactacatctntctctac

SEQ ID NO: 96090 - DNA, 529 bp, Homo sapiens
  misc_feature: GYAE6OF01C7HD7.12.37.D04.1.454.CMB.1.raw
  modified_base (281)..(281): a, c, t, g, unknown or other
  misc_feature (281)..(281): n is a, c, g, or t
  modified_base (368)..(368): a, c, t, g, unknown or other
  misc_feature (368)..(368): n is a, c, g, or t
  modified_base (415)..(415): a, c, t, g, unknown or other
  misc_feature (415)..(415): n is a, c, g, or t
  modified_base (486)..(486): a, c, t, g, unknown or other
  misc_feature (486)..(486): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaatggtttcagcaagaaaccagggaaacncccctagactcctgattcacgagcatccaattcggaaatagggtccagaaggttcagtggaggtgagcgtgggacagtattttaccncaccatcagcagcctgcagcctagaagtatctagcaacattattacngtacaactagtaataataactcctacccgtaatacgtttacggacctaggggacaaggtctaggaacgtanaccgtaaacgactggtgactgactaccattctcgtcttcgtac

SEQ ID NO: 96091 - DNA, 544 bp, Homo sapiens
  misc_feature: GYAE6OF01BE9K3.12.37.D04.1.454.CMB.1.raw
  modified_base (374)..(374): a, c, t, g, unknown or other
  misc_feature (374)..(374): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaaattggtttcagcaagaaaccagggaaacgcccctagactcctgattcacgaggcatccaattcggaaatgggtcccagaaggttcagtggaggtggagcgtagggacagtactttacccncaccatcagcagcctgcagcctagaagtatcttagacaactatacttactgtacaactagtaataataactcctaccgtactacgtttcggaccgtacggggaccaagcgtaggagtaactacgaaaccgtaagtggtcggctagacctaccattactcgttccttctac

SEQ ID NO: 96092 - DNA, 568 bp, Homo sapiens
  misc_feature: GYAE6OF01DDC9H.12.37.D04.1.454.CMB.1.raw
  modified_base (281)..(281): a, c, t, g, unknown or other
  misc_feature (281)..(281): n is a, c, g, or t
  modified_base (379)..(379): a, c, t, g, unknown or other
  misc_feature (379)..(379): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagatcaccatcacttgccaggcgagtgaggacattacggtaaatttttaaatggtttcagcaagaaaccagggaaacncccctagactcctgattcacgaggcatccaagttcggaaagtacggggtcccaagtaaggttcaggtggaggtggagctgggacagtacttttacccncacatcagcagcctgcagcctagaagtatcgtagacaactattacgttaactgtacaactagttaataattaactccttacccgtacttacgttttcgggaccctaacgggggaccaaaggccgtagggaacgtaataccgaaaacgtactggtcggactggacctacctatacctcttcgttctaccg

SEQ ID NO: 96093 - DNA, 607 bp, Homo sapiens
  misc_feature: GYAE6OF01DVYEU.12.37.D04.1.454.CMB.1.raw
  modified_base (281)..(281): a, c, t, g, unknown or other
  misc_feature (281)..(281): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtcctgcttctggtcggagacagagtcaccatcacttgccaggcgagtgagactattacggtaaattttaattggttacagcagaaaccagggaacnccctagactctagattcacgagcactccaagttcggaaatcggggtacccaacggtaacggttcgaggttcggaggtgggagtcgtagggactaggtacttttacccacaccgtatcgacgcgacgcctcggcacgtcctagagactcgttacgacaactatattactagtacaactagtataacgttactactacccgtataccgttttacggaccgtaacgggtaccaacggtccgtaggtaagaacttaacccggaaaacgtaaccggtacggtcggaccttacggaccttaccgacttacgtacgttcctttaccgtaaccc

SEQ ID NO: 96094 - DNA, 599 bp, Homo sapiens
  misc_feature: GYAE6OF01C7503.12.37.D04.1.454.CMB.1.raw
  modified_base (283)..(283): a, c, t, g, unknown or other
  misc_feature (283)..(283): n is a, c, g, or t
  modified_base (375)..(375): a, c, t, g, unknown or other
  misc_feature (375)..(375): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatccctcctgtctgcttctgtcggagacagagtcaccatcacttgccaggcgagtgaggacattacggtaaatttttaagtggtttacagcaagaaaccagggaaacncccctagactctgattcacgagcatccaattcggaaatcgggtacccagtaagttcaggtggaggtgagcgtagggactagtattttacccncaccgatcagcagcctgcacgctagaagtatctagacaactatattactgtacaacgtataataacttaactccttaccccgtaacttaccgttttcgggaaccgtaacggggaacctaacggcgtagggaaacgtaacgtaaaccgtaaaaccggtaacttgggtacgggtacctacggaccctaacccgtaattaccctttcggttacctttaccgtacccg

SEQ ID NO: 96095 - DNA, 535 bp, Homo sapiens
  misc_feature: GYAE6OF01BJG6B.12.37.D04.1.454.CMB.1.raw
  modified_base (376)..(376): a, c, t, g, unknown or other
  misc_feature (376)..(376): n is a, c, g, or t
  modified_base (519)..(519): a, c, t, g, unknown or other
  misc_feature (519)..(519): n is a, c, g, or t
  modified_base (530)..(530): a, c, t, g, unknown or other
  misc_feature (530)..(530): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggtaaatttttaaattggtttcagcagaaaccagggaacgcccctagactctgattcacgaggcatccaattcggaaatacggggtcccacggaaggttcaggtggaggtggagcgtgggacagtacttttacccncaccatcagcagcctgcagcctagaagatcttgacaactatattactgtacaactagtaataatactctacccgtatacgttttcggacctaggggaccaaggcgtaggacgactacgaaacgattggtggcctgaccacctntctgttccttntaccg

SEQ ID NO: 96096 - DNA, 588 bp, Homo sapiens
  misc_feature: GYAE6OF01CY0PK.12.37.D04.1.454.CMB.1.raw
  modified_base (221)..(221): a, c, t, g, unknown or other
  misc_feature (221)..(221): n is a, c, g, or t
  modified_base (450)..(450): a, c, t, g, unknown or other
  misc_feature (450)..(450): n is a, c, g, or t
tcagatacgacgtacacgaccggtgctcgatttagtagcatactgttgggtttgggggacgaggagtcagtcccaacctggacacagcatggacatgaggtccctgctcagctcctggggctcctgctgctctggctcccaggtgccgagactgttggtacctattcccagtattggacccagttcctccatcctccctgtctgcttcgtgtcggaggacnggacgtcgaccggatcacttggccgggcgagtcaggggccatttacgctaattttttacgccttggtactcagcaagaaaccagggaaacttccacacctcctgagtctatgctgcactccgtctttgactaagtcgtacggggtccctattcgttacggttcagcggcagtgatcgtgggacagtagttcactctccacatcacgcacgcctgactagcctagaagtntgttacactaactttattactagtaacaaagtactaacgcgtccgtccccttacgacccgttcggaccgaacggggtacctacggtacgttagggtaagtacgttaacggaaccgtaacgttcggtcggtcctaccgg

SEQ ID NO: 96097 - DNA, 552 bp, Homo sapiens
  misc_feature: GYAE6OF01EHD31.12.37.D04.1.454.CMB.1.raw
  modified_base (391)..(391): a, c, t, g, unknown or other
  misc_feature (391)..(391): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcatctgtagcagacagagtcaccatcacttgccgggcaagtcagaccatcagcagctatttaaattggtatcagcagaaaccagggaaacgccctaaggtcctgatctatgctgcatcctagtttgacgtaaaggtcggggtacccagtacgaaggttcaaggtggcgaggttgggtacgtgggacagtatttccgacttcncaccatcaagcagtctagcaacctgtaagtattttcgactaactttactctagtacaacgtagtacgttacaacttacccctctacctaccgtggtaccggaccgtaacgggacaccgggtactaggaacgtaacttaaacggacgttgtacggcgtaccg

SEQ ID NO: 96098 - DNA, 563 bp, Homo sapiens
  misc_feature: GYAE6OF01DYP4E.12.37.D04.1.454.CMB.1.raw
  modified_base (391)..(391): a, c, t, g, unknown or other
  misc_feature (391)..(391): n is a, c, g, or t
  modified_base (409)..(409): a, c, t, g, unknown or other
  misc_feature (409)..(409): n is a, c, g, or t
tcagatacgacgtacacgaccggtgctcgatttagtagcatactgttgggtttggggcaggagtcagtcccaacctggacacagcatggacatgagggtccctgctcagctcctggggctcctgctgctctggctcccaggtgccagatgtgacatccagatgacccagtctccatcctcctgtctgcttctgtcggagacagagtcaccatcacttgccaggcgagtgaggacattcggaaatttttaaatggtttcagcaagaaaccagggaaagcccctagactcctgattcacgaggcatccaattcggaaatagggtccagaagtcagtggagtggagctgggacagactttacccgcaccatcaagcagcctgcagcctagaagntctgacaacatattactntacaacagataacacgttaccctccaacgtttcggacggagggaccaagggtgacggtaataccgaaaacggaaccttgggtacggccttaggaccctaacccgaaacgtttccgttacggtacccttttaccgaatttccccgttccccccgg

SEQ ID NO: 96099 - DNA, 529 bp, Homo sapiens
  misc_feature: GYAE6OF01D8M3G.12.37.D04.1.454.CMB.1.raw
  modified_base (375)..(375): a, c, t, g, unknown or other
  misc_feature (375)..(375): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggtaaaatttttaaattggtttacagacaagaaaccagggaaacgcccctagactcctgattcacgaggcatccaattcggaaataggggtcccagaaggttcagtggaggtggagctgggacagtatttacccncaccatcagcagcctgcacgcctagaagtatcttagacaactattattactgtacaactagtaataataatacctaccgtactacgtttggaccgagggaccaagcgtaggacatacgaaacgtactggtggctgaccacatctcgttctctac

SEQ ID NO: 96100 - DNA, 524 bp, Homo sapiens
  misc_feature: GYAE6OF01BGX1A.12.37.D04.1.454.CMB.1.raw
  modified_base (377)..(377): a, c, t, g, unknown or other
  misc_feature (377)..(377): n is a, c, g, or t
  modified_base (486)..(486): a, c, t, g, unknown or other
  misc_feature (486)..(486): n is a, c, g, or t
  modified_base (517)..(517): a, c, t, g, unknown or other
  misc_feature (517)..(517): n is a, c, g, or t
  modified_base (521)..(521): a, c, t, g, unknown or other
  misc_feature (521)..(521): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggaaatttttaaattggtttcagcagaaaccagggaacgcccctagactcctgattcacgaggcatccaattcggaaatacggggtcccaggtaaggttcaggtggaggtggagcgtgggacagtacttttacccncaccatcagcagcctgcagcctagaagtatcttgacaacattattactagtacaacataataataactctacccgtactacgtttcggaccgaggggaccagctagganactacgaaacgactggtgctgactacatctntctntac

SEQ ID NO: 96101 - DNA, 863 bp, Homo sapiens
  misc_feature: GYAE6OF01CPU8R.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacatttacggtaaattttttaaatggtttacagtacaagaaaccgagggaaacgccccctagactcctgtattcacgaggctacgttaccaagtttacgggaaaacttacgggggtaccccaacggtaacgggttcaggtgggaggtggagcgtgggaactaggtacttttacccacaacatacagcacgtccctaacgacgtaccgtagaaagtacttcgtttacggaacctaaacctaagtttaactttaaccgtacggttaacctaaaaccgttaaaggtttaaactttaaaactttaaaccgtttaccccgttttaaaccccccgggttttaaaccttttaaaccccgggttttttttaccggggaaacccccgggtaaaaccggggggggttaaacccctaaaacggggttaccccggtttaaagggggggtaaaaccgtaaaaccggttttaaaccccggtaaaaaaaacccggggttaaaacccggtttacgggggtttaacccggggtaaacccccgttttacgggaaacccccgttaaaacccccgttaacgttttaaccccggttttacgggtttttaacccccttttaccccgttaaacccgtttttaccccccccgg

SEQ ID NO: 96102 - DNA, 554 bp, Homo sapiens
  misc_feature: GYAE6OF01D0OGH.12.37.D04.1.454.CMB.1.raw
  modified_base (292)..(292): a, c, t, g, unknown or other
  misc_feature (292)..(292): n is a, c, g, or t
  modified_base (391)..(391): a, c, t, g, unknown or other
  misc_feature (391)..(391): n is a, c, g, or t
  modified_base (424)..(424): a, c, t, g, unknown or other
  misc_feature (424)..(424): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtccaccatcacttgccaggcgagtgaggactatttacggtaaaatttttaaagttggtttacagacaaggaaaccgagggaaacncccctagactcctgacttcacgagcataccaattacggaaatacggggtaccaacggagttcaggtggaggtggagcgtagggactagtactttacccncacatcagcagcctgcagctagaagtatcttanacaatatattactgtacaatagtaataataactcctaccgtatacgtttacggaccgaacggggacctaaggtcgtaggacgtatacgaaacgtacgtggcgacgtacactacattctacgtcttctacc

SEQ ID NO: 96103 - DNA, 587 bp, Homo sapiens
  misc_feature: GYAE6OF01DYM8Q.12.37.D04.1.454.CMB.1.raw
  modified_base (281)..(281): a, c, t, g, unknown or other
  misc_feature (281)..(281): n is a, c, g, or t
  modified_base (368)..(368): a, c, t, g, unknown or other
  misc_feature (368)..(368): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctcctgtctgcttctgtcggagacagagtcaccatcacttgccaggcgagtgaggacattcggtaaaatttttaattggtttcagcaagaaaccagggaaacncccctagactcctgattcacgagcatccaattcgaaatcgggtccagaggttcagtggaggtgagcgtgggacagtacttttacccncaccatcagcagcctgcagcctagaagtattctgacaactattacttactagtaccaactagttaataataacttaccttacccgttaacttacgttttacgggacccgtaacggggaccaacggtcgtagggaacgtaacgtaaccgtaaaacggtaacgttaggtcggacctcggaccctaacccgtacgttaccttcggttccttaccgtaacccg

SEQ ID NO: 96104 - DNA, 509 bp, Homo sapiens
  misc_feature: GYAE6OF01CX1YU.12.37.D04.1.454.CMB.1.raw
  modified_base (278)..(278): a, c, t, g, unknown or other
  misc_feature (278)..(278): n is a, c, g, or t
  modified_base (366)..(366): a, c, t, g, unknown or other
  misc_feature (366)..(366): n is a, c, g, or t
  modified_base (393)..(393): a, c, t, g, unknown or other
  misc_feature (393)..(393): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaatggtttcagcagaaaccagggaaancccctagactcctgattcacgaggcatccaattcggaaatagggtccagaaggttcagtggagtggagctgggacagacttttacccncaccatcagcagcctgcagcctgaagntcttgcaacatattactgcaacataataataatcctacccgtactacgttttgccgtaagggaccaagctaggacatacgaaaacgtatggtgctagctacattctcgtcttctac

SEQ ID NO: 96105 - DNA, 586 bp, Homo sapiens
  misc_feature: GYAE6OF01AHVU2.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcacatcacttgccaggcgagtgaggacattacggtaaatttttaaatggtttcagacagaaaccagggaacgcccctagactctgattcacgaggcatccaattacggaagtagggtacccacggtaaggttcaggtggaggtggagcgtagggacagtacttttacccacacatcagcagcctgcagcctagaagtatctagacaactatattactgtacaactataataatactacctacccgtactacgttttacggaccgtacggggtacctaacggtcgtagggtaacgtaacgtaaccgtaaaacggtacgttaggtcgggtacttacggacctaacccgtatttaccgttcgtttccgttaccttaacccg

SEQ ID NO: 96106 - DNA, 568 bp, Homo sapiens
  misc_feature: GYAE6OF01ES9NA.12.37.D04.1.454.CMB.1.raw
  modified_base (288)..(288): a, c, t, g, unknown or other
  misc_feature (288)..(288): n is a, c, g, or t
  modified_base (395)..(395): a, c, t, g, unknown or other
  misc_feature (395)..(395): n is a, c, g, or t
  modified_base (423)..(423): a, c, t, g, unknown or other
  misc_feature (423)..(423): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggactagttacggtaaatttttaaattggtttacagacaagaaaccgagggaaacncccctagacctcctagtattcgacgaggcatcctaattacggaagtacggggtacccaaggtaaggttcaggtggaggtggagcgtagggactaggtactttacccncaccatcagcacgcctgcacgctagaantctagacaactattattactgtacaactagtaataataactcctaccgtacttacgtttacggaccgtagggacctaaggcgttaggagtactaacgaaacgtagtggtcgacgtacgactaccatacttcgttccttcgtaccg

SEQ ID NO: 96107 - DNA, 579 bp, Homo sapiens
  misc_feature: GYAE6OF01EZKV8.12.37.D04.1.454.CMB.1.raw
  modified_base (383)..(383): a, c, t, g, unknown or other
  misc_feature (383)..(383): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggtaaaatttttaaattggtttcagtcaagaaaccagggaaacgcccctagactcctgattcacgaggcatccaattcggaaagtaggggtcccaacggaaggttcaggtggagggtggagctagggacagtactttaccctnaccatcagcagcctgcagcctgaagatctagacaacattaattactgtactaacaagttataattaactacctaccccgttaacttacgttttacggacccgtaacggggaccaaggccgtaggaacgtaataccgaaaacgtacgtaggtcggtactacggacctaacctattacctcggttccttcgtaacccg

SEQ ID NO: 96108 - DNA, 588 bp, Homo sapiens
  misc_feature: GYAE6OF01DQMWN.12.37.D04.1.454.CMB.1.raw
  modified_base (282)..(282): a, c, t, g, unknown or other
  misc_feature (282)..(282): n is a, c, g, or t
  modified_base (378)..(378): a, c, t, g, unknown or other
  misc_feature (378)..(378): n is a, c, g, or t
  modified_base (406)..(406): a, c, t, g, unknown or other
  misc_feature (406)..(406): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaaatttttaagtggtttcagcagaaaccagggaaacncccctagactcctgattcgacgaggcataccaattcggaaatggggtacccagaaggttcaggtggaggtgagcgtagggacagtacttttacccncaaccatcagcagcctgcagctagaatntcttgaccaatattattactgtacaactagtaataataacttccgtacccgttaacttaccgttttgggacccgtaacggggtacccaaggtcgtagggaacgtaacgtaaccgaaaacggtaagttcggtacggtcctacggaccctaaccgtacttccgttcgttacctttccgtacccg

SEQ ID NO: 96109 - DNA, 492 bp, Homo sapiens
  misc_feature: GYAE6OF01EP7C9.12.37.D04.1.454.CMB.1.raw
  modified_base (283)..(283): a, c, t, g, unknown or other
  misc_feature (283)..(283): n is a, c, g, or t
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (455)..(455): a, c, t, g, unknown or other
  misc_feature (455)..(455): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaaattggtttacagcaagaaacgagggaacncccctagactcctgatcacgagcatccaattcgaatgggccagagtcagtggagtgagctgggacagtactttacccacaccatcagcagcctgcagctagaagtatctgacaatntattactgtacaanagtataatatctcctatactttgcagggacagctaggagtanacgaaacgtatgtgctgacctacatctcgtctcgtac

SEQ ID NO: 96110 - DNA, 501 bp, Homo sapiens
  misc_feature: GYAE6OF01DHQLM.12.37.D04.1.454.CMB.1.raw
  modified_base (364)..(364): a, c, t, g, unknown or other
  misc_feature (364)..(364): n is a, c, g, or t
  modified_base (399)..(399): a, c, t, g, unknown or other
  misc_feature (399)..(399): n is a, c, g, or t
tcagatacgacgtacacgaccggtgctcgatttagtagcatactgttgggtttggggcaggagtcagtcccaacctggacacagcatggacatgagggtccctgctcagctcctggggctcctgctgctctggctcccaggtgccagatgtgacatccagatgacccagtctccatcctcctgtctgcttctgtcggagacagagtcaccatcacttgccaggcgagtgaggacattacggtaaatttttaatggtttcagcaagaaaccagggaaacgcccctagactcctgattcacgagcatccaattcggaaatgggtcccagaagttcagtggagtgagctagggacagacttttaccncacatcagcagcctgcagcctgaagatctgcaacntatactgtacaatagtataatatacctccgtatacgtttgcctagggaccaagctaggacgatacgaaacgatgtcggactgacaccattctgtcttcgtac

SEQ ID NO: 96111 - DNA, 557 bp, Homo sapiens
  misc_feature: GYAE6OF01E1VP9.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttacagcaagaaaccagggaaacgcccctagacctcctgattcacgaggcatccaattcggaaataggggtccagaaggttcaggtggaggtggagcgtgggacagtactttaccctcacatcagcagcctgcagcctagaagactcttgactaactattacttactagtacaaactaagttaataaattaactactacccgttacttacgttttcggaccgacggggaccaaggctagggacgaactacgaaaacgacgttggtggacgtagacctactactcgttcttccgttctac

SEQ ID NO: 96112 - DNA, 524 bp, Homo sapiens
  misc_feature: GYAE6OF01CHDDT.12.37.D04.1.454.CMB.1.raw
  modified_base (292)..(292): a, c, t, g, unknown or other
  misc_feature (292)..(292): n is a, c, g, or t
  modified_base (373)..(373): a, c, t, g, unknown or other
  misc_feature (373)..(373): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctcctgtctgcttctggtcgagacagagtcaccatcacttgccaggcgagtgaggacatttcggaaatttttaaattggtttcagcagaaaccagggaacgcccctagactccngattcacgaggcatccaattcggaaatacggggtcccaggaaggttcagtggaggtggagcgtgggacagtattttacccnaaccatcagcagcctgcagcctagaatntctgacaanattattactgtaccaatagtataataactcctacccgtatacgtttcggaccaggggaccaagctaggatatacgaaacgtactggtcggctagcacctatctcgtccttatac

SEQ ID NO: 96113 - DNA, 617 bp, Homo sapiens
  misc_feature: GYAE6OF01B1XRU.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatcgacccagtctccatccctcctgtctgcttctggtcggagacagagtcaccatcacttgcaggcgagtgaggactagtttacggtaaatttttaagtggtttacaagcaaggaaaccagggtaaacgcccctagactcctgacttcacgagctactaccaagttcggaaagtcggggtacccaaggaaggttcgaggtggaaggtggagcgtagggactaggtacttttacccacaccaatcgagtcagtccctagacacgcttaggaagtacttctacggactaactattaattactacgtaaccaataagttaattaaactacttaccgttaccccggttaaacttacggttttacgggacccgtaacggggacctaaaggtcgtaggaaacgacttaaccgaaacgtactgggtacgacgtacgactaccgtattcttcgttccttatacc

SEQ ID NO: 96114 - DNA, 797 bp, Homo sapiens
  misc_feature: GYAE6OF01AV9T2.12.37.D04.1.454.CMB.1.raw
  modified_base (292)..(292): a, c, t, g, unknown or other
  misc_feature (292)..(292): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagacgtcaccatccacttgccaggcgagtgaaggacagtttacggtaaatttttaagttggtttacagacaagaaaccgagggaaaccncccctagacctccgtagtattccgacgtacggactactacctaagtttacggaaaagttacggggtacccaacggtaaggttccgaaggtagggtagggtagggagtcggtagggaactaggtttaacctttttaaccccgactaacccgtacttaccgaacggtaccgtaacggtcccgttacggacccgtaacggtacccggttaaggaaaacgttacgtttacccggtttaagaaacccaaacgtttaacttttaaaccgtttaacctttacggtaacctaaaacgttaagttaaactttaaaacttaacgtttacccttaaccgtaaccgtttaaccgtttaccgggtttttaccgggaaccgggtaaccgggggtaactaaacgggtcgttaaacggggtaacttaaaaccgttaaccgggtaaaaacctacgggtttccggtacgggtaaccctacggtaaccctaacgttactttcccgtttaggttaccctttaccg

SEQ ID NO: 96115 - DNA, 621 bp, Homo sapiens
  misc_feature: GYAE6OF01EA7RR.12.37.D04.1.454.CMB.1.raw
  modified_base (366)..(366): a, c, t, g, unknown or other
  misc_feature (366)..(366): n is a, c, g, or t
  modified_base (388)..(388): a, c, t, g, unknown or other
  misc_feature (388)..(388): n is a, c, g, or t
  modified_base (417)..(417): a, c, t, g, unknown or other
  misc_feature (417)..(417): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacatttcggtaaaattttttaaattggtttacagacaagaaaaccgagggaaagcccctagacctcctgattcacgaggcatccaatttcggaaatacggggtcccaacggaaggttcaggtggaggtggancgtgggacagtactttacccgnacctatcagcagcctgcagcctagaagtntcttgacctaactattacttactgtaccaaagacgtaagtaactacgttaacccttacccctaacgttttccgggacggtacggggaaccgtaagggtcgggaaagtaacgtaccgaaaacggtacgtacgggtaggaccgttcggaccctaaccgtaacttcccgttagttccctttaccgtactttccccgttaccccccgg

SEQ ID NO: 96116 - DNA, 536 bp, Homo sapiens
  misc_feature: GYAE6OF01BSB1J.12.37.D04.1.454.CMB.1.raw
  modified_base (282)..(282): a, c, t, g, unknown or other
  misc_feature (282)..(282): n is a, c, g, or t
  modified_base (373)..(373): a, c, t, g, unknown or other
  misc_feature (373)..(373): n is a, c, g, or t
  modified_base (524)..(524): a, c, t, g, unknown or other
  misc_feature (524)..(524): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaaattggtttcagcaagaaaccagggaacncccctagactcctgattcacgaggcatccaattcggaaatcgggtccagaggttcagtggaggtggagcgtagggacagtacttttacccncacatcagcagcctgcagcctagaagatcttagacaactattattactgtacaactagtaataataactccttaccgtactacgttttcggaccgtagggaccaagcgtaggacatacgaaacgtatggtcggactgacctacctatcgtnttccttctaccg

SEQ ID NO: 96117 - DNA, 570 bp, Homo sapiens
  misc_feature: GYAE6OF01ENGVN.12.37.D04.1.454.CMB.1.raw
  modified_base (201)..(201): a, c, t, g, unknown or other
  misc_feature (201)..(201): n is a, c, g, or t
  modified_base (288)..(288): a, c, t, g, unknown or other
  misc_feature (288)..(288): n is a, c, g, or t
  modified_base (376)..(376): a, c, t, g, unknown or other
  misc_feature (376)..(376): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcgganacagagtcaccatcacttgccaggcgagtgaggactattacggtaaatttttaaagttggtttacagacaagaaaccgagggaaacncccctagactcctagattcacgaggcatccaattcgaaatgggacccagaagtcaggtggaggtgagcgtgggacagtactttacccncactatcagcagctgcagctagagatctgacaactattattactagtacaactagtaataataactacctacccgtaacttacgttttacggaccgtaacggggtaaccaaggtacgtaggtaacgtaagtaaccgaaaacgtaacgtaggtacggacgtacgacctaacctattaccttcgttccttctaccg

SEQ ID NO: 96118 - DNA, 548 bp, Homo sapiens
  misc_feature: GYAE6OF01B3U4B.12.37.D04.1.454.CMB.1.raw
  modified_base (279)..(279): a, c, t, g, unknown or other
  misc_feature (279)..(279): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaatggttcagcagaaaccagggaaacncccctagactcctgacttcacgaggcatccaattcggaatcgggtcccagaggttcaggtggaggtggagcgtagggacagtactttacccgcaccatcagcagctgcagcctgaacgtatcttagacaactatacttactagtaccaacagttaataactaactcctacccgtacttacgttttacggaccgtaaggggaccaagtcgtaggagaacgtacgaaacgtaacgtggtacgcgtacgactacctatctcgttcctgtacc

SEQ ID NO: 96119 - DNA, 558 bp, Homo sapiens
  misc_feature: GYAE6OF01ENW62.12.37.D04.1.454.CMB.1.raw
  modified_base (293)..(293): a, c, t, g, unknown or other
  misc_feature (293)..(293): n is a, c, g, or t
  modified_base (396)..(396): a, c, t, g, unknown or other
  misc_feature (396)..(396): n is a, c, g, or t
  modified_base (509)..(509): a, c, t, g, unknown or other
  misc_feature (509)..(509): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtcctgcttctgtcggagacagagtcaccatcacttgccaggcgagtgaggactagttacggtaaaattttttaaagttggtttacagacaagaaaccgaagggaaacncccctaagactctgattcacggagcactaccaagtttacggaaagtacggggtacccaacggtaaggttcaggtggaggtggagcgtggacagtactttaccncacatcagctagcctgacagcctagagtactctgacaatattacttactgtacaactagtaataataactactaccgtactagtttacgacgtacgggacagcgtaggactanacgaaacgtagtcggtcgcgtgacctactacgtacttcgttcctctacg

SEQ ID NO: 96120 - DNA, 589 bp, Homo sapiens
  misc_feature: GYAE6OF01C5SEB.12.37.D04.1.454.CMB.1.raw
  modified_base (293)..(293): a, c, t, g, unknown or other
  misc_feature (293)..(293): n is a, c, g, or t
  modified_base (409)..(409): a, c, t, g, unknown or other
  misc_feature (409)..(409): n is a, c, g, or t
  modified_base (453)..(453): a, c, t, g, unknown or other
  misc_feature (453)..(453): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggactatttacggtaaaattttttaaagttggttttacagtacaagaaaccgagggaaacncccctagtactccgtagacttcgacggagcataccgtaagttacgggaaagtacggggtacccaacggtaaggttcgaggtgggaggtgggagcgtgggactagtacttttacccncacgatcgagcagtcctgcacgcctagagtactcttagactaanattacttactgtacaactagtaataatactacccgttaccgtacgttacgtttcggacgtaacgggaccaagtcgtaggacgagtaaccgaaacgtagtcggtgctagacctacgtactcttcgttctcgtacccg

SEQ ID NO: 96121 - DNA, 579 bp, Homo sapiens
  misc_feature: GYAE6OF01DS6MD.12.37.D04.1.454.CMB.1.raw
  modified_base (287)..(287): a, c, t, g, unknown or other
  misc_feature (287)..(287): n is a, c, g, or t
  modified_base (379)..(379): a, c, t, g, unknown or other
  misc_feature (379)..(379): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggactattacggtaaaatttttaaagttggtttcagacaagaaaccagggaaacncccccagactcctgattcacgaggcatcaattacggaaagtgggtaccagaagttcgagtggaggtggagcgtgggacagtacttttacccncaccatacagcagcctgcagcctagaagtactctagactaactataacttactagtactaaactagtaataagtaactccttacccgttaacttacgtttacgggacctaaggggacccaaggtccgtaggaacgtataaccgaaacgtaagttggtcggacttagacctaacgtacttacgttcgttccttcttacccg

SEQ ID NO: 96122 - DNA, 605 bp, Homo sapiens
  misc_feature: GYAE6OF01C58C6.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctccgtggggctcctgctgctctggctcccaggtgccagatgtgacatccagatgacccagtcctccatccctccctgtctgcttctgtcggagacagagtcaccatcactgccaggcgagtgagactagttacggtaaattttaattggttacagacaagaaaccgagggaaacgcccctaagactcctgacttcacgagcataccaagttacggaaagtacggggtacccaacggtaaggttcaggtggaggtggagcgtagggacagtactttacccacaccatcagctacgcctgcacgctagaagtatcgttagacaaactattaattactagtaacaaactagtaataaactaactccttacccgtacttacgtttacggacccgtaacggggaaccaaaggtcgtagggaacgtaacgtaaccgaaaacggtactaggtcgggtcctacggacctaaaccgtacttacttacggttaccttcttaccc

SEQ ID NO: 96123 - DNA, 295 bp, Homo sapiens
  misc_feature: GYAE6OF01A3T1U.12.37.D04.1.454.CMB.1.raw
  modified_base (177)..(177): a, c, t, g, unknown or other
  misc_feature (177)..(177): n is a, c, g, or t
  modified_base (291)..(295): a, c, t, g, unknown or other
  misc_feature (291)..(295): n is a, c, g, or t
tcagatacgacgtacacgaccggtgctcgatttagtagcatactgttgggtttgggagaaggggtcccctcaagatttcatggcgacttttctgggacaaatttcaccctctccatcagcggtctggaacccgatgactttggaaagtattactgccatcagactcacattttcccnccgacgttcggccaagggaccatagtggctctcaggcgaactgtggctgcaccatctgtcttcatcttccgccatctgatacgtcgtatctgagcggctggcaaggcgcatagnnnnn

SEQ ID NO: 96124 - DNA, 652 bp, Homo sapiens
  misc_feature: GYAE6OF01E2JMI.12.37.D04.1.454.CMB.1.raw
  modified_base (297)..(297): a, c, t, g, unknown or other
  misc_feature (297)..(297): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtcgccagatgtgacatccagatcgacccagtctccactccctccgtgtctgtcttcgtggtcgaagcagactaccacatcacgttcgccagggcgagtgaaggactagttacggttaaattttaagtggttacagacaacgaaaccgaggaaccnccctagactcgtagactcgacgagctactaccagtaccgaagtacgggtaccaggtaagttcgaggtggaggtagacgtcggtagggaactacgttacctttacccgcactaatcgaatccgagtccctagaccgagtaccgaggtaaatcgtactagacctaaactattaccgtaagtacgtaacctaagttaagttaactaacttaacgtttacccgtaaccgttacgtaccggtttacggacccggttaacggacgaacgttcggtagaacgtaaaccttaacggaaaacgtcgggttagacggttaccctaaggacccctaacgttagtacctttcgttcctccgtacccg

SEQ ID NO: 96125 - DNA, 546 bp, Homo sapiens
  misc_feature: GYAE6OF01DVKDM.12.37.D04.1.454.CMB.1.raw
  modified_base (289)..(289): a, c, t, g, unknown or other
  misc_feature (289)..(289): n is a, c, g, or t
  modified_base (311)..(311): a, c, t, g, unknown or other
  misc_feature (311)..(311): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
  modified_base (410)..(410): a, c, t, g, unknown or other
  misc_feature (410)..(410): n is a, c, g, or t
tcagatacgacgtacacgaccggtgctcgatttagtagcatactgttggggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtccaccatcacttgccagggcgagtgaggactattacggtaaaatttttaagttggtttcagcaagaaaccgagggaaacncccctagacctctgattcacgnggcatccaattcggaaagtacgggtacccagagttcaggtggaggtgagcgtggganagtactttacccncacctatcagcagcctgcacgctagaatntctagactaatattatactgtacaatagtaataatacttcctacccgtatacgtttggaccgtaagggaccaaggcgtaggaagtactacgaaaacgtactggtgcctggaccctacacttcgtactcttcgtacc

SEQ ID NO: 96126 - DNA, 555 bp, Homo sapiens
  misc_feature: GYAE6OF01C97Y5.12.37.D04.1.454.CMB.1.raw
  modified_base (288)..(288): a, c, t, g, unknown or other
  misc_feature (288)..(288): n is a, c, g, or t
  modified_base (382)..(382): a, c, t, g, unknown or other
  misc_feature (382)..(382): n is a, c, g, or t
  modified_base (432)..(432): a, c, t, g, unknown or other
  misc_feature (432)..(432): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatccctccctgtctgtcttctggtcggagacagacgtcaccatcacttgccaggcgagtgaggatattacggtaaatttttaatggtttacagacaagaaaccgagggaaacnccctagactcctgacttcacgagcataccaagttacggaagtcgggtaccaggtagttcaggtggaggtgagcgtagggacagtactttacccncacatcagcacgctgcagctaggatcttcgtagactaactattacttacngtactaacgtataataactactaccttacccgtaacttcgttcggaccgtacgggacctaagcgtaggagtacaacgtaaacgacgttaggtcgtcgtcgaccactatcttcgtcttctaccg

SEQ ID NO: 96127 - DNA, 297 bp, Homo sapiens
  misc_feature: GYAE6OF01EN0IP.12.37.D04.1.454.CMB.1.raw
  modified_base (293)..(297): a, c, t, g, unknown or other
  misc_feature (293)..(297): n is a, c, g, or t
tcagatacgacgtacacgaccggtgctcgatttagtagcatactgttgggtttgggagaaggggtcccctcaagatttcatggcgacttttctgggacaaatttcaccctctccatcagcggtctggaacccgatgactttggaaagtattactgccatcagactcacattttccctccgacgttcggccaagggaccatagtggctctcaggcgaactgtggctgcaccatctgtcttcatcttcccgccatctgatacgtcgtatctgagcgggctggcaaggcgcatagnnnnn

SEQ ID NO: 96128 - DNA, 567 bp, Homo sapiens
  misc_feature: GYAE6OF01DMQQ4.12.37.D04.1.454.CMB.1.raw
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
tcagatacgacgtacacgaccggtgctcgatttagtagcatactgttgggtttgggggcaggagtcagtcccaacctggacacagcatggacatgagggtccctgctcagctccgtggggctcctgctgctctggctcccaggtgccagatgtgacatccagatcgacccagtcctccactccctccctgtctgtcttctggtcggagacagacgtcaccatcactgccgaggcgagtgaggactagttacggttaaatttttaagtggttacagacaagaaaccgagggaacctcccctagacctctagtactcgacgagcataccaagttacggaaagtcgggtacccaggtaacggttcaggtggaggtggagcgtagggactagtactttacccacactatcagtcacgtcngacacgctagaatntctacgacaatacttacttactagtacaacgtaataataactactaccctccgttacttacgttggaccgtagggacagtcgtagagtactaacgtaacgagtagtcggactacgactaacgtctatctactctacg

SEQ ID NO: 96129 - DNA, 542 bp, Homo sapiens
  misc_feature: GYAE6OF01BJEE1.12.37.D04.1.454.CMB.1.raw
  modified_base (291)..(291): a, c, t, g, unknown or other
  misc_feature (291)..(291): n is a, c, g, or t
  modified_base (389)..(389): a, c, t, g, unknown or other
  misc_feature (389)..(389): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggactattacggtaaaattttttaaagttggtttcagtacaagaaaccgaggggaaacncccctaagacctcctgacttcgacgaggcatccaattcggaaatcgggtcccaagaggttcaggtggaggtggagcgtgggactagtacttttacccncaccatcagcagcctcgcacgctagaagtatcttacgacaactattaacttactgtacaacgtagtaataactactacctaccgtactacgtttcgacgtacgggaccagcgtaggagatacgaacgtatggtgctgacacatctcttctctc

SEQ ID NO: 96130 - DNA, 717 bp, Homo sapiens
  misc_feature: GYAE6OF01C0CTV.12.37.D04.1.454.CMB.1.raw
tcagatacgacgtacacgaccggtgctcgatttagtagcatactgttgggtttgggggcaggagtcagtcccaacctggacacagcatggacatggagggtccctgctcagctccgtggggctcctgctgctctgggcctcccgaggtcgaccagtatgtagacactccagactcgacccagtcctccactcccgttccctgtcctcgtccttcgtcggacggacacgagacgtccaacctatcgtactcggaccgaggcgagtagagacgtatttaacggttaaattttagtggttacagtcgaaaggaaacccggtaaggaacctcccgtagacctacctgtacttcgacgacgactactaccgtaagttacggaaacggtcgggtacccaaggtacgtacgaggtaggaggtaggatcgggtaggactagttacctttaccacactagcaagtcacgctacgactcgctaaggatacgttcgagacaagttactatacgtacgaataaacttgtaacctaaatttaccgacccgttacccgttaacgtttacccggtttaacgggcccggaaaccggggtaacccaaggggttacgttaaacggaccggttaaaactaaacccggtaaacgggttacggttcgacggggtttaacccacggtaaccccttaacccggttattacccggttcccttttacctacttaacccccgg

SEQ ID NO: 96131 - DNA, 747 bp, Homo sapiens
  misc_feature: GYAE6OF01CNAUR.12.37.D04.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttcgtggtcgganacagacgtccaccatcacttcgccaggcgagtgaggactattacggttaaatttttaagtggttacagacaagaaaccgaagggaaaccncccctaagtacctccgtagtaacttccgaacggacgtctaactaccgtaaagttaccgggaaaacgttacggggtaccccaaagggtaacggttcgaagggtgggagggtacggacgtcgtaggggactaacggttaccttttaccccacgtaaccgtattaccgacgaccgtacggcccttacggacctaacggtacccgtaaaggtaaacgttacgttacgtttaacgaaccctaaacgttaacttttaaacgtttaccgtaacgttaacctaaacgtaagtttaaacttaactttaacctacccgtttaaccccgttaacgtttaccgttttaccgggaacccggtaacggggtacctaaacggtacgttacgggaatacgtaaacccgtaaacgtacgtggtacgtacgtaccgacgtaaccttacgtacttcgttccttaccgtacccg

SEQ ID NO: 96132 - DNA, 731 bp, Homo sapiens
  misc_feature: GYAE6OF01CTS3T.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatctactgccaggcgagtgaggactagtttacggttaaatttttaaagttggtttacaagtacaagaaaccgaagggaaaccgccctagactccgtagattccacgaggcatacctaagttacggaaagtacgggtacccaggtaacgttcgaggtggaggtggaggcgtagggactagtacttttacccgctacatcagctagcctgcgacgtccgtagaacgtactcttacgaccgtaactacgttaactttaactacggtaacctaaaaccggtaagtttaaactttaaacttaaacctttaccccgtttaacccccggttaactttaacccggtttttacggggaaccccgttaaaccgggggggtaacccctaaaaggggttccgtaacgggggtaaacgttaaccgttaaacccggaaaaaacggttaaacccggtttcgggggtaccgttaccgttaaccggaccctaacccgttaacgtttccgtttaccgttcgtttacccttaaccccg

SEQ ID NO: 96133 - DNA, 560 bp, Homo sapiens
  misc_feature: GYAE6OF01CWQNY.12.37.D04.1.454.CMB.1.raw
  modified_base (283)..(283): a, c, t, g, unknown or other
  misc_feature (283)..(283): n is a, c, g, or t
  modified_base (370)..(370): a, c, t, g, unknown or other
  misc_feature (370)..(370): n is a, c, g, or t
  modified_base (401)..(401): a, c, t, g, unknown or other
  misc_feature (401)..(401): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacatttcggaaattttttaaatggtttacagtcaagaaaccagggaaancccctagactcctgattcacgagcatccaattcggaatacgggccagaggttcagtggaggtgagcgtgggacagtacttttacccncaaccatcagcagcctgccagcctagaagtntcgttagaccaactattatactgtacaactagttaataattactccttacccgtacttacgttttcgacccgtaaggggaccaagtcgtaggacgtactaaccgaaacggtactggttcgacttacggacctacgttactcgtacggttccttgtaccc

SEQ ID NO: 96134 - DNA, 802 bp, Homo sapiens
  misc_feature: GYAE6OF01DEPJR.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcgagacagagtcaccatcacttgccaggcgagtgaggactagtttcggtaaaattttttaagtggttttacagacaagaaaccgaggggaaactccccgtagacctaccgtagtacttaccgaacggacggtacaacttacccgaaagtttaccgggaaaagttaaccgggggttccccaaacgggtaacggttcaagggttcgggtaaggggttgggaacggtccggtagggggaactaacggttaccgtttttaacccccgctaaaccctagtaccgacggtacccgtaacggcccttcggaccgtaaccggtcccgtaaggtaaaggttacttccgtttaacggaccctaaacttaacgtttaactttaccgttaggttaaccctaaacgtaacggttaaatttaaaacttaacctttacccgtttaacccccgtttaacgttaccggtttttaccgggaacccggttaaccgggggaaccctaaggtaccggttaagggaaacgttaacgtaaacccgtaaaaacggtaccggttggttaccgggaccgttaccggaacccttaccgtacttacccgtttacgtttcccttcgttaaccccg

SEQ ID NO: 96135 - DNA, 780 bp, Homo sapiens
  misc_feature: GYAE6OF01AIZ7I.12.37.D04.1.454.CMB.1.raw
  modified_base (205)..(205): a, c, t, g, unknown or other
  misc_feature (205)..(205): n is a, c, g, or t
  modified_base (565)..(565): a, c, t, g, unknown or other
  misc_feature (565)..(565): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgacagatgtgacatccagatcgacccagtcctccatccctccctgtctgcttcgtgtcgganacagagtccaccatcacgttcgccgagggcgaggtagaggtactagttacggttaaatttttaagttggttacagacgaagaaaccgagggaacctcccgagtacctacgtagactaccgacggacggacctaacgtaccgtaaaggtttaccgggaaaacggttaccgggggtaacccctaaacgggttaaggttccgtaagggggtacggggtaacggggtagggacggttacggtaggggtaaacctaacggttaccttttaaccccgacgtaacctagtacccgacgtaccgacggttacccgtgaccgaacgtaccgtaggtaaacgttactaccgttaagaaccctaaaacgtntttaaaccttaccgtacggtaacctaaacgtaagtttaaacgttaaacttaacccgttcccttaacccggtttaactttaccgggttaaccgggacccggaaagggttacccgaaagtcggtacggtaaaccgtaacgttaacccgtaaaacgtacggttaggccggtacgtaccgtaccctacttacggttaatccggtttaccctcgtacccg

SEQ ID NO: 96136 - DNA, 599 bp, Homo sapiens
  misc_feature: GYAE6OF01D5NMN.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagacgtcaccatcacttgccaggcgagtgaggactagtttacggtaaaattttttaaagttggtttacagtacaaggaaaccgagggaaacgcccctaagacctcctgacttcgacgaggacatacctaagttacggaaagtacggggtacccaaggtaaggttcgaggtggaggtgggagcggtaggggactaggtaacttttaccccacaccatcgagccacgcctgacacgcctaggaacgtactcgttagactaactattacttactgtacaactagtaataactacttacctacccgtattacgtttacggaccgaagggaccagctaggaactagtaccgaaacgtagtacggtcggactcgacctacctacttcgttctcgttctaccg

SEQ ID NO: 96137 - DNA, 568 bp, Homo sapiens
  misc_feature: GYAE6OF01B7U5G.12.37.D04.1.454.CMB.1.raw
  modified_base (285)..(285): a, c, t, g, unknown or other
  misc_feature (285)..(285): n is a, c, g, or t
  modified_base (387)..(387): a, c, t, g, unknown or other
  misc_feature (387)..(387): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatccacttcgccaggcgagtgaggactattacggtaaatttttaagttggttcagcaagaaaccgagggaacncccctagactcctgactcacgagcatacctaattcggaaatacggggtacccaaggtaaggttcaggtggaggtggagcgtagggactagtacttttacccncaccatcagcacgcctgaccagtcctagaacgtcttcgtacaccaatattacttactgtacaaactagtaattaactactccttacccgtacttcgtttcggaccgaaggggaccaggtcgtagagaactacgaaacgtatcggtcggcacgacctacctattccgtacttccgttctacg

SEQ ID NO: 96138 - DNA, 687 bp, Homo sapiens
  misc_feature: GYAE6OF01CX3WL.12.37.D04.1.454.CMB.1.raw
  modified_base (298)..(298): a, c, t, g, unknown or other
  misc_feature (298)..(298): n is a, c, g, or t
  modified_base (431)..(431): a, c, t, g, unknown or other
  misc_feature (431)..(431): n is a, c, g, or t
  modified_base (668)..(668): a, c, t, g, unknown or other
  misc_feature (668)..(668): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggcctcccaggtgccagatgtgacatccagatcgacccagtctccactcctcctgtctgcttctgtcgagacagacgtcaccatcactgccgaggcgagtgacgtactagtttacggtaaaattttttaagtggtttacagtacaaaggaaaccgaagggaaaccncccctaagaccttccgtagtactccgaacggacggacctaactaacctaacgtttacggaaacggtacgggtaccccaaggtaacggttcgaggtggaggtgagcgtagggacttacgtaaccttttaccccncgtaccagtacgacgcgtaacgccgtacgaccgaacgtccgtaagtaaacgtcttacgttacgaactaaacgtattaaacgtttacctaaggtaacctaaacgtaattaaacttaaacgttaacttacccgttaccgttaacgttcgtttacgggaacccgtaagggacctaaggtctaagggactaactaacgaaacggtacgttacggacggtacctacgaccgtacctacgttnttaaccttctacttacccg

SEQ ID NO: 96139 - DNA, 842 bp, Homo sapiens
  misc_feature: GYAE6OF01CSNKL.12.37.D04.1.454.CMB.1.raw
  modified_base (206)..(206): a, c, t, g, unknown or other
  misc_feature (206)..(206): n is a, c, g, or t
  modified_base (301)..(301): a, c, t, g, unknown or other
  misc_feature (301)..(301): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggcctcccaggtgccagatgtgacatccagatgacccagtctccatccctccctgtctgtcttctaggtcgganacagacgtcacctatcacttgccgaggcgagtgacgactagttaacggttaaatttttaagttggtttacagtacaacgaaaccgaagggaaccncccctagtacctaccgtagtacttaccgaacggacggtactaacgttaccgtaaaggtttaaccgggtaaaaacggttaccggggtaacccccgtaaagggttaaacgggttaccggtaacggggttaacgggtaagggggttacggggaacgggtaccgggttaacgggggtaaaccgtaacggttttaaccgttttttaaccccccaccggaaaacccttacgttaccgtaaaccggaccggtaccgtacccgttacggaccgtaaccggtaccgttaacggtaaacggtacttaccgttaacgaaccgtaaacttaagtttaacctttaacgacggttaaccctaaaggttaatttaaacttaaactaaaccctttacccgttaaccccgttaacgtttaccggttttacgggaacccgttaacggggtaaccaacggtacgtaacgggtaacgtaaccgtaaacgaaaccggtaacgttggttaccgacgttaccgacgttaacctattacccgtttacgttccgttacttaccccg

SEQ ID NO: 96140 - DNA, 788 bp, Homo sapiens
  misc_feature: GYAE6OF01BUD12.12.37.D04.1.454.CMB.1.raw
  modified_base (145)..(145): a, c, t, g, unknown or other
  misc_feature (145)..(145): n is a, c, g, or t
  modified_base (152)..(152): a, c, t, g, unknown or other
  misc_feature (152)..(152): n is a, c, g, or t
  modified_base (189)..(189): a, c, t, g, unknown or other
  misc_feature (189)..(189): n is a, c, g, or t
  modified_base (750)..(750): a, c, t, g, unknown or other
  misc_feature (750)..(750): n is a, c, g, or t
tcagatacgacgtacacgaccggtgctcgatttagtagcatactgttgggttggggcaggagtcagtcccaactggacacagcatggacatgaggtccctgctcagctccgtgggctcctgctgctctcggcctcccgagggtcnccaagtntggtcgacactccagcgttccgacccagtcctacccnttcccctccgtgtctcgtcttccgtaggtcggaacacgacggtaccgtaccaaccgtatccgtacgttaccggccgtaggacggaagttaggacgtaaccgtttaagtttaacggtttttaaaagttttaggtttcggttaacgaacgtaccgtaaaacggaaacgtaacgggtaacccctccccgtaaagttccccgtaagtcgttaacctcggacgttagaccaacttccgtaaggtacgtaacgttaccgggaaccaacgtaggttacaggtacggagtaggacgtcgtaagggcccttaagttacccttaaccgagtacctacgttggaccgtaacgccgtaccgtaacgtcgtaccgtaccgaggtaaccgtacgtttacgacgtaaccgtaactacgttaaccgttaacgacgttaaacgtaacgtttaagaactttaaccgttacctaacccgttacccgttaacgtttaccgtaccggaacggtaaccggtacccgagtccgtaaacgggtctaaccggtaaacccgtacgtaacgttcgggactaaacccgngtaaacccgtactcttaccggtacttacgttcctaccg

SEQ ID NO: 96141 - DNA, 824 bp, Homo sapiens
  misc_feature: GYAE6OF01BTK7T.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctgggctcctgctgctctggctcccgaggtgccagatgtgacatccagatgacccagtcctccatccctccctgtcctgtcttctggtcgagacagacgtcacctatcacgttcgccaggcgagtgaggactagttacggttaaatttttaagtcggttacagacaaggaaaccgaaggggaaccgcccctaagtacctccgtagtacttaccgacggagtacctaacgtacccgtaaaggtttaaccgggaaacggttaacccgggggtacccaacgggtaacggtttccgaaggggtttcgggaacggggtagggacggtccggtaggggaacctaacggttacctttttaaccccgacgtaaacccgtagtaccgtacggtaccctacggtacccgttcgaacccggtacgtaccccgtaaggtaaacgttaccgtttcgttaacgaaccctaaacttaacgtttaacttacccgtacgttaaccgaaaccgttaagtttaaacttaaacgttaaccgtttaccccgttaacccgttttaaccggttaacccggtttttaccggggaacccgggttaacgggggtaacccctaaacgggtccggttaacgggtaaaccgtaaccgtaaaccgtaaaacccggtagggtacggtaccgggtcctacggtaccctaccgtacttaccgttcgtttaccttccgtaacccg

SEQ ID NO: 96142 - DNA, 860 bp, Homo sapiens
  misc_feature: GYAE6OF01D2G2M.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctccgtggggctcctgctgctctggctcccaggtgccagatgtgacatccagatcgacccagtcctccatccctccctgtctgtccttcgtggtcggagacagacgtccaccatccacttcgccgaggcgagtggagactagttacggttaaatttttaaagttggtttacagtacaacggaaaaccgtaagggaaaccgtcccctaaggtacccttccgttaggtaaccttaccgaacggtacggtacctaacgttacccgtaaaggtttaaccgggaaaaacggttacccgggggtaacccccgtaaaggttaacgggtttaaccgaaggggttcgggaacggggtagggtaacgtcgggtaacggggaaccttaaacggtttaccgtttttaaccccaccgtaacctaacgtcgaacggtaccgtacggcccgttacgaccggtaacgtacccggttaaagggaacgttaacgtttccgttaacggaaccctaaacctttaaggtttaaccctttaacgttacgttaaaccctaaaggttaactttaaacttaaactttaacccggttaccccttaaaccccggtttactttaacgggtttaccggggaacccggttaacgggtaaccctaaggccgttaaggggaacctaaacggttaaaccgaaaaacgttcggtacgggttaccggtacccgtacgtaacccgtaccgttaagttcccgtttacgtccgtttaactaccccggg

SEQ ID NO: 96143 - DNA, 677 bp, Homo sapiens
  misc_feature: GYAE6OF01B0Y9D.12.37.D04.1.454.CMB.1.raw
  modified_base (558)..(558): a, c, t, g, unknown or other
  misc_feature (558)..(558): n is a, c, g, or t
  modified_base (665)..(665): a, c, t, g, unknown or other
  misc_feature (665)..(665): n is a, c, g, or t
tcagatacgacgtacacgaccggtgctcgatttagtagcatactgttgggtttgggggcaggagtcagtcccaacctggacacagcatggacatgagggtccctgctcagctcctgggctcctgctgctctggctccaggtgccagatgtagacatccgagactcgacccagtcctccactccctcctgtctgtcttctggtcggagaccagacgtcaaccatccacgttcgaccgaagggcgtaggtagacggactaagtttaacggttaaaattttttaaagtggtttacacgaacgtaacggaaaacccgaaggggaaacctaccccgtaagtacccgtaccgttaggacttaccgaacggaaggctaacgtacctaaaggtttacggaaacgtacggggtaacccaagggtaacggtttcgagggttaggacggtgggagtccggttaggaacgtaacggttacttttaacccgacgaacttacgacgacgataccgtcctagacgtagccgtagacagttgtacgtactaattagtatacgtaactaaagttntaacgactacccgtacccttctaacccgttcggaaccgtacggaacacggtacgtacggaagtataccgaagtacgtgcgcgtcacgtactacgtcgtcttactccngttccgtacccg

SEQ ID NO: 96144 - DNA, 639 bp, Homo sapiens
  misc_feature: GYAE6OF01DWC4V.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtccggagacagacgtcaccgatccacttgcctaggcgtagtgaggactagttacggtaaaatttttaagttcggtttacacgtacaacgtaaaacccgacgggaaacgtacccccgtaggtaccctaccgttagacctttacgacggacggacctactaccgtaattacgggaaaactacggggtccccaaggtaaggttcgaaggtgggaggtggacgcgttacgggactaggtactttacccgcactatcagcacgctgcacgtcctagaacgatccgtagacctaactattacttacgtagtacctaagtaagtattaactaacttcctaccgtacttcgtttacgaccgtacggggacaagtcgtaggaacgtactaacgtaaacggtagtacggttggaccctaggaccctacctacgttacttcgttcttccgtaccc

SEQ ID NO: 96145 - DNA, 1038 bp, Homo sapiens
  misc_feature: GYAE6OF01EW4XZ.12.37.D04.1.454.CMB.1.raw
  modified_base (288)..(288): a, c, t, g, unknown or other
  misc_feature (288)..(288): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggcctcccaggtgccagatgtgacatccagatgacccagtctccatccctccctgtctgcttctgtcggagacagagtcacatcactgccaggcgagtgaggactagttacggtaaatttttaagtggtttacagtcaagaaaccgagggaaaccnccccgtagaccttaccgtagtacgttacgaccggtaggctaacgtacctaaacggtttacgggaaaacgttaccgggggtaccccctaaacgggtaaacgggttttaccgaaggggttacggggtaacggggttacggggaacgggtacccgggttaagggggtaaacccgttaaaaccgggtttaacccttttttaaccccccgtaacgtaaacccccgttaaagttcccggaaaccgggtacccgtaaccgggttacccgttacgggtaacccgtaacccgggtaacccgttaacgggaaaaaccgggttaaccggttttaaccgtttaaccgggtaaaaccccgttaaaaccctttaaaaggtttttaaccgttttaaaccggtttaaaccggttaaacccgtaaaacccgttaaaacggggtttaaaccgttaaaaaccccggtttaaccccggttttaaaccccccgtttaccccccggtttaaacccggggttttttaaccccggggggaaaccgggggtttaaaaccccgggggtaacccggggttaaaaccgggggttaacggggtaaaccgggttaaaaccgtttaaaaccccggggtaaaaaccgggttaaacccggttagggttaacccggggtaacccggtttaccgggaaacccgttaaaccccttaacgtttacccggtttaccgtttaaccccgttttaacccgttacccgtttaccccccgttttaacccccgg

SEQ ID NO: 96146 - DNA, 767 bp, Homo sapiens
  misc_feature: GYAE6OF01CGV3C.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggcctcccgaggtgccagatgtcgacatccagatcgacccagtcctccattccctccctgtctgtcttcgtggtcggagacagacgtccacctagtcctacttcgacctaggcgagtgaggactaagtttaacggttaaaattttttaacgttcggtttacaagtacgaaacgtaaaaccgacgggaaacctacccctaggtacctccgtagtacttccgaacggtacggaccacgttaccgtaacgttaacgggaaacgttaccgggtacccaagggttaaacggttcgtaagggtagggtaaggtaggtacggtacggttacgggaacttaacggtttaacccttttacccgacgtaacctacgttaccgaacgtaccgtaacgcccgttacgaccgtacgtaccgtaagtaaacgttacgttacgttaacgaactaacttattaacgttacgtacgtaactaacgtaagttaaactaacgttaaccttacccgttacccgttaacgtttaccgtttacggaaccggtaacgggacctaaggtaccgtaaggacgtaaacgtaaccgtaaacggtacgtacggtacgaccgtacgaccgttaacgttacttcgttaacttcgttccttacccg

SEQ ID NO: 96147 - DNA, 693 bp, Homo sapiens
  misc_feature: GYAE6OF01AN4S3.12.37.D04.1.454.CMB.1.raw
  modified_base (144)..(144): a, c, t, g, unknown or other
  misc_feature (144)..(144): n is a, c, g, or t
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (685)..(685): a, c, t, g, unknown or other
  misc_feature (685)..(685): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtnccagatgtgacatccagatgacccagtctccatccctccctgtctgctttcnggtcganacagagtcaccatcacttgccaggcgagtgaggtccagttacggtaaatttttaagtcggtttacagtacaagaaaccaggggaaactcccctaagacctcctagacttcgacgaggctactcctaaagtttaccggaaacgttcggggttacccccaaggtaacggtttccaagggtcggaacggtgggaactcggtaggggaactaaggttaactttttacccccgagtaacccctagttacccgaacggtaccgtaacgtaccccgtaggacccgtacggtaccccgtaggaaaccggtacttacgtacgaccaacctacgttaacttaccgtcgtaaccaaccgtagtaaactaactaaccttcccttaacccgtacttaccggtttacgaccgtaacgggtacctaagccgtaggtactaagtaccgaaacgttacgtaggcgtacctacgacctaccgattaccggtcttaccgtntaaccccg

SEQ ID NO: 96148 - DNA, 841 bp, Homo sapiens
  misc_feature: GYAE6OF01DPZN5.12.37.D04.1.454.CMB.1.raw
  modified_base (667)..(667): a, c, t, g, unknown or other
  misc_feature (667)..(667): n is a, c, g, or t
tcagatacgacgtacacgaccggtgctcgatttagtagcatactgttgggtttgggggcaggagtcagtcccaacctggacacagcatggacatggagggtccctgctcagctccgtggggctcctgctgctcgtggcctccgaggtcgaccagtagttgtagaacactaccgaagacgtacgaaccctacgttccctcctacgttccccttcccgttcgttcttcgttctttcggtacggtaccgggaagacgaaggtactaccacctagttcctacgtcgaccgagggcgtaaggtggaacggactttaacgtttaacgggttttaaaatttttaacggttcggtttaacgaacgaaccgaaacggaaaaccggaacggggtaacctacccgtaagtacccgtccgttagacgttaccgaacggacgtacctaacgtaacgtaagggttaacgggtaaacgggtacccgggtacctaaacgggttaaggtccggtaaggggtacgggtagggtacgggtaacgggcggttaaccggggacttaaacgtttaacccgtttacccacaacccgtagacgtaccgagaccctcgacgtacgaccgtaacgtagtaagtcctacgtacgaactaacgtattaaccgtagttaacgtaacaacgtttaanaaacttaacgttaccgtacctacccgtttaagttaccgggttacggaacggttaacgggaactacgggtaacgtggaaaccgtaactaaacggtaaccggttagtcggaccgttaccctaaacggtaccctacggtttaacgtacccgttttggaccccttaacttacccccgg

SEQ ID NO: 96149 - DNA, 676 bp, Homo sapiens
  misc_feature: GYAE6OF01DSUTX.12.37.D04.1.454.CMB.1.raw
  modified_base (195)..(195): a, c, t, g, unknown or other
  misc_feature (195)..(195): n is a, c, g, or t
  modified_base (214)..(214): a, c, t, g, unknown or other
  misc_feature (214)..(214): n is a, c, g, or t
  modified_base (217)..(217): a, c, t, g, unknown or other
  misc_feature (217)..(217): n is a, c, g, or t
tcagatacgacgtacacgaccggtgctcgatttagtagcatactgttgggtttgggggcaggagtcagtccccaacctggacacagcatggacatgagggtccctgctcagctcctggggcctcctgctgctctggcctcccaggtcgccagatgtgacactccaggatcgacccagtcctccacttccctcccngtctgtcttcgtcggcganacngacgtccaaccatcactcgccgaggcgagtggagactagttacggtaaatttttagtgttacagacaacgaaacgacggaacgccccctagtacctcctagacttaccgaacggcgacactactaaggttacggaaacgtccggggtacccaaggttaacggttcgaggtggagggtggaacgtcgtacgggactacggttactttaccccgcaacctcgacgacgtacgacggaccctcgaccgaaggacctaagaaacgttcgttaccgtagacctaaactagtttaacccggttataccgtaaacctaagtacgtttaaactaataaccttcccgtaaccgtttacctggttacgaccggtaggaccaaggtcgaagggtacaacgtaaccgtaaaccgtaggtcgtacgaccgttcgaacccgttactagttccttacgttcccgtcttaccccg

SEQ ID NO: 96150 - DNA, 602 bp, Homo sapiens
  misc_feature: GYAE6OF01EFHTE.12.37.D04.1.454.CMB.1.raw
  modified_base (289)..(289): a, c, t, g, unknown or other
  misc_feature (289)..(289): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtcctccatcctcctgtctgcttctgtcggagacagagtccaccatcacttgccaggcgagtgaggactattacggtaaaatttttaaagttggtttcagacaagaaaccgagggaaacnccccgtaaggtcctgatctatgctgcactcctagtttgacgtaaaggtcgggtaaccagtacgtaacggttcgaggtcggacgtagggttcgggtcgtaggggactacgtacttttacgacttctacgaacctactacagctacgtctacgactaaacctgaaactactttcgagtaccttaaacttactttactagtacgaacacgtaacgtaacctacgttacccctaccgttacgttacgggacggaacggaactagggtacgaagtacgtacgtaacgactcggacgcgtgaccactatctgtctaccg

SEQ ID NO: 96151 - DNA, 715 bp, Homo sapiens
  misc_feature: GYAE6OF01D040U.12.37.D04.1.454.CMB.1.raw
  modified_base (157)..(157): a, c, t, g, unknown or other
  misc_feature (157)..(157): n is a, c, g, or t
  modified_base (193)..(193): a, c, t, g, unknown or other
  misc_feature (193)..(193): n is a, c, g, or t
  modified_base (302)..(302): a, c, t, g, unknown or other
  misc_feature (302)..(302): n is a, c, g, or t
  modified_base (309)..(309): a, c, t, g, unknown or other
  misc_feature (309)..(309): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (496)..(496): a, c, t, g, unknown or other
  misc_feature (496)..(496): n is a, c, g, or t
  modified_base (699)..(699): a, c, t, g, unknown or other
  misc_feature (699)..(699): n is a, c, g, or t
  modified_base (708)..(708): a, c, t, g, unknown or other
  misc_feature (708)..(708): n is a, c, g, or t
tcagatacgacgtacacgaccggtgctcgatttagtagcatactgttgggtttgggggcaggagtcagtcccaacctggacacagcatggacatggacgggtccctgctcagctccgtggggctcctgctgctcgtggcctcccgaggtcgccaagntgacgactacgccagtactccgaaccctgtcctccncttcccgtcctgtctgtccgttcgaggtacggaacagagaccgtaccactagtcgttacgccggaccggtaccagacgacggtatagttacacgttaaagttggtacgngtagtancggatacgacgacgacgtaacggtaccctcctacgtctagngtctaggtcgcnctactccgtttagcgactagggtaccggtcggtactaacgtaggtaacgtcgaccgggtgtacggtaggtcgaaccggtggtaaaccggtatacggtactacctacgtaccaacgacctaaccgtccgaaccgnggccctagacccgtacgaacgttacgttaattccgttaacgtaactttacttaaccgggtgttaaaccgtactttaaacgttttccggaaaccttttttcccggtaaactttccgggttaccgttaccggttaccctaacgggtacctaacggttataaaccgttcgtaaacctaaggttaaccctggggaccttggtacccncttaccggntttaccg

SEQ ID NO: 96152 - DNA, 802 bp, Homo sapiens
  misc_feature: GYAE6OF01DGZ3M.12.37.D04.1.454.CMB.1.raw
  modified_base (293)..(293): a, c, t, g, unknown or other
  misc_feature (293)..(293): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctggtcgagacagacgtcaccatcacttgccaggcgagtgaggactagttacggtaaatttttaagtggtttcagtacaacgaaaccgaacggggaaaccnccccgtaaggtaccttccgttagtaacttccgaacggtacggactaacgttaccaaaggtttaccgggaaaggttaacgggggtacccccaaagggtaacggttcgaaggttgggaacgggttggacggtcggtacggggactaacggttacctttttaaccccacgtacctaacgttaccgacggaccacggtacccttacggcccgtaacgtccgttaaggaaacgttcttacgtttagacctaacgtatttaaccgtttacgtacgttaacctaacggtaactttaacgttaaacttaaccgtttacccgttaaccccggttttaaccgttacccggtttttaccgggaaccccgggttaaacgggggtaaccctaaacgggttacccgggttaacgggtaaggtaacccgtaaaccggaaaaacccggttaggtttacgggtacggtaccgttacgaacccttacccgtaatttcccggtttaccgtcccttttccggtaacccc

SEQ ID NO: 96153 - DNA, 696 bp, Homo sapiens
  misc_feature: GYAE6OF01BFCM5.12.37.D04.1.454.CMB.1.raw
  modified_base (420)..(420): a, c, t, g, unknown or other
  misc_feature (420)..(420): n is a, c, g, or t
  modified_base (493)..(493): a, c, t, g, unknown or other
  misc_feature (493)..(493): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgaccccagtctccactccctccctgtctgtcttctgtcggagacagagtccaccatcacttcgccaggcgagtggaggtacattacggttaaatttttaaagttggtttacagtacaacgaaaccgaaggaaccgtacccctagtaccttctagtacttaccgacgaggcactacaacgttacggaaagtacgggtacccaaggtacggtcgaggtggaggtggagtcggtagggtactaacgttaacctttacccnccgaactacgtacacgaccgacgtccgtagacgtaacgtagtaaggaagtaccttacgtaacgacctaaagtntttaaaccgttaccgttaggtaaccctaaagtaagtttaaacttaaacttaccgttacccccgttaacccggttaaccttttaaccgggtttaccggaaacccgggtacggggaaccctaggacgtacgggtaactaaccgtaacgtaaaccgtaggtgtaccggactcgaaccctacttacttacgttccttctacgttccc

SEQ ID NO: 96154 - DNA, 738 bp, Homo sapiens
  misc_feature: GYAE6OF01BP0R8.12.37.D04.1.454.CMB.1.raw
  modified_base (246)..(246): a, c, t, g, unknown or other
  misc_feature (246)..(246): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggcctcccgaggtgccagatgtgacatccagactcgaccctagtcctccacttccctccctgtctcgctatctgtacgcagacagacgtaccaccatcctacgtcggaccgganaacgtcgaacgtacctatacgacgtacgtacgtaactttaacgttttaaagtcggttaactaccgtaacggaaccgtaaaaccggaaaacccggtaacggggtaaaacccgttacccccgttaaagggtccctaggtaaccttacgtaacgtcgtacgtacgtactacgtccgttaggtttacgacgtaacgggtcggtacctaaggtacgtacggtcgaggtcgtacggtaggtcggtaccgtagggtaactaacggttacgttaccgtacgttacctaccgtaacgtactccggaacgtccgtacgtaccgtcggacctacgtaccgtaagtaacgttgtacgtacgtacttaacgttacgtacgtaagttaaactaaacgttacgtaaccgtcgttaccccgtccccgttaacgtacccggttaaccggacggtaaaccgtaccggacgtacgtaaggtactacgtaacgtacgtacgtggtcgtaccg

SEQ ID NO: 96155 - DNA, 727 bp, Homo sapiens
  misc_feature: GYAE6OF01ERSH0.12.37.D04.1.454.CMB.1.raw
  modified_base (144)..(144): a, c, t, g, unknown or other
  misc_feature (144)..(144): n is a, c, g, or t
  modified_base (464)..(464): a, c, t, g, unknown or other
  misc_feature (464)..(464): n is a, c, g, or t
  modified_base (495)..(495): a, c, t, g, unknown or other
  misc_feature (495)..(495): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtnccagatgtgacatccagatgacccagtctccatcctccctgtctgcttctgtcgagacagagtccacatcactttcgaccaggcgagtcgaggtacagtttacggtaaattttttaagttggtttacagtaccaagaaacccgaagggaaacgccccttaaggacctaccgtagtacgttaccgacggtaggcctaattaccccgaaggtttaccgaaagttaccggggtaccccaaaggtaacggtttaccgagggtggtaagggtcggaggtaccgtaggggaacctaggttaacctttttaccccgactaaccgtanaccgaacgtccgaacgcccgtaagccgtaanaccccggttagaacgtattcgttaacggaccaaacgttattaacgttacctgtaaccaacgttaacgtaattaaacgttattacccgtaacccgttacttacggtttacgggacccgaaggggtaccctaacggagtacggtaataacgttaaccgaaaccggttagttacgggttccgacgttacgaaccccgttcgtaagttacccgtttggttaacttccccgttaacg

SEQ ID NO: 96156 - DNA, 768 bp, Homo sapiens
  misc_feature: GYAE6OF01AE6UW.12.37.D04.1.454.CMB.1.raw
  modified_base (150)..(150): a, c, t, g, unknown or other
  misc_feature (150)..(150): n is a, c, g, or t
  modified_base (561)..(561): a, c, t, g, unknown or other
  misc_feature (561)..(561): n is a, c, g, or t
tcagatacgacgtacacgaccggtgctcgatttagtagcatactgttggggtttgggggcaggagtcagtcccaacctggacacagcatggacatggagggtccctgctcagctccgtggggctcctgctgctctggcctcccgaggtcnccagatgtcgacactccagactcgaccctagtcctcctactcccgtccctgtctcgtcttcgtggcggagacaggactccactatcgacgtcgaccgaggcgaggtcggaagtactacgtttaacgttaaatttttaagtgttacagacgaacgaacgaacggaacctccctagtacctcgtagtactacgacggacggactaacgtaaccgtaaggtttaccgggaaacggttaccggggtacctaacgggttaaggttacggtaggggtacgggtaagggtacgggtaggtacgggtaacgggtacgtaccgtttaaccgtttaccccacctaaccgtactacggacgtaccgtaccgtccggtacgaaccgtacgggtacctaagggtaacttacgttaccggttaanaaccgttaacttacgttaacgttaacctacgtaactaaagttaacttaaacgttaacttacccgttacccgtaaccgttaacgttcgggttacccggaacggtaacggacctacggtaggtacgaacctaagtaaaccgtaacggttacgtacggtccgtacgtaccgtaaccgtacttcgttacgtaccttacgtcccttaacccg

SEQ ID NO: 96157 - DNA, 698 bp, Homo sapiens
  misc_feature: GYAE6OF01D8WZO.12.37.D04.1.454.CMB.1.raw
  modified_base (208)..(208): a, c, t, g, unknown or other
  misc_feature (208)..(208): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggcctcccaggtcgccagatgtgacatccagatcgacccagtctccactcctccctgtctgtcttcgtggtcgganacgagactccacatcactcgaccgaggcgagtgagactagttacgttaaattttaagttggttacacgacaagaaaccgaagggaacctcccgtaacgtcctctagtacttaccgaacggacggacaactaccgtaaagttaacgggaaacggtccgggtaccctaaacgggtaacggttcgaagggtggggtaacggtaggacggtcggtaggggaacttaaggttactttacctccgtacaacctagtaccgacgtaccgtacggtcctacgggaccgtacgtacgtaacggtaagtactttacgtacgacttaaaccgttattacgtttactacggttaaacctaaagtaagttaaactaacgttaacctacccgtttaacccgtaacggtttcgttaccgggaacggtaaccgggactaaagcggtaacgaacgtactaaacggtaacctagtcgtgactacgacctacttctacctgtccgtacc

SEQ ID NO: 96158 - DNA, 951 bp, Homo sapiens
  misc_feature: GYAE6OF01CAWNO.12.37.D04.1.454.CMB.1.raw
  modified_base (147)..(147): a, c, t, g, unknown or other
  misc_feature (147)..(147): n is a, c, g, or t
tcagatacgacgtacacgaccggtgctcgatttagtagcatactggttgggtttgggggcaggagtcagtcccaacctggacacagcatggacatggagggtccctgctcagctccgtggggctcctgctgctctggcctcccaggngcagatgtgacatccgagatcgaaccctgtcctccactccctccctgtctgcttcgtggacggagacgagtacgtaccacctatctaacgtcggaccgaggacgaggtagaacgggtacttaacgtttaacggtttaaaagttttttaaacgttcgtttaacgaacggaactaaaacggaaaaccgtaacggggtaaacctaccccgtaaggtaacccttaccgtaacgtacgttaccggaacggacggtacctaacgtaaccgtaaacggtttaaaccggggtaaaacggttaccgggggtaacccctaaagggttaaacggttccggaaggggtacggggtaacggtagggaacggaccgggtttaagggaaaccttaacgggtttaaaccccttttaccccgaaccgtaaccgtaacgttaacccgaacgtaaccgtaccgggtacccgttaacggaccctaaccgggttaacccgtaaacgggttaagtaaccgtttaacgtaaccggaactaaaacgttactttaacgtttaaccgtaacgttaaaccgtaaaacgttaacggtttaaaattaaaccggtttaaccctttaacccgttaaccccgtttaaaccgttttaacgggtttacccgggaacccggttaaaccggggaaccttaacgggtacgttaaccggggaaacttaaaccgtaaaacccggtaaacggtaaccgggttacggtaaccgtccggttaaacgaaccccgttaacgttaacggttacctttaacccgtttacccggtcccttttaaaccccgg

SEQ ID NO: 96159 - DNA, 632 bp, Homo sapiens
  misc_feature: GYAE6OF01CI8DE.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggcctcccaggtgccagatgtgacatccagatgacccagtctccatccctcctgtctgcttctggtcggagacagagtcaccatcacttgccaggcgagtgaggacagttacggtaaatttttaattggtttacaggacaagaaaccgagggaaacgcccctaagacctcctgacttcacgaggacagtacctaagtacggaaagtcggggtacccacggtaaggttcaggtagggaggtgggagcgtaggggaacctaggtaacttttaccccgacacccaagtacccgagactacgcctggaccacgtaccgtagaacgtaattcctagtaccaactaattattaaccgtcgtacaactagtaataaatactaccttaccgtacttacgtttacggccgtaacgggacgtaacgcgtagggtaataacgtaacgtaaacccgtagtcggtcggtacgttagaccctaacttacgtaccgttcgttaccttccgtaccc

SEQ ID NO: 96160 - DNA, 638 bp, Homo sapiens
  misc_feature: GYAE6OF01AOHJT.12.37.D04.1.454.CMB.1.raw
  modified_base (194)..(194): a, c, t, g, unknown or other
  misc_feature (194)..(194): n is a, c, g, or t
  modified_base (201)..(201): a, c, t, g, unknown or other
  misc_feature (201)..(201): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatcgacccagtctccatcctcctgtctgcttcngtcgganacagagtccaccatccacttcgccaggcgagtgaggactagttacggtaaatttttaagttcggttacagtacaacgaaaccgaagggaaccgtccccgtagtaacctcctagacttacgaacggacggcactacccgtaagttaccggaaagttaccggggtacccaagggtaaggttcgaagggttggaggttggacgtcggtagggactacgtaccttttacccacgacctactcacgcaacgcctgcacgccgtagaatactctcgactacgtaattacgttactgtaaccaactagttaataacttaactaccttcccgtaattaccgtttcggacgtaacgggtacaacggtcgaggaactaacgtacgaaaaccgtaggtgtcggactaccgtaccctaaccgtacttacgtctttaccttacgtacccg

SEQ ID NO: 96161 - DNA, 698 bp, Homo sapiens
  misc_feature: GYAE6OF01DN3LW.12.37.D04.1.454.CMB.1.raw
  modified_base (217)..(217): a, c, t, g, unknown or other
  misc_feature (217)..(217): n is a, c, g, or t
  modified_base (521)..(521): a, c, t, g, unknown or other
  misc_feature (521)..(521): n is a, c, g, or t
  modified_base (550)..(550): a, c, t, g, unknown or other
  misc_feature (550)..(550): n is a, c, g, or t
tcagatacgacgtacacgaccggtgctcgatttagtagcatactgttggggtttgggggcaggagtcagtcccaacctggacacagcatggacatgagggtccctgctcagctcctgggggctcctgctgctctggcctcccaggtcgccagatgtgacatccagatcgaccccagtcctccactcccgttccctgtcctgtcttccgtagtcgganacaggtacgtccaccatccgtacttcggccgaggcgaggtgaacggactaacgtttacgttaaaatttttaagttcggttacgagtaccaacggaaaaccgaggggtaaaaccgcccctaggtaccctccgttaacgtacgttccaacgggcggaccctacgtaacctaaacgttacgggaaaacggttacggggtaccccgaaaggtaacgggttacagggttacgggagggtcggaacggtcggtacggggaaatacggttaccttttaacccgactaccctagtccaaggtcacgtccgtnccgaacggtctaacgtacgtactttcganaccgtaactattacttacgtagtaaccaacgtatacgttaataccttacgtacccgttaccgttacttccgacggacggacgaaccgagtagacgaataccgaaactaggactcgtacgcacgtactacgtcttacgtctcttacccg

SEQ ID NO: 96162 - DNA, 649 bp, Homo sapiens
  misc_feature: GYAE6OF01ARJG3.12.37.D04.1.454.CMB.1.raw
  modified_base (184)..(184): a, c, t, g, unknown or other
  misc_feature (184)..(184): n is a, c, g, or t
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctcccngtctgcttctgtcgganacagagtcacntcacttgccaggcgagtgagacagttacgttaaattttaaagttgttcagactaacgaacgaggaacgcctagtactctgattacacgaggcataccaagttacgaaagtacgggtaccacgtaaggtcgaaaagtggaggtggagcgtaggacacgtactttaacccgtcaaccgtactacgacgacgacgtaccgtcgacgtacgtaccgtagtaacgtacgttcgttacgtaccgtaaactacttaacgttacgtacgtactaaactaagttaaataaacgtaacttacccgttaaccgttaaccgttacgtttacggaccgtaacgggaaccgtaacggagtaccggaagtaacgtaacccggtaaacgtaaccgtaggtcgtacgtacgtaaccaccgttaccgttaccgttacttcgttaccgttaacccg

SEQ ID NO: 96163 - DNA, 790 bp, Homo sapiens
  misc_feature: GYAE6OF01EE5SU.12.37.D04.1.454.CMB.1.raw
  modified_base (728)..(728): a, c, t, g, unknown or other
  misc_feature (728)..(728): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctcggctcccgaggtgccagatgtcgacatccaagactcgaacccagttcctaccacttcccttccctttcgtcgtcctttactcgggtacggaacacgaagtacgtaccaacctatcctacgttcgaccgacggtcgagtacggagtaacgtaacgtttaacggtttaaaattttttaagttcggtttacaacggtaacgaaacggaaaaccggtaacgggtaaacctaccccgttaagtacctttacgtagtaacgttaccgaacgacggactaacgtaaccgtaagttaacggtaaaaggtccgggtaccgaacggtaacgttacgaggtagggtaaggtggacggtacggtaggtaaccgtaacgtttaccgtttaccccacgtaaccgtagtaccggtacgaccgttaacgcccggtacgacctacggtaaccgtacggtaaagttaccgtaccttaacggaaataaaccgttactttaacgttaaccgtcgttaaaccaaaggttaacttaaactttaactaccggtacccttaaccgttaccgtttaccggttaccggaaccggtaacggtaacacggcgtaagaccgtanaacccgtaaagcggttagcggtactacggaccctacgtgtacttcgttcctagtcctacccg

SEQ ID NO: 96164 - DNA, 750 bp, Homo sapiens
  misc_feature: GYAE6OF01CB7ND.12.37.D04.1.454.CMB.1.raw
  modified_base (131)..(131): a, c, t, g, unknown or other
  misc_feature (131)..(131): n is a, c, g, or t
  modified_base (293)..(293): a, c, t, g, unknown or other
  misc_feature (293)..(293): n is a, c, g, or t
  modified_base (460)..(460): a, c, t, g, unknown or other
  misc_feature (460)..(460): n is a, c, g, or t
  modified_base (538)..(538): a, c, t, g, unknown or other
  misc_feature (538)..(538): n is a, c, g, or t
  modified_base (611)..(611): a, c, t, g, unknown or other
  misc_feature (611)..(611): n is a, c, g, or t
tcagatacgacgtacacgaccggtgctcgatttagtagcatactgttgggtttgggggcaggagtcagtcccaacctggacacagcatggacatggagggtccctgcctcagctccgtgggggcctcccgngtcgcgtctcggtccgaccctaccggtaggccacgaagtagtaggaccaactacctacgagtacgaccacgtcctcctacctcctccgttcgtcgtctcgttacgtcggtacggaggacacgttacggacaccgtactacgtacgtacgacgacggtaaggnggaggtaacggaacgttacgttaacggtttaaaagtttttaaagtttacgttacgagaacgaacgtaaaccggaacggtaacggaccctacgtacgtactacgtaacgtcgaacgacgaacgtctaacgtaaaccgtagtaaccggacggtacgtaaccgaggtaancggtaggaggtaccgagaggtacgtacgtaacgttaccttaacgtccacggacctagacgtaacgctacgagcgtaanacggtaacaaggtactacttaacggaatacgaaatttcgtaacgttacagaacgtaacgtaataaacgttacnccgtttaaccgtgttaacgtcgggaaccacgggtaactacggcgtagtaagaaaacctagggtaaaccaagggtttgcccggttaaagtaccaccttacgtaaactttacgtcggtttaccaacggtctttaacccccg

SEQ ID NO: 96165 - DNA, 718 bp, Homo sapiens
  misc_feature: GYAE6OF01BYXFE.12.37.D04.1.454.CMB.1.raw
  modified_base (528)..(528): a, c, t, g, unknown or other
  misc_feature (528)..(528): n is a, c, g, or t
  modified_base (707)..(707): a, c, t, g, unknown or other
  misc_feature (707)..(707): n is a, c, g, or t
tcagatacgacgtacacgaccggtgctcgatttagtagcatactgttgggtttgggggcaggagtcagtcccaacctggacacagcatggacatgaggtccctgctcagctcctggggcctccgtgctgctctggcctcccgaggtgccagtatgtgacatccgagactcgacccagtcctccatccctcccgtgtctgcttctggtacggagacagacgtccaccatcgtacttacgccgaggcgtagtgacgtactagttacggttaaatttttagtcggttacacgtactaagaaccgaaggaaccaccccgtagacctaccgtagtaacttccgaacgtacgactacgtaccgtaagttacggaaacgttccgggtaacccaggttaacggttcgaagggtcggacggtacggagtccggtaggacgtacgttaccgtttacccgacgaacgtaggtacacggtcgacctccgtcgacagtccctaaggaactcgtacgtagaccctaagtagttaacttacgngtaacctaaagttagttaacttaacgtctttcccgtaaccgttagtttaccgttacgggaacccgtacgggtaaccctacggttacggttacggaaccgttaacggtaacccggaaaccggtacttcgggtaccgtaccgttaacgacccgttaactcggttacccttaacggttcccnccggttacccc

SEQ ID NO: 96166 - DNA, 779 bp, Homo sapiens
  misc_feature: GYAE6OF01EI6W0.12.37.D04.1.454.CMB.1.raw
  modified_base (213)..(213): a, c, t, g, unknown or other
  misc_feature (213)..(213): n is a, c, g, or t
tcagatacgacgtacacgaccggtgctcgatttagtagcatactgttgggtttgggggcaggagtcagtcccaacctggacacagcatggacatgagggtccctgctcagctcctgggggctcctgctgctctggcctcccgaggtcgccagatgtagacatccagatcgacccagtctccactccctccgtgtctgtccttctggtacgganacgagtacgtaccacctactctacgttcgaccgaggcggtaggtggaacggtaacttagttaacggtttaaatttttaacgttggttacaagacaaacggaaccggaacgggtaacctccctagtacctcgtacgtacttacgacgggaacgcctaacgtacctaaacggttacgggtaaaccgggtaccgggtaccctaagggtacggttacgaggggttagggaggttagggacggtacggggtacggtaaccggtaactttacccgtttaaccgaccaacggtcacggtacgccgaactccggtactaccgacggtaaccctagggttaaccgtagtttaccggtaacaaccgttaaacgtacttttaacgttaaccgtaacgtaacctaaaagttaacgtttaataaaccttccggttaccccttaccgtttaacgtttacccgggtttacggaaaccggaaccgggacctaacgtcgggtaacgtaacgtacgtaaaccgtaaagtcggtggtaccgtataccgaaccctaattcccttaggttccttcctcggttacccc

SEQ ID NO: 96167 - DNA, 853 bp, Homo sapiens
  misc_feature: GYAE6OF01BHZ3T.12.37.D04.1.454.CMB.1.raw
  modified_base (222)..(222): a, c, t, g, unknown or other
  misc_feature (222)..(222): n is a, c, g, or t
tcagatacgacgtacacgaccggtgctcgatttagtagcatactgttgggtttgggggcaggagtcagtcccaacctggacacagcatggacatgagggtccctgctcagctcctgggacctcctgctgctcgtcggcctccgagactaccagatgtagacagtcgagtatccgaccctagtcctaccacgtccctcctgtctacgctatcgtaggtagganaccgagtacgtccaacctactacgtaccgttcgggccgggacgtaacgtccggagggtactacgttaagtacttttaagttttacgaccgttaggtactacgacgaacgaaacggaaaccgtaacgggtaaccttaccgacctaccttcgacgtaactcgtatcgtcgtacgactaccgttccgttacttacgacgtaccggtacggttaacccggtcctacgggttacccggttcggtacgacgggtaccggtacgttacggtacggtacggtttacgggacgggtaaccttacgggttaccttccgtaaccccgttttaccaacccgtaacgtaccgttacgaaccggcctaaccgggtccaacggttaccgacggttaccgtaagtacggttaccgtttacgggttaaacttaacccgtttaaacgtttaccgtttaaacttaaacgggttaaaaccttaaacggttaacccgttacgggttaaccccctttaccccgggttaccccctttaaaggtacccccggtaaaggggaacccgtaaccggggtaaaccctacgggttaaccggtaacggttaacgttaaacggtaacccggttaaccgtcggtttaacggccgttaaacccg

SEQ ID NO: 96168 - DNA, 303 bp, Homo sapiens
  misc_feature: GYAE6OF01D5XE5.12.37.D04.1.454.CMB.1.raw
  modified_base (178)..(178): a, c, t, g, unknown or other
  misc_feature (178)..(178): n is a, c, g, or t
  modified_base (296)..(303): a, c, t, g, unknown or other
  misc_feature (296)..(303): n is a, c, g, or t
tcagatacgacgtacacgaccggtgctcgatttagtagcatactgttgggtttgggagaaggggtcccctcaagatttcatggcgacttttctgggacaaatttcaccctctccatcagcggtctggaacccgatgactttggaaagtattactgccatcagactcactattttcccnccgacgttcggccaagggaccaatagtggctctcaggcgaactgtggctgcaccatctgtcttcatccttcccgccatctgatcgtcgtatctgaggcggctggcaaggcgcaatagnnnnnnnn

SEQ ID NO: 96169 - DNA, 901 bp, Homo sapiens
  misc_feature: GYAE6OF01ERPEC.12.37.D04.1.454.CMB.1.raw
tcagatacgacgtacacgaccggtgctcgatttagtagcatactgttgggtttggggcaggagtcagtcccaacctggacacagcatggacatgagggtccctgctcagctccgtggggctcctgctgctctggcctcccgaggtgccagatgtgacatccagatcgaccctagtcctccacttcctccctgtctgtccttcgtcggtcggagacagtacgtaccaacctatacctaccgttcggccgagggacggtaggtacggacgggtaacttaaggttttaaaccggtttaaaaatttttttaaacggtttcgggtttaaccaacggtaccgtaaaacggaaaaacccgggtaacggggaaaccccgtacccccgttaagtaaccccgtttccgtacggttaacttaccggaacgggtaacggtacctaacgtttaacccgtaaaaggtttaccgggtaaaacggttaccgggggtacccccgtaaacgggttaacggtttacggaaggggttacggggtaaggggttacgggacggttcggtaacgggaacttaacggttaccttttaccccgactaaccgtactacgacgccgtaacgtcctacggacgacgtcgtaggtaaacttcgttacgtacgaacttaacgttaatttaacttacgttacgtaacctaaacgtttaagtaactaaacgttccgttaacccgttaaccgttacggtttaccggtttaacgggaacccggttaacgggtaaccgtaaggtaccgggtaaaggtaaccgtaaaccgtttaaaccggaaaccggttaccgttacggggtacccggtacctttaaaccgggaccctttaaacccttccggtacggttttacccgtttaacgtcccgttaaccccg

SEQ ID NO: 96170 - DNA, 685 bp, Homo sapiens
  misc_feature: GYAE6OF01BPCPT.12.37.D04.1.454.CMB.1.raw
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
tcagatacgacgtacacgaccggtgctcgatttagtagcatactgttgggtttgggggcaggagtcagtcccaacctggacacagcatggacgatgagggtccctgctcagctcctggggctcctgctgctctggctcccaggtgccagatgtgacatccagatgaccctagtcctccactcctcctgtctgcttcngtcgganacgagagtccacatccacttgccaggcagtgagacattcggtaaatttttaatggtttcagcaagaaaccgaggaaacgtcccctagactccgtagtacttcacgaggcactacctaagtacggtaaagtaccgggtaccctaaggtaaggttccgaaggttcggaggtcgggagtacgtgggacgtagtaccgttttaccctcgacctataccgacgttaccaacggtccctaggcctacggtccccgtaaggtaaacgtacgtttacccttaggaaccctaaactacgtttaacgttaacccgttaggtaacctaaaaccgttagtaaatttaactaaccgttccgttaacccgtaacttaccgggttttaccgaccggtacggtaaccgtaaggtcgttaacggagtaacgtaaccgaaaccggttaacgtcggtacgtacgtacgacctactacgtactttcggtccttctaccccg

SEQ ID NO: 96171 - DNA, 1024 bp, Homo sapiens
  misc_feature: GYAE6OF01D9WDN.12.37.D04.1.454.CMB.1.raw
tcagatacgacgtacacgaccggtgctcgatttagtagcatactgttgggtttgggggcaggagtcacgtcccaacctggacacagcatggacagtggacgggtccctgctacgagcttccgtaggggcctcctgcctgccttctcggacctcccgaggtcgacctaggtatcggtcaactactaccgaagtactaccggaacccgttacgtccctacctaccttcccttcccgtgttccttcgtccgtttcggtacggacggaacgtaacgtaagtaccgttacccaaacctagttaacctaccggttccggaccgggtagggtaccgtaacgggttaggggaaccggttaacgttttaaaggtttttaaaacggttttaaaaacgttttttacggttcgggttaaccaacggttaaaccgaaaaaccggtaaaaacccggtaaaccgggtaaaacccctaccgttacttacccgtagtaaccgtacgtaccggtacactacttaacccggtaaggtaacggtaaacggtaacccggtacggtaacggttacggtggtaacggtaagggtacgggagttacggggtaaacctacgggtaactaaacccggttttaaacccttaccccgtacgaacccttaaagaacccggttaacgaacccggtaaccgttaacccggttacggaaccgaaccgggttaaccggtaaaggttaacttaaccggtttacaaccgttaaaataaccggttacttttaaacccggtttaaccgttaaccggttaaccgtaaaacgtttaacgtttaaacttaaacccgtttaaccgtttaccccggtttaaccccgtttaaagggtttacccgggtttaacgggtaaaccggttaacgggaaaccggttacggtaacggtaacgtaaaccggtaaactaaaccgggtaaaacgtcggttacgggacgttaaacccggaccctaacgttaaccgttacgtttacgcctttaaaccctttccgccctttaacccccgg

SEQ ID NO: 96172 - DNA, 717 bp, Homo sapiens
  misc_feature: GYAE6OF01EXUB7.12.37.D04.1.454.CMB.1.raw
  modified_base (149)..(149): a, c, t, g, unknown or other
  misc_feature (149)..(149): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
tcagatacgacgtacacgaccggtgctcgatttagtagcatactgttgggtttgggggcaggagtcagtcccaacctggacacagcatggacatgagggtccctgctcagctccgtggggcctcctgctgctctggcctcccgaggtcnccagtatgtcgacatccagatccgaccctagtcctcctactccctccttgtcctcgtccttcgtcgggtacggaagacgtagtacgtacccacctacttaccgtaccgttcggaccgacgggtacggaggttacgggaacgttacgttaaggttttaaacggttttaaaattttttaacggtttacggttaactaacggaaccgtaaacggaaaccggtaacggaaccgtccccgtaacgtacctcgtacgtacttacgacggacgactacgtactaaggttaacggaacggtacggtaccgaagtacggttacgaggtggacggtggagtgtacggtactacgttaccttaccgcacgtacgcacgacncgtcncgtcgacgttcaagtacgtactacgtactacgaactgttaacgttactaacgtaacctaagtaacttataacgtactaccgttacgtacgtaccgtcgtaccgagacgtagcggtagtacaaccgtacgaaacggttcgtacggtcgtaccaccgacctacgttccttaccggttatccccgttattaccccg

SEQ ID NO: 96173 - DNA, 870 bp, Homo sapiens
  misc_feature: GYAE6OF01EIADK.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctccgtggggctcctgctgctctggcctccaggtgccagatgtagacatccaagatcgacccagtcctccatccctcctgtctgtccttcgtggtcggaagacctagacgtccaacctattaccacgtttcgaccgagggcgtaagtagacggtaactaagtttacgggttaaaaattttttaaacgttcggtttacaggtaaccaaacggtaaaaccggaacggggtaaaaccctcccccgttaaaggtacccttaccgtaggtaacttaccggaacggacggtacctaacgttacccgtaaaaggtttacgggaaaacggtttaccggggtacccctaaagggtaacgggtttacgaaggggtgggtaacgggtcggaacggtcggttaaggggaactaaccgggtttaaccttttaacccccgtacgaacctaagtaccgaacgtcccgaacgtccgtacgaccgtacggacgttaacggaacgtacttaccgttacgaaaccgtaacgtaacgtttaacgttaccctaggttaacctaaacggtttaaagttaaacttaaaacgttaaccgttaccccgtttaacccggttaacccgtttaccggttttaacggggaaccccggttaacgggggtaaaccctaacgggtaaccggtaacgggtaaacgtaaaccgtaaaccggtaaaacggtacgttacggtcggtaccgtacgaaccctacgtacgttaccgttacgtttccgttacgtaacccg

SEQ ID NO: 96174 - DNA, 506 bp, Homo sapiens
  misc_feature: GYAE6OF02IB99U.12.37.D04.1.454.CMB.1.raw
  modified_base (367)..(367): a, c, t, g, unknown or other
  misc_feature (367)..(367): n is a, c, g, or t
  modified_base (471)..(471): a, c, t, g, unknown or other
  misc_feature (471)..(471): n is a, c, g, or t
  modified_base (503)..(503): a, c, t, g, unknown or other
  misc_feature (503)..(503): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacatttcggaaatttttaaaatggtttcagcagaaaccagggaaagcccctagactcctgattcacgaggcatccaattcggaaatgggtcccagaaggttcagtggaggtggagctgggacagatttacccnaccatcagcagcctgcagcctgaagatcttgcaaacataattactgtacaaacagtaataataaatctacccgtacacttttggcctaggggaccaagctgganatcaaacgactgtggctgcaccatctgtcttntac

SEQ ID NO: 96175 - DNA, 541 bp, Homo sapiens
  misc_feature: GYAE6OF02I1YPY.12.37.D04.1.454.CMB.1.raw
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaatggtttcagcagaaaccaggaaagcccctagactcctgattcacgaggcatccaattcggaaataggggtcccagaaggttcaggtggaggtggagcgtgggacagtattttacccnaccatcagcagccctgcagcctgaagtntgttgctaactttattactgtacaaaagttactaacagttccgcccctttcaccgtttcggaccaagggaccacgtactggatagttagacgtaacgtggtacggctaggccaaccgtattccgtgtcttcattcccttcccg

SEQ ID NO: 96176 - DNA, 501 bp, Homo sapiens
  misc_feature: GYAE6OF02F6VT5.12.37.D04.1.454.CMB.1.raw
  modified_base (368)..(368): a, c, t, g, unknown or other
  misc_feature (368)..(368): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaatggtttcagcagaaaccagggaaagcccctagactcctgattcacgaggcatccaattcggaaataggggtcccagaaggttcagtggaggtggagctgggacagattttacccnaccatcagcagcctgcagcctgaagatcttgcaacattattactgtcaacagtataataatctaccgtactactttggccagggaccaagctggagatacgaaacgactgtggctgcaccatctgtcttctac

SEQ ID NO: 96177 - DNA, 502 bp, Homo sapiens
  misc_feature: GYAE6OF02I5A3U.12.37.D04.1.454.CMB.1.raw
  modified_base (276)..(276): a, c, t, g, unknown or other
  misc_feature (276)..(276): n is a, c, g, or t
  modified_base (360)..(360): a, c, t, g, unknown or other
  misc_feature (360)..(360): n is a, c, g, or t
  modified_base (499)..(499): a, c, t, g, unknown or other
  misc_feature (499)..(499): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctcctgtctgcttctgtcggagacagagtcaccatcacttgccaggcgagtgaggacattcggaaatttttaatggtttcagcagaaaccagggaaancccctagactcctgattcacgaggcatccaattcggaaatgggtccagaagttcagtggagtggagctgggacagatttacccnaccatcagcagcctgcagcctagaagatcttagcaacattattactgtacaactagtataatattctaccgtatactttggcctaaggggaccaagctaggagatacgaaacgactgtaggctgccactatctgtcttntac

SEQ ID NO: 96178 - DNA, 567 bp, Homo sapiens
  misc_feature: GYAE6OF02HCOCU.12.37.D04.1.454.CMB.1.raw
  modified_base (278)..(278): a, c, t, g, unknown or other
  misc_feature (278)..(278): n is a, c, g, or t
  modified_base (369)..(369): a, c, t, g, unknown or other
  misc_feature (369)..(369): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaattggtttcagcagaaaccagggaaancccctagactcctgattcacgaggcatccaattcggaaatagggtccagaaggttcagtggaggtggagcgtgggacagtacttttacccncaccatcagcagcctgcagcctgaagatcttgacaactattaacttactgtacaacagtaataataacttcctacccgtactacgttttcggacctaaggggtacccaagtcgtagggagacgtaccgaaaacgtaacgttggtacggtaccttacggaccctaaccgtacttccgttacggttacctttacgtaccg

SEQ ID NO: 96179 - DNA, 511 bp, Homo sapiens
  misc_feature: GYAE6OF02FKQAH.12.37.D04.1.454.CMB.1.raw
  modified_base (476)..(476): a, c, t, g, unknown or other
  misc_feature (476)..(476): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaattggtttcagcagaaaccagggaaagcccctagactctgattcacgaggcatccaattcggaaatacggggtccacgaaggttcagtggaggtggagcgtgggacaggtactttaccctcaccatcagcagcctgcagcctagaagatcttgacaactattaattactgtacaactagtaataataatctacccgtactactttgaccagggacaagctagganatacgaaacgactgtgctagcacatctgtctctac

SEQ ID NO: 96180 - DNA, 524 bp, Homo sapiens
  misc_feature: GYAE6OF02HK2NU.12.37.D04.1.454.CMB.1.raw
  modified_base (279)..(279): a, c, t, g, unknown or other
  misc_feature (279)..(279): n is a, c, g, or t
  modified_base (363)..(363): a, c, t, g, unknown or other
  misc_feature (363)..(363): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaatggtttcagcaagaaaccagggaaancccctagactcctgattcacgagcatccaatcggaaatgggccagaaggttcagtggagtggagcgtgggacagtatttacccncaccatcagcagcctgcagcctgaagatcttgacaactattattactgtacaacagtaataataatcctaccgtactacttttcggaccgtaaggggaccaagcgtaggagtatacgaaacgaacgtggtaggtctgacaccgattccgtgttacttctac

SEQ ID NO: 96181 - DNA, 536 bp, Homo sapiens
  misc_feature: GYAE6OF02HV2AN.12.37.D04.1.454.CMB.1.raw
  modified_base (278)..(278): a, c, t, g, unknown or other
  misc_feature (278)..(278): n is a, c, g, or t
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctcctgtctgcttctgtcgagacagagtcaccatcacttgccaggcgagtgaggacattacggaaatttttaaattggttcagcagaaaccagggaaacncccctagactcctgacttcacgaggcatccaattcggaaatgggtccagaggttcagtggaggtgagctgggacagtactttaccnaccatcagcagctgcngctganatctgacaactattatactgtacaatagttaataataattcctaccgttaactacgttttcggacctaaggggacctaagcgttaggagtactaccgtaaacgtactggtacggactcgacctactaacgttcgttacgtcttactaccg

SEQ ID NO: 96182 - DNA, 617 bp, Homo sapiens
  misc_feature: GYAE6OF02GG325.12.37.D04.1.454.CMB.1.raw
  modified_base (381)..(381): a, c, t, g, unknown or other
  misc_feature (381)..(381): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggtaaaatttttaaattggtttacagtcaagaaaccagggaaacgcccctagacctcctgattcacgaggcatccaagttcggaaatacgggtccaggaaggttcaggtggaggtggagctggggacaggtactttacccncacctatcagcacgcctgcacgcctagaagtattcgttgacaactattaaacttactacgtacaaactagtaattaacttaactccttacccgttactacgtttttacggaccgtaacggggtaaccaaggtaccgttagggaacgtaacgtaaccgtaaaaccggtaacgttagggtaaccgggtaccttacggaccgtaacctacgtttccgtcgtttacccttacttaacccg

SEQ ID NO: 96183 - DNA, 520 bp, Homo sapiens
  misc_feature: GYAE6OF02GU420.12.37.D04.1.454.CMB.1.raw
  modified_base (371)..(371): a, c, t, g, unknown or other
  misc_feature (371)..(371): n is a, c, g, or t
  modified_base (399)..(399): a, c, t, g, unknown or other
  misc_feature (399)..(399): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaacgcccctagactcctgattcacgaggcatccaattcggaaatggggtcccagaaggttcagtggaggtggagcgtgggacagtacttttacccncaccatcagcagcctgcagcctagaagntcttgacaacattattactgtacaacagtataaataactcctacccgtactactttggaccgagggacccaagtctggagactacgaaacgacgtgtaggctgacaccatctgtcttctac

SEQ ID NO: 96184 - DNA, 497 bp, Homo sapiens
  misc_feature: GYAE6OF02FE3P8.12.37.D04.1.454.CMB.1.raw
  modified_base (366)..(366): a, c, t, g, unknown or other
  misc_feature (366)..(366): n is a, c, g, or t
  modified_base (416)..(416): a, c, t, g, unknown or other
  misc_feature (416)..(416): n is a, c, g, or t
  modified_base (462)..(462): a, c, t, g, unknown or other
  misc_feature (462)..(462): n is a, c, g, or t
tcagatacgacgtacacgaccggtgctcgatttagtagcatactgttgggtttgggggcaggagtcagtcccaacctggacacagcatggacatgagggtccctgctcagctcctgggctcctgctgctctggctcccaggtgccagatgtgacatcccagatgacccagtctccatcctccctgtctgcttctgtcggagacagagtcaccatcacttgccaggcgagtgaggacattcggaaatttttaaatggtttcagcagaaaccagggaaagcccctagactcctgattcacgagcatccaattcggaaataggggtcccagaagttcagtggaggtggagctgggacagtatttacccncaccatcagcagcctgcagcctgaagatcttgcaacatattactgtcaanagtataataatctacccgtactactttgccagggaccaagctgganatacgaaacgactgtgctgcacatctgtcttctac

SEQ ID NO: 96185 - DNA, 583 bp, Homo sapiens
  misc_feature: GYAE6OF02F7X69.12.37.D04.1.454.CMB.1.raw
  modified_base (294)..(294): a, c, t, g, unknown or other
  misc_feature (294)..(294): n is a, c, g, or t
tcagatacgacgtacacgaccggtgctcgatttagtagcatactgttgggtttgggggcagggagtcagtccccaaccctgggtaccacgagcatggtacatgagggtccctgctcagctcctggggctcctgctgctctgggctcccaggtgcctagatgtgactatccagatgacccagtctccatcctcctgtctgcgttctgtcggagacagaggtccacatcacttgccaggcgagtgaggacattcggaaatttttaattggtttactagcagtaaaccagggaaacncccccgtaggacctcctggacttcgaacggaggcataccaattcggaaatcggggtaccagtaaggttcagtggaggtagagctgggacagtactttacccactaccatcgagcacgtcctgacacgcctagaaagtactcttacgacaaaccattaacttactgttaccaactagtattaaatactctacccgtatacgtttcggaccgtaagggacccaaggtctaggtatactacgaaacggtacgtggtcggactcggactacgtagttcgtgttacctcgtacg

SEQ ID NO: 96186 - DNA, 507 bp, Homo sapiens
  misc_feature: GYAE6OF02GVN6A.12.37.D04.1.454.CMB.1.raw
  modified_base (279)..(279): a, c, t, g, unknown or other
  misc_feature (279)..(279): n is a, c, g, or t
  modified_base (368)..(368): a, c, t, g, unknown or other
  misc_feature (368)..(368): n is a, c, g, or t
  modified_base (504)..(504): a, c, t, g, unknown or other
  misc_feature (504)..(504): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaattggtttcagcagaaaccagggaaacncccctagactcctgattcacgaggcatccaattcggaaatacgggtccagaggttcagtggaggtggagctgggacagtactttacccnaccatcagcagcctgcagcctagaagatcttagccaactattattactgtacaacagtaataataatacctcccgtactacgtttggaccagggacagctggagatacgaaacgactgtagctgcacatctgtctntac

SEQ ID NO: 96187 - DNA, 507 bp, Homo sapiens
  misc_feature: GYAE6OF02ICK1W.12.37.D04.1.454.CMB.1.raw
  modified_base (277)..(277): a, c, t, g, unknown or other
  misc_feature (277)..(277): n is a, c, g, or t
  modified_base (366)..(366): a, c, t, g, unknown or other
  misc_feature (366)..(366): n is a, c, g, or t
  modified_base (500)..(500): a, c, t, g, unknown or other
  misc_feature (500)..(500): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaatggtttcagcagaaaccagggaanccctagactcctgattcacgaggcatccaattcggaaataggggtcccagaaggttcagtggaggtgagctagggacagattttacccnaccatcagcagctgcagcctagaagatcttagcaacattacttactgtacaactagtaataataatctacccgtactacgttttgaccagggaccaagctggagactacaaacgtaactgtagctgcacatctntctctac

SEQ ID NO: 96188 - DNA, 549 bp, Homo sapiens
  misc_feature: GYAE6OF02HZ9N8.12.37.D04.1.454.CMB.1.raw
  modified_base (280)..(280): a, c, t, g, unknown or other
  misc_feature (280)..(280): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcaagaaaccagggaaancccctagactcctgattcacgaggcatccaattcggaaatcgggtccagaaggttcaggtggaggtggagctgggacaggtactttacccnaccatcagcagccngcagcctgaagatcttgacaacattattactgtacaaacagtaataataactcttacccgtactacgtttcgaccgtacggggaaccaagcgtacggagtaacgtacgaaaacggaacttaggtacggtcgtagtaccacctattccgttacgtaccttctaac

SEQ ID NO: 96189 - DNA, 612 bp, Homo sapiens
  misc_feature: GYAE6OF02GPPQ0.12.37.D04.1.454.CMB.1.raw
  modified_base (391)..(391): a, c, t, g, unknown or other
  misc_feature (391)..(391): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggactattacggtaaatttttaattggtttacagcaagaaaccgagggaaacgcccctagacctcctgattcacggaggcataccaagttacggaaagtacggggtacccaacggtaaggttcgaggtggaggtggagcgtgggacagtactttacccncaccatcagcacgcctgctagtctagaagttattttcgacttagttttacttacgttgtacagtctaagttaacttaagtaacgttcggttacctgtaccttacgtaccggttttcgggggaccgggggtaactaagggtcggaagtacgtaacgaaacggtacgttggtacggcgttacggaccaccgtacgttccgttacgttcgttaccacttccccg

SEQ ID NO: 96190 - DNA, 295 bp, Homo sapiens
  misc_feature: GYAE6OF02GHM4Y.12.37.D04.1.454.CMB.1.raw
  modified_base (292)..(295): a, c, t, g, unknown or other
  misc_feature (292)..(295): n is a, c, g, or t
tcagatacgacgtacacgaccggtgctcgatttagtagcatactgttgggtttgggagaaggggtcccctcaagatttcatggcgacttttctgggacaaatttcaccctctccatcagcggtctggaacccgatgactttggaaagtattactgccatcagactcacattttccctccgacgttcggccaagggaccatagtggctctcaggcgaactgtggctgcaccatctgtcttcatcttcccgcatctgatacgtcgtatctgagcgggctggcaaggcgcatagnnnn

SEQ ID NO: 96191 - DNA, 560 bp, Homo sapiens
  misc_feature: GYAE6OF02GXA79.12.37.D04.1.454.CMB.1.raw
  modified_base (276)..(276): a, c, t, g, unknown or other
  misc_feature (276)..(276): n is a, c, g, or t
  modified_base (366)..(366): a, c, t, g, unknown or other
  misc_feature (366)..(366): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctcctgtctgcttctgtcggagacagagtcaccatcacttgccaggcgagtgagacattcggaaatttttaatggtttcagcagaaaccagggaaacncccctagactcctgattcacgaggcatccaattcggaatagggtccagaaggttcagtggaggtggagcgtgggacagtacttttacccncaccatcagcagcctgcagcctagaagatcttgacaactattattactagtacaacagtaattaataattcctacccgtactacgttttcggaccgtaacggggaaccctaagcgtaggagtactaaccgaaaacgtaacgttggtacggtactacggacctaaccgtattccgtacgtttaccttactacccg

SEQ ID NO: 96192 - DNA, 556 bp, Homo sapiens
  misc_feature: GYAE6OF02IIY5R.12.37.D04.1.454.CMB.1.raw
  modified_base (400)..(400): a, c, t, g, unknown or other
  misc_feature (400)..(400): n is a, c, g, or t
  modified_base (510)..(510): a, c, t, g, unknown or other
  misc_feature (510)..(510): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaaattggtttcagcaagaaaccagggaaacgcccctaagaccttcctagtactttcacggaggacactccaaagttacggaaaattacgggggtaccccaacggtaaggttcaggtggagggtggagcgtgggacagtactttacccncaccatcagcacgcctgcagctagaagtatcttgacaaactattaacttactgtacaactagtaataataatcctaccgtatacgtttggccaagggacaagcgtagganactaccgaaacgtactggtacgctgacacgtatctcgtccttatac

SEQ ID NO: 96193 - DNA, 570 bp, Homo sapiens
  misc_feature: GYAE6OF02H15II.12.37.D04.1.454.CMB.1.raw
  modified_base (375)..(375): a, c, t, g, unknown or other
  misc_feature (375)..(375): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaaattggtttcagcaagaaaccagggaacgcccctagactcctgacttcacgaggcatccaattacggaaatacggggtccaggaaggttcagtggaggtgagctgggacagtactttacccncaccatcagcacgcctgcacgcctagagtatcttgacaactaattattactagtacaaactagtaataataactcctaccgtactactttcggaccgtagggaaccaagccgtaggaacgattaaccgaaaacgtaaccgttggtacggtaccgtaggaccctaaccgtacttcgttacgttcccttagtaaccc

SEQ ID NO: 96194 - DNA, 577 bp, Homo sapiens
  misc_feature: GYAE6OF02IFVGX.12.37.D04.1.454.CMB.1.raw
  modified_base (210)..(210): a, c, t, g, unknown or other
  misc_feature (210)..(210): n is a, c, g, or t
  modified_base (217)..(217): a, c, t, g, unknown or other
  misc_feature (217)..(217): n is a, c, g, or t
tcagatacgacgtacacgaccggtgctcgatttagtagcatactgttgggtttgggggtcgaggagtcagtcccaacctggacacagcatggacatgagggtccctgctcagctcctgggctcctgctgctctggctcccaggtgccagatgtgacatccagatgacccagtctccatccctccctgtcctgcttctggtcggagacagngtcaccntccacttgcccaggcgagtgaggacagtttacggtaaatttttaaagtggtttacagtacaagaaaccgtagggaaactcccctagactcctgacttcgacgaggcattccaaattcggaaatacgggtcccaaggtaagttcaggtggagtgagtcgtaggggactagtactttacccacaccatcagtcaacgctgcagcctagaagtatcgtgacaatattacttactgtaccaatagtaataactaatccttacccgtatacgtttggccaaggggacagtcgtagacgtataaccgaaacgtattcggtagtaccttagaccctaacgtacgttactacggttacttacctaccg

SEQ ID NO: 96195 - DNA, 562 bp, Homo sapiens
  misc_feature: GYAE6OF02IVVUW.12.37.D04.1.454.CMB.1.raw
  modified_base (373)..(373): a, c, t, g, unknown or other
  misc_feature (373)..(373): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaaattggtttacagcaagaaaccgagggaaacgcccctagactcctgattcacgagcatcaattcggaaatcgggtccagaggttcagtggaggtgagcgtgggacaggtacttttacccncaccatcagcagcctgcagcctagaagatctgacaacattattactgtacaaactagtaataactaacttccttacccgtaactacgttttcggaccgtaaggggaacctaaggcgtagggagtaactaacgaaacgtaacgttggtacggtaccgtagacctaccgtacttcgtacgttacttctaac

SEQ ID NO: 96196 - DNA, 674 bp, Homo sapiens
  misc_feature: GYAE6OF02HOGP5.12.37.D04.1.454.CMB.1.raw
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (386)..(386): a, c, t, g, unknown or other
  misc_feature (386)..(386): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggaaatttttaaattggtttcagcagaaaccagggaaancccctagactcngtattcacgagcactaccaagttacggaaagtacgggtacccaacggtaaggttcaggtggagggtaggagcgtagggacagtacttttacccncaacctatcgagcacgcctcgacacgtccgtagaagtacttcgttagaccaaactagttaactttaccgtgtaaccaaagacggtaacttaaccgtaccgtttaccccctacccgttaccggttttccgggaaccggggtaacgggtaacccggtaaagggtacggtaacgtaaccgttaccgaaaacggttaaccggttgggtaccgggtaccttacggaccccgtaacgttacgtttaccggttacgtttaccctttaacgtacccgtttaccccgttacccccgg

SEQ ID NO: 96197 - DNA, 563 bp, Homo sapiens
  misc_feature: GYAE6OF02HLOIS.12.37.D04.1.454.CMB.1.raw
  modified_base (302)..(302): a, c, t, g, unknown or other
  misc_feature (302)..(302): n is a, c, g, or t
  modified_base (370)..(370): a, c, t, g, unknown or other
  misc_feature (370)..(370): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtcctgcatctgtaggagacaaagtcaccatcacttgccgggctaacgagagtattgcctacgtatttaaattggtatcaaacaaaagcaggacaaagtcccaaagctactgatttangctgccacagtctgcaaggtggttcctcgaaggttcactggccgtggatcgagggacagtaatttacnctcacctatcagtagtctacagtctagaagtatattgacttaactttattacttgtacagcaggtacgttaccgcgtactcccattcctaccgtttcgacccgtaagggaccaccggaccgtacgaacggtacgttacgggaaccgtaacggttcggtacggtcctacggtaccaacccgtagttccgttacg

SEQ ID NO: 96198 - DNA, 583 bp, Homo sapiens
  misc_feature: GYAE6OF02GDNCA.12.37.D04.1.454.CMB.1.raw
  modified_base (389)..(389): a, c, t, g, unknown or other
  misc_feature (389)..(389): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacatttacggtaaaatttttaaagttggtttacagtcaagaaaccgagggaaacgcccctagacctcctgattcacgaggcatccaattcggaaatacggggtacccaagtaaggttcaggtggaggtggagcgtgggacaggtacttttacccncaccatcagcagcctgcagcctagaagatcttgacaactattattactgtacaactataataataactcctacccgtactacgttttcggaccgtaacgggaccaagtcgtagggacgtacgtaacgaaacggtaacgttggtacggtaccgttacggacctaccgtattccgttacgttaccttacgtacccg

SEQ ID NO: 96199 - DNA, 578 bp, Homo sapiens
  misc_feature: GYAE6OF02HNOFE.12.37.D04.1.454.CMB.1.raw
  modified_base (283)..(283): a, c, t, g, unknown or other
  misc_feature (283)..(283): n is a, c, g, or t
  modified_base (379)..(379): a, c, t, g, unknown or other
  misc_feature (379)..(379): n is a, c, g, or t
  modified_base (410)..(410): a, c, t, g, unknown or other
  misc_feature (410)..(410): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaaattggtttcagcaagaaaccagggaaacncccctagactcctgattcacgaggcatccaattcggaaatacgggtcccaagaaggttcaggtggaggtggagcgtgggactagtacttttacccncaccatcgagcacgcctgcagcctagaagtntcgttgacaactattactttaactgtacaactagttaataattaactccttacccgtacttacgttttcggacccgtaacgggggaccaaggtccgtagggactaactaccgaaaacggtacgttgggtacgactacgaccaacctgttaccgtgttaccttctaccg

SEQ ID NO: 96200 - DNA, 579 bp, Homo sapiens
  misc_feature: GYAE6OF02GXUI5.12.37.D04.1.454.CMB.1.raw
  modified_base (383)..(383): a, c, t, g, unknown or other
  misc_feature (383)..(383): n is a, c, g, or t
  modified_base (408)..(408): a, c, t, g, unknown or other
  misc_feature (408)..(408): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggactattacggtaaatttttaattggtttacagacaagaaaccgagggaaacgcccctaagactcctgattcacgaggcatccaattacggaaatacggggtccaaggaaggttcaggtggaggtggagcgtgggacagtactttacccncaccatcagcagcctgcagctaganatctagacaactattattactgtacaactagtaataataactccttacccgttacttacgttttacggaccgtaacggggtaccaaggtcgtagggagtaactaacgaaaccgtaacgttcggtacggacttacggacctaccgtacttccgttacgttcctttactaccg

SEQ ID NO: 96201 - DNA, 609 bp, Homo sapiens
  misc_feature: GYAE6OF02FQYXF.12.37.D04.1.454.CMB.1.raw
tcagatacgacgtacacgaccggtgctcgatttagtagcatactgctgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggtaaatttttaaattggtttacagcagaaaccaagggaacgcccctagacctcctgacttcacgaggcatacctaagttacggaaatacggggtacccacggtaaggttccgaggtgggaggtggagcgtgggactagtactttacccacaccatcagcagctgcagcctagatatcttgacaactatattactcgtacaaactagttaataaatacttcctacccgttaacttacgttttacggaccgtaacggggaacctaacggtcgttaggaacgtaacgtaaccgtaaaaccggtaacgttcggtacggttaccgtaccggacctaaacccgagtttacccgtttacggttccctttaacccg

SEQ ID NO: 96202 - DNA, 604 bp, Homo sapiens
  misc_feature: GYAE6OF02GVQ8C.12.37.D04.1.454.CMB.1.raw
  modified_base (388)..(388): a, c, t, g, unknown or other
  misc_feature (388)..(388): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaattggtttacagcaagaaaccgagggaacgcccctagacctctgacttcacggaggcataccaagttcggaaagtaggggtacccaaggtaaggttcaggttgggggtagagcgtgggacagtacttttacccgnaccatcagcagcctgcacgcctagaacgtacttcgttagacaactattaactttacgtagttacaaactagttaattaaataacttccgttacccgttactacgttttcggacccggtaaggggtacccaaggccgtagggagtacgtacgaaacgtaactcggttacggacctacgacctacgtacttccgtacgttaccttacctacttccccg

SEQ ID NO: 96203 - DNA, 508 bp, Homo sapiens
  misc_feature: GYAE6OF02GMEML.12.37.D04.1.454.CMB.1.raw
  modified_base (388)..(388): a, c, t, g, unknown or other
  misc_feature (388)..(388): n is a, c, g, or t
  modified_base (399)..(399): a, c, t, g, unknown or other
  misc_feature (399)..(399): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaatggtttcagcagaaaccagggaaagcccctagactcctgattcacgagcatccaattcgaaatagggtcccagaagttcagtgaggtgagctggacagtatttacctcaccatcgagcagcctgcagcctagaantcttagacaanattattactgtacaacagtataactaatctccgtatactttgccagggacaagtctagagactacgaaacgtactggtaggactgactacctatcttagtcttactacc

SEQ ID NO: 96204 - DNA, 589 bp, Homo sapiens
  misc_feature: GYAE6OF02GCNK0.12.37.D04.1.454.CMB.1.raw
  modified_base (286)..(286): a, c, t, g, unknown or other
  misc_feature (286)..(286): n is a, c, g, or t
  modified_base (382)..(382): a, c, t, g, unknown or other
  misc_feature (382)..(382): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggactagttacggtaaatttttaattggtttacagcaagaaaccgagggaaacncccctagacctctgattcgacgagcataccaattcggaaagtcggggtacccaggaagttcaggtggaggtgagcgtagggacagtactttacccncacctatccagcagcctgcacgcctagaagtactcttagactaactattacttactagtacaaactagtaattaactaacttccttacccgttacttacgttttcggaccgtaacggggtaaccaaggtcgtaggacgtaacgtaaccgaaacgtaaccgtaggtacgactacgaccaccgtagttcgtacgttaccttaccgtacc

SEQ ID NO: 96205 - DNA, 595 bp, Homo sapiens
  misc_feature: GYAE6OF02IHAXE.12.37.D04.1.454.CMB.1.raw
  modified_base (287)..(287): a, c, t, g, unknown or other
  misc_feature (287)..(287): n is a, c, g, or t
  modified_base (394)..(394): a, c, t, g, unknown or other
  misc_feature (394)..(394): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtccaccatcacttgccaggcgagtgaggacatttacggtaaattttttaaagtggtttcagcaagaaaccgagggaaacncccctagactcctgtattcacgaggccaatccaaattcggaaagttcggggtacccaaggtaaggttcaggtggaggtggagtcgtgggactagtaactttacccanaccatcaagcacgcctgccagctagatactctgacaactattactttactgtacaacataataaatacttaccttacccgtaacttacgtttcggaccgtaaggggaccaaaggtcgtaggaactaacgtaccgaaaacgttacgttaggtacggtcctaggtaccctaacccggtattcccgttagttcccttatacccg

SEQ ID NO: 96206 - DNA, 568 bp, Homo sapiens
  misc_feature: GYAE6OF02IYCC5.12.37.D04.1.454.CMB.1.raw
  modified_base (384)..(384): a, c, t, g, unknown or other
  misc_feature (384)..(384): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtccaccatcacttgccaggcgagtgaggacatttcggaaaatttttaaattggttttacagcaagaaaccagggaaacgcccctagactcctgattcacgaggcatccaattcggaaatacggggtcccaggtaagttcaggtggaggtggagcgtagggacaggtacttttacccncacctatcagcagcctgcagcctagaagatctagacaactataactttctagtacaactagtaataaataacttccttacccgtacttacgtttcggaccgtaacggggacctaagccgtaggagtaactaacgaaacgtaacgtggtcgacgtcgactaccgtatcgtcgttactccgtaccg

SEQ ID NO: 96207 - DNA, 754 bp, Homo sapiens
  misc_feature: GYAE6OF02ILC9Y.12.37.D04.1.454.CMB.1.raw
  modified_base (333)..(333): a, c, t, g, unknown or other
  misc_feature (333)..(333): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatccctcctgtctgcatctgtaggagacaaagtcaccatcacttcggccgggactaacggagagttattcgcctaagttaattttaaagttggtaatacaaaacaaaaagcaaggactaaaacgtaccccaaaagtcctacccgtagtaacttttagngtcctacgacccacctagttcctggaccgtaaggggttccggttacccgtacgtaaacggttcacggtcgggaccgtggtactcgaacgggactaaagttaactttaccgtctaccgaacctagttacaacggtttagtacctaaacgtacgtacccttaaggaaagtaattaagtttacgtactttaaccttttaatttacccgttagtaccgtaaggtaccgttaacggtaaacggtttaccccggaccgttaccctaccccgttaacgtaacccgtttaacccggttttacccggaaccgggttaaaccggggaacccacccgggtaacccggacgtaacgggtaaccgttaacggggaaccgttaacgttagggtacggtacgtaccggaccgtaaacccgttcgttaccgttaccg

SEQ ID NO: 96208 - DNA, 533 bp, Homo sapiens
  misc_feature: GYAE6OF02GLD03.12.37.D04.1.454.CMB.1.raw
  modified_base (384)..(384): a, c, t, g, unknown or other
  misc_feature (384)..(384): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaaatttttaagttggtttcagacaagaaaccgagggaaacgcccctagacctcctgattcacgaggcatcctaattcggaaagtacgggtccaggtaaggttcaggtggaggtggagtcgtgggacagtactttacccncaccatcagcagctgcagcctagaatatcttgacaatattatactgacaatataataatatactaccgtatacgtttcgaccgtacgggaccagctaggagactacgaaacgtactggtcgctacgacacctatcgtcgttcttactac

SEQ ID NO: 96209 - DNA, 740 bp, Homo sapiens
  misc_feature: GYAE6OF02I86UN.12.37.D04.1.454.CMB.1.raw
  modified_base (293)..(293): a, c, t, g, unknown or other
  misc_feature (293)..(293): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggcctcccaggtgccagatgtgacatccagatcgacccagtcctccatccctccctgtctgtcttctggtcggagacagacgtccaccatcacttcgccgaggcgagtgagactagttacggtaaatttttaagtgttacagacaagaaaccgagggaacnccctaagacctcgtagtacttacgacgacgacactaccgtaagttacggaaagtcgggtacccaaggtaacggttcaggtaggaggtgagcgtagggactacggttacctttacccacgtaacctagtaccgagtaccgtacgtaccgtgaccgtacggtaccgtaggtaaacgttacttccggttaacgaaccttaacgttaacttaacgtttaccgtacgttaacctaaacgtaagtttaaacttaaaccgttaaaccgttccccgttaacccgtttaacttacggttttacccggggaacccgggttaacgggtaaaccctaacgggttacgtaacgggtaacttaaccggtaaaccgtaaaaccggttaccggttaggtaccggtacccgttaggaccctaaccgtttaccgttccggtttacttacccgttaccttacccgg

SEQ ID NO: 96210 - DNA, 717 bp, Homo sapiens
  misc_feature: GYAE6OF02H7YUD.12.37.D04.1.454.CMB.1.raw
  modified_base (145)..(145): a, c, t, g, unknown or other
  misc_feature (145)..(145): n is a, c, g, or t
  modified_base (150)..(150): a, c, t, g, unknown or other
  misc_feature (150)..(150): n is a, c, g, or t
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (315)..(315): a, c, t, g, unknown or other
  misc_feature (315)..(315): n is a, c, g, or t
  modified_base (508)..(508): a, c, t, g, unknown or other
  misc_feature (508)..(508): n is a, c, g, or t
  modified_base (672)..(672): a, c, t, g, unknown or other
  misc_feature (672)..(672): n is a, c, g, or t
tcagatacgacgtacacgaccggtgctcgatttagtagcatactgttgggtttgggggcgaggagtcagtcccaacctggacacagcatggacatgagggtccctgctcagctcctggggctcctgctgctctggctcccaggtnccagntgtgacatccagatgacccagtctccatcctccctgtctgtctttcaggtcgganacaagcgtcaaccntcgacttcgcaggcgagtgaggactgttacggtaaatttttaaagttggttacagcgaagtaaaccgaagggtaaccgcccctaagacttaccgtntaattcgaacgaggacctaactaccgtaaagttaccggaaaagtcggggttacccccaaggtaaacggttcaagggtcggaaggttcgggactcggtacggggaactaggttaccttttacccgacaaccgtagttacgagaccctacggtcgttaccgagtacccggtacgtaaggaacgttatccggttanacgtaaacctagtttaaccgtttcgactactaaaccgtagtaaatttaacgacctttaaccgtccccgttaaagtttacgtttacggacccggtaacggggaacttaaacgtcggttaagggcctaaacgttccggaaaaacgtccctttggggacgttaaccncggtaacctaccggtatttaccgttggttaaccctccttaaccgg

SEQ ID NO: 96211 - DNA, 592 bp, Homo sapiens
  misc_feature: GYAE6OF02IFTGE.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctcctgtctgcttctgtcggagacagagtcaccatcacttgccaggcgagtgaggactagttacggtaaaattttttaagtggtttacagtacaagaaaccagggaaactcccctaagactcctgtacttcgacggagcactccaatttcggaaagtcggggtaccaaggaaggttcaggtggaggtggagcgtaggactagtacttttacccgacacctatcgagccagtcctgcacgctagagtatcgttacgactaatattacgttactgtacaactagtaattaactaacttactacccgtacttacgtttcggaccgtaagggaccaagtcgtaggataacgtacgaaacggttacgtaggtccggtactacgaccctacgtacttacgttacgttcgttccctaaccg

SEQ ID NO: 96212 - DNA, 574 bp, Homo sapiens
  misc_feature: GYAE6OF02HD20N.12.37.D04.1.454.CMB.1.raw
  modified_base (385)..(385): a, c, t, g, unknown or other
  misc_feature (385)..(385): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaaattggtttcagcaagaaaccagggaaacgcccctagactcctgacttcacgaggcatccaagttacggaaagtacggggtacccaagtaaggttcaggtggaggtggagcgtggggacagtactttacccnaccatcagcagcctgcagcctagaagtactcttagacaacattaatttactagtactaaactagtaataataacgtccttaccgtacttacgttttacggaccgtacgggtaaccaagtctagggacgtaactacgaaacgtacgttaggtagtcgtacggtaccacgtactcgttactcttactaccg

SEQ ID NO: 96213 - DNA, 555 bp, Homo sapiens
  misc_feature: GYAE6OF02H6IVV.12.37.D04.1.454.CMB.1.raw
  modified_base (282)..(282): a, c, t, g, unknown or other
  misc_feature (282)..(282): n is a, c, g, or t
  modified_base (380)..(380): a, c, t, g, unknown or other
  misc_feature (380)..(380): n is a, c, g, or t
  modified_base (408)..(408): a, c, t, g, unknown or other
  misc_feature (408)..(408): n is a, c, g, or t
  modified_base (428)..(428): a, c, t, g, unknown or other
  misc_feature (428)..(428): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggtaaatttttaaattggtttcagcaagaaaccagggaacnccctaagactcctgattcagacggcactccaaattcggaaatacggggtccaacgaaggttcaggtggaggtggagcgtgggacagtacttttacccnacctatacagcagctgcacgctagaagntcttgcaaactataattacngtacaacgataataataacttacctacccgtaactcgtttacggaccgaaggggacctaagcgtagagactaccgaaaagtactggtagtacctgacctaccgtaattcgttagttcctacgtaccc

SEQ ID NO: 96214 - DNA, 612 bp, Homo sapiens
  misc_feature: GYAE6OF02IHRBO.12.37.D04.1.454.CMB.1.raw
  modified_base (295)..(295): a, c, t, g, unknown or other
  misc_feature (295)..(295): n is a, c, g, or t
  modified_base (372)..(372): a, c, t, g, unknown or other
  misc_feature (372)..(372): n is a, c, g, or t
tcagatacgacgtacacgaccggtgctcgatttagtagcatactgttgggtttggggggcaggagtcagtcccaacctggacacagcatggacatgagggtccctgctcagctcctggggctcctgctgctctggctcccaggtgccagatgtgacatccagatgacccagtctccatccctccctgtctgtcttctgtcggagacagagtccaccatcacttcgccaggcgagtgaaggactagttacggtaaaattttttaattggtttacagacaagaaaccgagggaaacncccctaagactcctagtactcgacggaggcactccaagttacggaaagtcgggtaccaggtaacggttcgaggtggngggtggagcgtaggactagtactttccacaccatcagccacgtcctgcacgtcctagacgtatctgacctaactcttaattactagtactaacgtaataacttaaacttacttaccgttccttaacgttaccgtttacggaccgtaacgggactaaggcgtaggaccgtaacgtaacgtaaccgtaagtcgggtacgtcgtaaccgcctaacttaccgttcgtacgtttcctactacccg

SEQ ID NO: 96215 - DNA, 599 bp, Homo sapiens
  misc_feature: GYAE6OF02IKAKC.12.37.D04.1.454.CMB.1.raw
  modified_base (420)..(420): a, c, t, g, unknown or other
  misc_feature (420)..(420): n is a, c, g, or t
  modified_base (454)..(454): a, c, t, g, unknown or other
  misc_feature (454)..(454): n is a, c, g, or t
  modified_base (475)..(475): a, c, t, g, unknown or other
  misc_feature (475)..(475): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagacgtcaccatcacttcgccaggcgagtgaggactagttacggtaaaatttttaagttggtttacagcaagaaaccgagggaaacgccccctaagacctcctagtacttacgacggaggactactacctaaagttacgggaaaacgttaccggggtacccaacggtaacggttcgaaggtggagggtggagcggtgggaactagttactttacccncaaccatcgagcacgcctgacacgcctagaagtntctgacaactattacttactntacaatagtaataatactcctaccgtacttacgtttcgaccgtaacgggaccaagtgtaggataacgtaaccgaaacgtacgtggtacgtctacgacctacctagttcgttacttccttactcc

SEQ ID NO: 96216 - DNA, 562 bp, Homo sapiens
  misc_feature: GYAE6OF02HNXIS.12.37.D04.1.454.CMB.1.raw
  modified_base (206)..(206): a, c, t, g, unknown or other
  misc_feature (206)..(206): n is a, c, g, or t
  modified_base (286)..(286): a, c, t, g, unknown or other
  misc_feature (286)..(286): n is a, c, g, or t
  modified_base (412)..(412): a, c, t, g, unknown or other
  misc_feature (412)..(412): n is a, c, g, or t
  modified_base (433)..(433): a, c, t, g, unknown or other
  misc_feature (433)..(433): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagngtcaccatcacttgccaggcgagtgaggacattacggtaaattttttaaagttggtttcagcaagaaaccgagggaaacncccctagactcctgattcgacgaggcatccaattcggaaatgggtacccacggtaaggttcaggtggaggtggagcgtgggacagtacttttacccacaccatcagcagcctgcagcctagaagtntcgtgacaactattaattacngtaaccaatagtaattaaactattccctacccgtaattcctttcggaccgagggtaaccagtctaggacactacgaaacgacgttggacgtctacggacctaccgtacttcgttacgttcctactaccg

SEQ ID NO: 96217 - DNA, 674 bp, Homo sapiens
  misc_feature: GYAE6OF02JBNF9.12.37.D04.1.454.CMB.1.raw
  modified_base (157)..(157): a, c, t, g, unknown or other
  misc_feature (157)..(157): n is a, c, g, or t
  modified_base (236)..(236): a, c, t, g, unknown or other
  misc_feature (236)..(236): n is a, c, g, or t
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
tcagatacgacgtacacgaccggtgctcgatttagtagcatactgttgggtttgggggcgaggagtcagtcccgaaccctggacacagcatggacatgagggtccctgctctagctcctgggctcctgctgctcgtgctcccaggtcgccagattgngacagtccagatcgacccagtcctccactccgtcctgtctgtccttcgtagtcggagacagtaacgtcaccatcacttnccgagcgagtgagtactagtacgtaatttagtgttacancaacgaactaggaacncccgtagactccgtanacttcgagacggacaactacctaagtaccgaaagtaccgggtaccagtaacggtttcaggtacggacggtacggacgtggtacggactacgtacttttacccgacaaccgtacgtaccgtacacgtacgtcctagaccgtcggaccgtagtaaacgtcgttagtacaacgtaactaactacgttttaccgagttaacccttaagaacggttattaaacttaacgtccgttaacccgttagtaccgttttacggaccggttaaacgggacctaaggtcctaacgggtacgtaaacgtccgtaaaacgtaacccggttgaccggttctaccggactacccgtaattccgtacgttaccttcccgtaccg

SEQ ID NO: 96218 - DNA, 592 bp, Homo sapiens
  misc_feature: GYAE6OF02G9BDO.12.37.D04.1.454.CMB.1.raw
  modified_base (201)..(201): a, c, t, g, unknown or other
  misc_feature (201)..(201): n is a, c, g, or t
  modified_base (392)..(392): a, c, t, g, unknown or other
  misc_feature (392)..(392): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcgganacagagtcaccatcacttgccaggcgagtgaggacattacggtaaatttttaaagttggtttacagtacaagaaaccgagggaaacgcccctaagacctcctgacttcgacgagctactccaagttacggaaatcggggtacccaggtaaggttcaggtggaggtggagcgtagggacagtactttacccncaccatcgagcacgccgtgcgagtcctagaagtatcttagactaactattacttactgtacaactagtaataattaacgtaccttaccgtaaccttacgttttacggacccgtaagggtaccaagtcgtaggacgtaataccgtaaacgtaacgttggtacggtcgtacgactaccgtaacttcgtacgttactactacc

SEQ ID NO: 96219 - DNA, 865 bp, Homo sapiens
  misc_feature: GYAE6OF02IOG8W.12.37.D04.1.454.CMB.1.raw
  modified_base (164)..(164): a, c, t, g, unknown or other
  misc_feature (164)..(164): n is a, c, g, or t
tcagatacgacgtacacgaccggtgctcgatttagtagcatactgttgggtttgggggcgaggagtcagtcccaacctggacacagcatggacatgagggtccctgctcagctcctggggctcctgctgctctggctcccaggtcgccagatgtgacatccagntcgacccctagtcctccagtccctcccctgtccttcgctttcctggtaccgggataccagacgttccaccctatcctaccttgcccgtaggccgaagtcgaaggaacgatttacgggtaaaatttttaacgttagttttccgagactaagtaaaccgaaggggaaacccgtacccgtaaacgtacttaccctagtacgtttacacggaacggtacaactaacctaagttacggtaaaacgtaccggggtaccctaacggtaaacggtttactaacgggtgggttaacgggtacggggtacgtaccgggttagggacggtaacggttaaccggtttttacccaccggtacctaaggttacgacggtactgtaaccgtcgaacgtaccgtaacccggtgtaaacggtacttaccgtttacgggacctaacgtaaactttacggttaaaccttcggttaaacctaaacgtaacggttaactttaaaacgtttaacccgtaccgttaccccggtttaaacctttaccgggtttaaaccgtacccgggtaaaccgggtttaaccccggaaagtttaggttacccgggaaacggtttacgtaaacccgggtaaaccgttaaccggttaccggtaaccggttacgtaaccgggtacccctaaacggtcccgtttaacggtttcccgttaccggttaccttaccccggg

SEQ ID NO: 96220 - DNA, 848 bp, Homo sapiens
  misc_feature: GYAE6OF02GRJDQ.12.37.D04.1.454.CMB.1.raw
  modified_base (197)..(197): a, c, t, g, unknown or other
  misc_feature (197)..(197): n is a, c, g, or t
  modified_base (288)..(288): a, c, t, g, unknown or other
  misc_feature (288)..(288): n is a, c, g, or t
tcagatacgacgtacacgaccggtgctcgatttagtagcatactgttgggtttgggggcaggagtcagtcccaacctggacacagcataggacatgagggtccctgctcagctcctggggctcctgctgctctggctcccaggtgccagatgtgacatccagatgacccagtcctccatcctccctgtctgccttcngtcggagacagatcaccatcacttgccaggcgagtgaggactattacggtaaatttttaattggtttcagtacaagaaaccgagggaaacnccccgtaagaccttaccgtaggtaactttccgaacggtacgggtaccaacgttaccccgtaaaagttttaccggggaaaaacgtttacccgggggggtaaccccctaaacggggtaaaacgggttttacggaacggggttacggggtaacggggttacggggaacgggttaccggttacgggggtaaacctaacgggttaacttttttaaacccccgcctaaacccgtacgtttaccgaacggtacccgtaacggtcccgttacggtacccgtaacggacccgttaaggaaacggttactttacccggtttagaacccgtaaacgtatttaaacgtttaccgtacggttaaccaaaccgttaagttaaacgttaaacttaacgtttacccgttaaccccggtttaacgtttaaccgtttttacgggacccggttaaacgggggtaccctaaagggtccgtaagggtaccgtaacgttaaccggaaacgtaacgttacgggtacggtaccgtcgtaacccgtacccttacgttaccgttacggttacccttagttaacccg

SEQ ID NO: 96221 - DNA, 651 bp, Homo sapiens
  misc_feature: GYAE6OF02IZ8R3.12.37.D04.1.454.CMB.1.raw
  modified_base (124)..(124): a, c, t, g, unknown or other
  misc_feature (124)..(124): n is a, c, g, or t
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
tcagatacgacgtacacgaccggtgctcgatttagtagcatactgttgggtttgggggcgaggagtcagtcccaacctggacacagcatggacatgagggtccctgctcagctcctgggctccngctgctctggctcccaggtgccagatgtgacatccagatcgacccagtcctccgatcctccctgtctgcttctgtccgganacagacgtcaccatcacttgaccaggacgngtgacggactagttacggtaaattttaaagttggttactagacaagaaacccgaagggaaacgtccccgtaagtaccgtcctacgatttacgaacgtacggacgtactaccgtaatacgggtaaacgtacggggtaccctacggtaaagttccgagtacggtagggngaacggngtgggacaggtaacttttaccgactacccngttacncgtacgagcctgactagccgtagagtcttactgaacaacctattaactttactacgtaccaaacgtactaacgttaaactaagttccacccgtttattacttttaccgggaccaacggggttacaagtcctagggtacaacgtacggtaaactaaccgtcgttaggccgttagaccgtaacctcgtactttcgtccttacggtacc

SEQ ID NO: 96222 - DNA, 753 bp, Homo sapiens
  misc_feature: GYAE6OF02F9G8P.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggcctcccaggtgccagatgtgacatccagatgacccagtctccatccctcctgtctgcatctgtagcagacagagtccacatcacgttcggccgggacaagtccaagtacccatcagcagtactttaatttaaatcggtaatacgacgtaaccgaaggaaaacccggaaggggaaaacccgtcccccgttaaaggtccctaggtaacttaccgtaagtcggccttacggaccttacttaccgtaaggtttacgaaccggtaaacggggtccggggttaaccctagttaccggtaaaggttcgtaagggtcggtacgtaagggttcgggtacgtacggggaactacgtacgttttacccaccgttaccgtacctaaccgtactacgtacgcctaacgttccgtaacgaaccctaaaggttacgaagttaccttacgtacctaacgtttaaaccttagttaccgtaagtaacccgaaagtaacgtaaaccgttaccctaaacccgtttacccctaaccggtttacggttccggaaccgggtaaacgggtaaccgaaacggggttcgaaagttaaccgtaaccgtaaacggttaccgtgggttaccggaccgtagtaaccccg

SEQ ID NO: 96223 - DNA, 758 bp, Homo sapiens
  misc_feature: GYAE6OF02FMT1R.12.37.D04.1.454.CMB.1.raw
  modified_base (294)..(294): a, c, t, g, unknown or other
  misc_feature (294)..(294): n is a, c, g, or t
  modified_base (675)..(675): a, c, t, g, unknown or other
  misc_feature (675)..(675): n is a, c, g, or t
tcagatacgacgtacacgaccggtgctcgatttagtagcatactgttgggtttgggggcaggagtcagtcccaacctggacacagcatggacatgagggtccctgctcagctcctgggctcctgctgctctggctcccaggtgccagatgtgacatccagatgacccagtctccatcctcctgtctgcttctgtcggagacagagtcaccatcacttgccaggcgagtgaggactagttacggtaaatttttaaagttggttttacagactaacgaaaacccgaggggaaaacncccccgttaaggaccttcccgttaggtaactttccgaaccggtaggacctaacgttacccaaaagtttaccgggaaaaggttacgggggtacccccaagggtaaacggtttcgaaggttcgggaagggtgggaacggtccgtaggggtaacctaggtttaactttttacccccgactaacccgtattaccgaacgtaccgacgacccgttaggaccgaacggtcccgttaaggaaacgtcgttacgttagaccaacgttaatttaacgtttaaccttcgtaactaaacgtaagttaacttaaaacttacgtacccgtttacccgtaactttacgttttaccgggacccggtaaacgggaaccctaaggtctaacggggtanaaccgttaccgaaaacgggtaccttaggggtccgtaccgtacgaacctaccgttagttcctacggtttaccctagttaccccg

SEQ ID NO: 96224 - DNA, 720 bp, Homo sapiens
  misc_feature: GYAE6OF02I6ZOI.12.37.D04.1.454.CMB.1.raw
  modified_base (271)..(271): a, c, t, g, unknown or other
  misc_feature (271)..(271): n is a, c, g, or t
  modified_base (406)..(406): a, c, t, g, unknown or other
  misc_feature (406)..(406): n is a, c, g, or t
tcagatacgacgtacacgaccggtgctcgatttagtagcatactgttgggtttgggggcaggagtcagtcccaacctggacacagcatggacatgagggtccctgctcagctcctgggctcctgctgctctggctcccgaggtgccagatgtgacatccagatcgacccagtcctccatccctcctgtctgctttcgtggtacggagacagtacgtcaccattcacttgccaggcgagtgagacattacggttaaattttaagttggttanagtacaaggaaaccgagggaaacctacccaggtacttccgtagtacttccgaacgtacggccaactaccgtaaacgttaacggaaacgttaccgggtacccgaaggttaacggttacgaaggtagggtaacgggnggtacggtcggtacgggaactacgttaacgttttacccgacgtaacctatcccgaagtccgtacggacccgttgaaccgacgttaccaaggtaacgtacttacgttcaactaagtacttaacttacgtaacgtacaaacttagtaaacgtaacttaacgtacccttaaccgttaacgttaacccgtttacggaccggttaaccgggtaacaacgttacgaacggtagtaaccttaaaccggaaggttaaccgtggttacccgtcgtaacggtaacctaccgtagtttaccgtccgtttagttcccttaacccgg

SEQ ID NO: 96225 - DNA, 590 bp, Homo sapiens
  misc_feature: GYAE6OF02FLG08.12.37.D04.1.454.CMB.1.raw
  modified_base (284)..(284): a, c, t, g, unknown or other
  misc_feature (284)..(284): n is a, c, g, or t
  modified_base (388)..(388): a, c, t, g, unknown or other
  misc_feature (388)..(388): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctcctgtctgcttctgtcggagacagagtcaccatcacttgccaggcgagtgaggacattacggtaaattttttaaatggttttcagcaagaaaccaggggaaacncccctagacctcctagacttcgacgaggcatccaagttacggaaagttacggggtcccaacggaaggttcaggtggaggtggagcgtgggacagtactttaccnaccatcagcagcctgcagctgaagactcttagcaacattacttactgtactaacgtagtaataattaactaccttacccgttaacttacgttttcggaccgtaacggggtaacctaaggtcgtaggacgtacgtaaccgaaaacggtaacgttaggtacggtacgttcgaccaacctagttaccgttcgttccttactaccg

SEQ ID NO: 96226 - DNA, 694 bp, Homo sapiens
  misc_feature: GYAE6OF02FUWLY.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctcctgtctgcttctgtcggagacagagtcaccatcacttgccgaggcgaggtagacggactagttacggtaaaatttttaagttggtttacagtacaacgaaaccggagggaaaccgtccccctaagtacctcctgtacttaccgacggacggcagtacctaagttacggaaagttcggggtacccaggtaaggttacgaggtgggaggtagggacgtcggtagggactaggttaacctttaaccctcgaacctagtacctacggacacgtccctagccgacgtccgtagtacgtaacgttcgttacgaacctacttattacgttaactcgtaaccaaataacgttaactaaagtaccttaccggtttacccttaacgtttaccggtttacgggacccggttaaaccgggacttaacggtacgttaggtaagacgttaaccgaaacggttaacgtggttaaccgggctaccggactaacccgttagttaccgtttacgttactaccgtttacccg

SEQ ID NO: 96227 - DNA, 569 bp, Homo sapiens
  misc_feature: GYAE6OF02G9VZT.12.37.D04.1.454.CMB.1.raw
  modified_base (285)..(285): a, c, t, g, unknown or other
  misc_feature (285)..(285): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctcctgtctgcttctgtcggagacagagtcaccatcacttgccaggcgagtgaggactattacggtaaatttttaagttggtttacagcaagaaaccgagggaaacncccctagactcctgacttcgacggaggcatacctaagttacggaaagtacggggtacccaaggtaacggttcgaggtgggaggtggagcgtgggacagtactttacccnaccancagcagcctgcagctagaacatctagactaatattacttactgtacaactatactaatactcctaccgtacttacgtttcggaccgtaagggaccaagcgtaggatacgtaaccgaaacgtacgttggtcgtcgtacgaccgtactacgttcgtcgttacttacctaccg

SEQ ID NO: 96228 - DNA, 749 bp, Homo sapiens
  misc_feature: GYAE6OF02JJGU7.12.37.D04.1.454.CMB.1.raw
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
tcagatacgacgtacacgaccggtgctcgatttagtagcatactgttgggtttgggggcaggagtcagtcccaacctggacacagcatggacatgagggtccctgctcagctcctgggctcctgctggctctggctcccaggtgccagatgagacatccagatcgaccctagtctcccatccctcctgctncttcgngtcgagcagacgtcactatcactgaccaggtcagtagaggactagtacgttaaattttaagtgttacatacgacgaaaccgaggaaaccgtaccctagacctccgtagacttcgacggagaccaacgtactaacgttaacggaaacgtacgggtacccaaggtaggtcaggtgggacgtggacgtcgtaagggactacggtaacgttttaccccacgtaccgtacgtacgtaacggacccgtaggtaccctacggtaaccgaccggttacccccgtaacggggaaattccggtaccgtttacggaaacctaaccggttaaacttaccgttaaccgttacggttaaacctaaacccgtaaaggtttaacttaaacggacccttttaaccgtaccccgtttaaagtttaccgtttaccgggacccgggttaaacggggaaccctaaaccgtcgttaacgggaacgttaaccttaccggaaaaccgtaaggttccggtaacggttaaccgacggtaactacccgacgtttacggtcttaccgttcgtaaaccccg

SEQ ID NO: 96229 - DNA, 303 bp, Homo sapiens
  misc_feature: GYAE6OF02GJESR.12.37.D04.1.454.CMB.1.raw
  modified_base (178)..(178): a, c, t, g, unknown or other
  misc_feature (178)..(178): n is a, c, g, or t
  modified_base (295)..(303): a, c, t, g, unknown or other
  misc_feature (295)..(303): n is a, c, g, or t
tcagatacgacgtacacgaccggtgctcgatttagtagcatactgttgggtttgggagaaggggtcccctcaagatttcatggcgacttttctgggacaaatttcaccctctccatcagcggtctggaacccgatgactttggaaagtattactgccatcagactcactattttcccnccgacgttcggccaagggaccatagtggctctcaggcgaactgtggctgcaccatctgtacttcatcttcccgcatctgactacgtcgtatctgagcgggctggcaaggcgcatagnnnnnnnnn

SEQ ID NO: 96230 - DNA, 787 bp, Homo sapiens
  misc_feature: GYAE6OF02FW4VK.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtcctccatcctccctgtctgctttctggtcggagacagagtccaccatcacttgccaggcgagtgaggactagttacggtaaattttttaaagttggtttacagtacgaagaaaccgaggggaaacgcccccgtaagacttaccgtgtaacttcgacggaggctaactaccgtaaagttacgggaaaagtttacgggggaccctaacggggtaaacggtttccaagggttaggacgggttggaacgtccggtaggggaactaggttaacctttttaacccgtacgtaacccgtataccgaacgtccgaacggtcccttagccctagtaccgtaaggaacgtacgttcttacgaacctaacgtaattaactttaccgttagtaaacctaaacgtaagttaaaccttaaagttaaccgttacccgttaacccggtttaaacctttaaccggttttttacgggaacccgggtaaaccgggggttaaacccctaaagggtccgtttaaggggaacgtaaccgtttaaaccggtaaaacggttaccgttaacgggtacggtaccgtacggtacccgtaacccttagtttacccgttacggtttttccctaaccggtttaccc

SEQ ID NO: 96231 - DNA, 923 bp, Homo sapiens
  misc_feature: GYAE6OF02JLJBY.12.37.D04.1.454.CMB.1.raw
tcagatacgacgtacacgaccggtgctcgatttagtagcatactgttgggtttgggggcgaggagtcagtcccaacctggacacagcatggacatgaggtccctgctcagctcctgggctcctgctgctctggctcccaggtgccagatgtgacactccagtatcgacccagtctccatcctccctgtctgcttctgtacggagacagagtccacctatcctacttcgcccgaggtcgaaggtgtaacggacctacgtttaaccgggttaaaaatttttttaaacgtttcgggttttacctaacggtaccgtaaaacggtaaaaaccccggtaaacgggggtaaaacccgtccccccgttaaacggttaaccccgttcccgttaagtaaccgtttacccgaacccgggtaaggtccccgtaaacgttacccctaaaaggttttaaccccgggaaaaaggtttacccggggggttaacccccaaaacggggttaacggtttaaccggtaaggggttaacgggtaggggtacgggtaacggtaccggttaggggtaaacgtaacgttttaaccgtttttaacccccggaccgtaacccgactttaccgaaaccgggttcgaccgtaccgtacggacctacgggacccctttaagggaacgttacgtacttacggaccgtaaacttacgttaactttaaccgttacgtaacccgtaataacggtaactttaaagttaccgttacccgttaccgttaaacccgtttacgttttaccgggaacccgttaaccggggtaacccttaagggtaccgttagggtaaccgttaacgtaacccgtaaacggttaacggttaccggtacgggttaccacccggttacctaaccgtacgtttacccgttacggttacctttcccggttaacccgg

SEQ ID NO: 96232 - DNA, 773 bp, Homo sapiens
  misc_feature: GYAE6OF02FFTBL.12.37.D04.1.454.CMB.1.raw
  modified_base (143)..(143): a, c, t, g, unknown or other
  misc_feature (143)..(143): n is a, c, g, or t
  modified_base (175)..(175): a, c, t, g, unknown or other
  misc_feature (175)..(175): n is a, c, g, or t
  modified_base (193)..(193): a, c, t, g, unknown or other
  misc_feature (193)..(193): n is a, c, g, or t
tcagatacgacgtacacgaccggtgctcgattagtagcatactgttgggtttgggggcaggagtcagtcccaacctggacacagcatggacatgagggtccctgctcagctcctgggcctcctgctgctctggctcccaggtnccagatgtgactatccagatgaccctagtccnccactcccgtcctgttcncgtcttcgtggcggacgacaggtacgtccacctagtcctactcgccgtaggccgtaggtagaacggtaacctagttacggtaaaatttttaagttggttacagtacaacggaaaccgagggtaactccccgtaatcctacgtataccgttacgacgaggaccattacccgtaagtaccgggtaaggtccggggtaccctaaggtaacggttcctagggtagggtacggtacggaggtacggttacgggaactacggttaccttttaccccgacgtaacctaacttcgaacgtcctagtccctacgggaccttagggaccccgtaaggaacgttatttaccgtagaaccgaaacctttagttaaacgttccgttagttaacccaaacggtttaataaccggttaaaaacttcccgtacccgtttaaccctacgtttttaccggttaccggggaccgttaaccgggaaccgtgtaccgttaaggacttaaccggaccgttaaaacggtcgttacgggtaccgttacgtaaccgacgttaaccgtaccccggtttatccgggttaaccctatttaaccccggg

SEQ ID NO: 96233 - DNA, 592 bp, Homo sapiens
  misc_feature: GYAE6OF02F2983.12.37.D04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (396)..(396): a, c, t, g, unknown or other
  misc_feature (396)..(396): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctcctgtctgcttctgtcgganacagagtcaccatcacttgccaggcgagtgaggactagttacggtaaattttttaagttggtttacagtacaagaaaccgagggaaacncccctaagactcctgattcacgagcactaccaagttacggaaagttcggggtaccccaaggtaacggttcgaggtggaggtggagcgtgggactagtactttacccnacctatcgagcagcctgcagccgtagaacgtctcgttagaccaatattaacttactagtacaactagtaataactactaccttacccgtaacttacgtttcggaccgaacgggtaccaaggtcgtaggtagtactaacgtaaaccggtagttcggtacggtactacgaccaccgtattccgtacgttcctataccg

SEQ ID NO: 96234 - DNA, 611 bp, Homo sapiens
  misc_feature: GYAE6OF02H4UXG.12.37.D04.1.454.CMB.1.raw
  modified_base (286)..(286): a, c, t, g, unknown or other
  misc_feature (286)..(286): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacagttacggtaaatttttaaagttggtttcagacaagaaaccgagggaacncccctagactcctagattccgacgaggcatccaattacggaaagtacgggtccaacgtaaggttcaggtcggaggtggagtcgtagggaactaggttaaccttttacccgacaccgtattacacgaccaacggtcctaggccacgtaccgtaggaaacgtcttaccgttagacctaaacgtattactttacgcgtacaaactagttaaactaacttaagtaccctaccgttaacttacgtttacggaccgtaaggggaaccaggtctaggacgtactacggaaactacgtggtacgactacgaccactattcctgttccataccc

SEQ ID NO: 96235 - DNA, 792 bp, Homo sapiens
  misc_feature: GYAE6OF02FV8L6.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggcctctgctgctctggcctcccgaggtcgccagatggtgacactccagatcgacccagtcctccactccctccctgtctgtcttctggtcggagacagacgtccaccatcactcgccgaggcgaggtggacggactagttaacggttaaaatttttaagttcggttacagtacgaaacgtaaaccgaacgggaaaccgtccccgtaagtacccttacgtacgtacttaccgaaccggtaggcctaacgtaaccgtaaaggtttaaccgggtaaaacggttacccgggggtacccctaaacggggttaaacggttaccgaagggggttagggtaacggggtacggggacggtacgggtacggggtaactaacggtttaccttttaaccccgactaacccgtaactaccgaaacgacgtccgtacgaccgacggtccgtaaggtaaactacgttacgttacgaactaaacgtatttaacttacgtacgtaactaacgtaagttaaacttaaacctaacgttcccgtaaccgttaactttaccgggtttaccggaccgggtaacgggtaaccctaagggtccgtaagggtaccgtaacgtaacggaaaccgttaggtcggtacgtccgtaacgactaaccgtagttccgttacgttccgttacttacccgttccccg

SEQ ID NO: 96236 - DNA, 638 bp, Homo sapiens
  misc_feature: GYAE6OF02FHS86.12.37.D04.1.454.CMB.1.raw
  modified_base (181)..(181): a, c, t, g, unknown or other
  misc_feature (181)..(181): n is a, c, g, or t
  modified_base (244)..(244): a, c, t, g, unknown or other
  misc_feature (244)..(244): n is a, c, g, or t
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
  modified_base (336)..(336): a, c, t, g, unknown or other
  misc_feature (336)..(336): n is a, c, g, or t
tcagatacgacgtacacgaccggtgctcgatttagtagcatactgttgggtttgggggcaggagtcagtcccaacctggacacagcatggacatgaggtcctgctcagctcctgggctcctgctgctctggctcccaggtgccagatgtgacatccagttgacccagtctccatccttccngttctgcatctataggagacaggagtcaccatcacttgccgggcagtcaggcattagcaattntttaggctggtatcagcagacgcagggaacncccctaacgctagatctatggtncatcactttgcataggtgggtcccatccaaaggttcgngtcggacagtggtatcggtgggacagaacgttctatctcactaataccaccacgacctagaacgtccgtaaggaagttacgttttacgaccgttaaactttaacgtttaacctttacggtaccgtaaacgttaacggtttttaacttacgttttttaccccttacgttttacgttttaccccgggttacccgtacgggggttaccctaacgtaccgggttaactaacgttaacgttaacccgtaaaccggttaaccgttacggtaccggttaccgtacggaccccgttacctacgttacccg

SEQ ID NO: 96237 - DNA, 671 bp, Homo sapiens
  misc_feature: GYAE6OF02GRNX4.12.37.D04.1.454.CMB.1.raw
  modified_base (481)..(481): a, c, t, g, unknown or other
  misc_feature (481)..(481): n is a, c, g, or t
  modified_base (505)..(505): a, c, t, g, unknown or other
  misc_feature (505)..(505): n is a, c, g, or t
  modified_base (514)..(514): a, c, t, g, unknown or other
  misc_feature (514)..(514): n is a, c, g, or t
  modified_base (535)..(535): a, c, t, g, unknown or other
  misc_feature (535)..(535): n is a, c, g, or t
tcagatacgacgtacacgaccggtgctcgatttagtagcatactgttgggtttgggggcaggagtcagtcccaacctggacacagcatggacatgagggtccctgctcagctcctgggctcctgctgctctggctcccaggtcgccagatgtgacatccagatcgacccagtcctccacttccctcccgtgtctgtctttcgtaggtccggagacaggatccaccatctacttcgaccaggcgtaggtagacggtactaagtttaacggttaaaatttttaagttggttacacgtacaaacgtaaacgaacgggaaacctcccctaaggtacctacctagtactcgacgaggcctaactaccgaagttaccggaaacggtacgggtacccaaggtaacggttgagggtagggtaggtacggacggacggtacgggtaactacggttaacctttcccgaccgtacctatacgacgacgtacnccgtagactacgtacgtacgaatnttacgttanaactactattactacgtacanaacgtaataataacgtactacccgttacgttacttacggttacgaaccggtaggtaaccctaaaggcgtaagacggtaactaaccgaacggttactcggtaccgtcgtaccactctatccgttagtcctactaccg

SEQ ID NO: 96238 - DNA, 630 bp, Homo sapiens
  misc_feature: GYAE6OF02IVX5G.12.37.D04.1.454.CMB.1.raw
  modified_base (220)..(220): a, c, t, g, unknown or other
  misc_feature (220)..(220): n is a, c, g, or t
  modified_base (284)..(284): a, c, t, g, unknown or other
  misc_feature (284)..(284): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatcgacccagtctccatcctcctgtctgcttctgtcggagacagagtcaccatcacttnccaggcagtgaggactagttacggtaaatttttaagtggtttacagcaagaaaccgagggaacncccctagacctccgtgacttcacgagctatccaattcggaaatcgggtaccagtaaggttccaggtaggaggtggacgcgtagggactagtactttacccgcaccatccacgcgacgtaccgtacgacgtacgccgtagtaactacgttaccgttacgacctaaacgtacttaacgttaccgttacgtacctaaacgtagttaaacgttaactaacgttacccttacccgtacttaccgttttaccggaccgttaacgggacccaagtcgtacggtacgtaactaccgaaacgtacgttgtacggtcctagtacccgactacgttcctacgttacctacttacccg

SEQ ID NO: 96239 - DNA, 677 bp, Homo sapiens
  misc_feature: GYAE6OF02JFZ6V.12.37.D04.1.454.CMB.1.raw
  modified_base (152)..(152): a, c, t, g, unknown or other
  misc_feature (152)..(152): n is a, c, g, or t
  modified_base (208)..(208): a, c, t, g, unknown or other
  misc_feature (208)..(208): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgngacactccagatgacccagtccaccatcctcccgtgtctgcttcgtcgtacggganacagtacgtcaccatcacttgccaggcgagtgaggactagttacgtaaattttaaagtgttcagtacaagaaaccgaggtaaccgaccctaagtacctaccgtagtacttaccgacgacggctacgtaccgtaacgttaaccggaaaaggttacgggggtacccctaaaggtaacggtttaccgaaggttagggtaacggggtaggtaggtaccggtaggggaacgtaacggtaaccttttacccgtacaacccacttacgacgtacacgtactacgtccagcccgttaaggaactacttccgtataaccgaacctaagttaacttactacgtacaacgtataagtaacttactacctaccgtacgttacgtttcggaccgacgggaaccaagcgtagacgtataaccgtaaagtacctgggtacgtcgtacgaccgtacctaacgttcgtaccgttaccttctacccg

SEQ ID NO: 96240 - DNA, 623 bp, Homo sapiens
  misc_feature: GYAE6OF02FVL6N.12.37.D04.1.454.CMB.1.raw
  modified_base (290)..(290): a, c, t, g, unknown or other
  misc_feature (290)..(290): n is a, c, g, or t
  modified_base (314)..(314): a, c, t, g, unknown or other
  misc_feature (314)..(314): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatccctcctgtcctgcttctggtcggagacagacgtcaccatccacttcgccaggcgagtgagactattacggtaaatttttaagttggtttcagtcaagaaaccgagggaaacncccctagactccgtgtattcacgnggcactaccgaagttacggaaagtacgggtccaaggtacgttcgagtggaggtgagcgtgggactagtactttaccnacntcagcacgctgcagctagaatactcgtacgactaactacttacttacgtacgtaaccgtaactaaggttaacttaaacttaaccgttaccgttacccgttaacgtttaccggttttacgggaccggttaacgggaacctaacggtccgtaagggtacgaacgttaaccgaaacggttactacgggtaggtcctacgaccgtactccgttcttacgttcctcgtaacccg

SEQ ID NO: 96241 - DNA, 724 bp, Homo sapiens
  misc_feature: GYAE6OF02H4E7O.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctccgtggggctcctgctgctctggcctcccgaggtgccagatgtgacatccagatcgacccagtcctccactcctccctgtctgtcttctgtcggagacagacgtccaccatcacttcgccaggcgagtgaggacagtttacggtaaatttttaaagttggtttacagcaagaaaccgagggaactcccctaagacctaccgtgtacttaccgacgtaggactactaccgtaacgtttacggaaagtacggggttacccaacggtaacggttactaggtgggacggtggaggtcgtacgggacacggtttaactttacccgacaacctaagttccgacgtaccgacgtacctaccgtacgaacggtcccgtaggtaaacgtacgtttacgttacggaaccttaaacctaatttacgtttacgttagttaacctaaacgtaagttaaacttaaacttaacgttacccgttaacccgttaacttaccggttttacggaacccggtaacggggaaaccctaaggtccgttaaggacgtaacgtaacggtaaaccgtaacggttcggtaacgtccgacgtacctaccggtattccgttcgttaccttaccgttaccg

SEQ ID NO: 96242 - DNA, 709 bp, Homo sapiens
  misc_feature: GYAE6OF02HYVEA.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctgggctcctgctgctctggctcccgaggtgccagatgtgactactccagatcgaccccagtctccacttccctccctgtcctgtccttcgtgtccggagacagcgtaccaccatccacttcgccgaggcgagtgagtactagttacggttaaatttttaagttgttcgagacaaagaaaccgaaggaaccgtacccgtacgacctcctagtactcgacgcggactactacctaagttacggaaacggtacgggtacccgaacggtaacgtacgtaggtaggtaggtaggtcgacgtgggaactacgttaccttttaccactaactctacgagacgtacgccgtcgacacgtacgtagaagtcgtacgtacaccgtaaactacgttaacttactacgttaaaccaacgttaactaaacttaaacgttaccttaccccgttacccgtttaacctttaccggtttaccgggacccggtaaccgggtaaccgttaacgacggttaacgtacgtaaaccgtaaccgtaaacgtacggttacgggtaacggttacgtacgtaccgacccgttcttaccgtacctttccgttacctaacccg

SEQ ID NO: 96243 - DNA, 762 bp, Homo sapiens
  misc_feature: GYAE6OF02IZTMV.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggcctcccaggtgccagatgtgacatccagatcgacccagtctccactccctcctgtctcgcttcgtgtcggagacagactccaccatcacttcgccgaggcgagtggaggactagttacggtaaaatttttaaattggttcagacaagaaaccgagggaaacgcccctaagtacctaccgtagtacttccgaacggacggacacgtacctaagttaccggaaacggtacggggtacccaacggtaaggttacgaggtggacggtagggacgcggtagggacgtagtaccttttacccactacactcgacgcacgcctgaccagtccctaggaagtactcgttcgaaccgtaaacttaagttactttacgtactaacctaaactaacgtttaaacttaaacttaacccgtttaccttaacccccggtttaaacttaacccggtttttaccggggaaccccggtaaccgggggtaaaccctaaacgggttaccgtaagggttaaccgtaacgttaacccggtaaaaacccggttaccggttaacggggttaccggtacccgttaaccggtaaccccttaaccgtaaccgtttcccgtttaaccggtttaccctttacccggttaacccccg

SEQ ID NO: 96244 - DNA, 837 bp, Homo sapiens
  misc_feature: GYAE6OF02I3NPD.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctccgtggggctccgtgctgctctggcctcccgaggtcgccagtatgtcgacatccgagatcggacccagtcctccactccctccgttgtctcgtcttcgtcggtcggaacgacaggacgtcctacctagttcctaactcgaccgagggcgtaaggtggaacgtacttaaggtttaacggtttaaaatttttaacggttcggtttaacacggtaacgaaaacggaaacccggtaacggggtaaaccgtcccctaaggtaccgttccccgttaagtaccgttacggaaacccgggtcgttaacctaacgttaaccccggttaaaggttaaccggggttaaaaaccgttcccggggggtaaacccctaaagggtttaaacgggtacgtacggggttaacggggtaagggtaggggttaaccgtcgggttacgggggtaaactttaacggttaccctttaccggaaccctaacgtacgtacgtacgacgtacgtcgtacgacgtacgtacgagtaactcgtctagacaacgttacgttacgtactacggtaacctaagtacttaaacgtaaacttaaccgtttcccgaacccggtttaacgttccgtttaaccgggaaccgggtacggtaaaccgtaacggtcggtaacgtagtaacgtaaacccgtaaggttaaccgtcgtaggaccttacggaacctcgttacgtcgttaccgttacttaccgtaccg

SEQ ID NO: 96245 - DNA, 779 bp, Homo sapiens
  misc_feature: GYAE6OF02GF79H.12.37.D04.1.454.CMB.1.raw
tcagatacgacgtacacgaccggtgctcgatttagtagcatactgttgggtttgggggcaggagtcagtcccaacctggacacagcatggacatgagggtccctgctcagctcctggggctcctgctgctctggcctcccaggtgccagatggtgacatccagatgacccagtctccactcctcctgtctgtcttcgtgtcggagacaggacgtcaccatcacgttcgccgaggcgtagtggacggtactagtttacggtaaaatttttaagttcggtttacacgtacgaagtaaacccgagggtaaaaccgtccccctaaggtacctccgttaggatttaccggaaccggtaaggcctaacttaccgtaaacgtttacgggaaaacggttaccggggtacccaacgggtaaacggttcgaacgggtggacgggtagggacgtcggtacgggtaacgtaggttaaccttttacccgtaccgaaacctagttacgaacgacgtaccggtcccgtagaccgtacgtacccgttaaggaaacgtaacctttcgttaacggaaccctaaacgttaacgttaactttaaccggttacgtaacctaaaacggtagttaaacttaaacttaaaccgttacccgttaacccggttaactttacgttttacgggaacccgtaaacggggttaccctaacggttaccgtaggaacgaacgttaacgaaaaccggttaacgtcggtaccggtacacgaccgttaccaagtttcacggtttcttacgtacc

SEQ ID NO: 96246 - DNA, 658 bp, Homo sapiens
  misc_feature: GYAE6OF02JIKWS.12.37.D04.1.454.CMB.1.raw
  modified_base (320)..(320): a, c, t, g, unknown or other
  misc_feature (320)..(320): n is a, c, g, or t
  modified_base (496)..(496): a, c, t, g, unknown or other
  misc_feature (496)..(496): n is a, c, g, or t
  modified_base (582)..(582): a, c, t, g, unknown or other
  misc_feature (582)..(582): n is a, c, g, or t
tcagatacgacgtacacgaccggtgctcgatttagtagcatactgttgggtttgggggcaggagtcagtcccaacctggacacagcatggacatgagggtccctgctcagctccgtgggctcctgctgctctggcctcccaggtgccagatgtgacatccagatcgaccctagtcctccactccctccctgtctgtcttcgtgtcgagacagacgtccaccatcacgttcgccgaggcgagtgagactagttacgtaaattttagtcgttacagacgtaagaaacgaggaacgccctaagactacgtagtaactaacggngacctacgtaccaaggttaacggaaacgttacgggtaccgaacggtaacggttaccgaaggtacggggtacggtgggtaacggacggtacggtaacgtacgttaacttttacccgacgaacgttacgcgaacgcgtacgacctcgaacgtacgtccgtaaggacttacgtcgttanacccgtaatacgttaattcgtagtacaacgttaacgtataaccgtactccgttaaccgtacgtttcgttacgacgtaacggtaacngtacggtagaacgtactaacgaaccgttgcgtaaggccttacgctaccgtatccgtagtcctagttaccctacccg

SEQ ID NO: 96247 - DNA, 826 bp, Homo sapiens
  misc_feature: GYAE6OF02HWRFP.12.37.D04.1.454.CMB.1.raw
  modified_base (155)..(155): a, c, t, g, unknown or other
  misc_feature (155)..(155): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctccaggtgccagatgtgacntaccagatcgacccatctccactccctcctagtctgtcttctcggtacggacgaactagacgttaccaacctattctaacttcgaccgtagggaccggagtaggacggaacttaacgttttaacgggtttaaaaattttttaaaacgtttcgggtttccgaaggaccgtaaaacggaaaaaccggaaacgggggtaaaaccctcccccgttaaacggtaaccgttaccccgttaaggttaacgttccgaacgggtaaccggctaacgttaaccccgttaaaagttaccggggtaaaaacggttacccgggttaacccgaaacggggttaaacggtttacggaacggggttacggggtaaggtcggggaacttccgggtacggggaacttaacgttaaccggtttttaaacccccacggtaactaacccggttcgaaacgtcccgaaacgtcggtcgtaaccgtaccggtaccgtaaagtacgttaacgtacgttacgaacctaaactaattacgtttacgttaacgttaacttaaaacgatttaaactaaattaacccgttaccgtcccgttaaacttaccggtttacggaaccgtaacgggacaacgttgtaggactaacaacgtaacgacgtaggtactcgagtcacctatcgttagtccttacgtacc

SEQ ID NO: 96248 - DNA, 726 bp, Homo sapiens
  misc_feature: GYAE6OF02F0S2A.12.37.D04.1.454.CMB.1.raw
  modified_base (144)..(144): a, c, t, g, unknown or other
  misc_feature (144)..(144): n is a, c, g, or t
  modified_base (155)..(155): a, c, t, g, unknown or other
  misc_feature (155)..(155): n is a, c, g, or t
  modified_base (688)..(688): a, c, t, g, unknown or other
  misc_feature (688)..(688): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtnccagatgtganatccagatcgaccctagtcctaccactccctccctgtctcgtctttcgtgtcggagacaggtactaccgaccatcctacttcgaccgaggcgagttagaggacttagttacggttaaaatttttaagttcggtttacacgtacgaacggaaaccgaaggggaaaccgtccccttaaggtaccttaccgtaggacttacgacggtaggtactactacgtaacgttacgggaaacgttaccggggtaccctaagggtaacgttcgaggttaggagggtacggagtcggtacgggaactacgtttaactttaccccgacacctacgtcgacgtaccgacgtccgtagaccgtacgtacggtaaggtaaagtactttacgttgaaaccctaagttaacttaaccgtttactaacgtacgaaacttagttaaacttaaacgtaaccttccggttaaccttaccgttaccgtttggaacccgggtaacgacgtagtacgtagaccgttaactaacggaaacggttatcgggtagtaccngtacctaccgttcgttagttacccttactcttaccccg

SEQ ID NO: 96249 - DNA, 703 bp, Homo sapiens
  misc_feature: GYAE6OF02FOI4N.12.37.D04.1.454.CMB.1.raw
  modified_base (415)..(415): a, c, t, g, unknown or other
  misc_feature (415)..(415): n is a, c, g, or t
tcagatacgacgtacacgaccggtgctcgatttagtagcatactgttgggtttgggggcaggagtcagtcccaacctggacacagcatggacatgagggtccctgctcagctcctggggcctcctgctgctctggcctcccaggtcgccgaagatggtgacactccagatcgacccagtcctccactcctcccgtgtctcgtctttcgtcggtcggaagacgaggtacgtccacctatcctacgttcgaccagggtcgaggtagagtaactagttaacggttaaaatttttaagttcggttacaacgacaaggtaaaccggaagggtaaccgtcccctaagaccttccgtagtacttacgacggacggactactactaacgtacggtaacggtacgggtacccaggtaagttcgnggttaggaggtcgagtcggtacggacttacgttacttacccagacctatcgtacacgtacgcctacgacgtaccgtcgtaacgtaatcgttacctagaacctaaactcgttaaactacgttaacaacaataacggttaaattaacgttaacttacccgttccgtaaatttacccggttacgggaacccggtaaacggaaaccctagggtcgtaaggtacaacgtaaccgtaaaggcggttgtaccggtacctacgtactacgtaccttccgtttatcctgtttacccg

SEQ ID NO: 96250 - DNA, 693 bp, Homo sapiens
  misc_feature: GYAE6OF02I1H5G.12.37.D04.1.454.CMB.1.raw
  modified_base (237)..(237): a, c, t, g, unknown or other
  misc_feature (237)..(237): n is a, c, g, or t
  modified_base (295)..(295): a, c, t, g, unknown or other
  misc_feature (295)..(295): n is a, c, g, or t
  modified_base (325)..(325): a, c, t, g, unknown or other
  misc_feature (325)..(325): n is a, c, g, or t
tcagatacgacgtacacgaccggtgctcgatttagtagcatactgttgggtttgggggcaggagtcagtcccaacctggacacagcatggacatgagggtccctgctcagctcctgggctcctgctgctctggctcccaggtgccagatgtgacatccagatgacccagtctctactcctccctgtctcgtcttcgtggtcggagacgagagtacacctatctacgttcgcaggcgngtgagactagttacggttaaatttttaagtggtttcagcaagtaaaccgagggaaccnccccgtagtacctaccgtgacttcgacggngactactaccgaattacggaaagtcgggtaccacgtaaggttcgaggtggaggtaggacgtacggtaggactacgtacctttaccccagtaccctagtacacgaccgtacgtcccgtagactaccggtaccgtaaggaacttacgttacttaacggtaacctaaacggttaatttaacgttaaccgttaccttaacgtaaacgttaattaaacgttaaaacttaccttaacccgttacccgttaactttaccgggttttcgggaacccgtaacgggggaccctaaggtcgtaacggtagttaactaaccggtaaacgtacgttacggtcgtactacgactactaccgtcttacgttacttactacccg

SEQ ID NO: 96251 - DNA, 714 bp, Homo sapiens
  misc_feature: GYAE6OF02IKARS.12.37.D04.1.454.CMB.1.raw
  modified_base (436)..(436): a, c, t, g, unknown or other
  misc_feature (436)..(436): n is a, c, g, or t
tcagatacgacgtacacgaccggtgctcgatttagtagcatactgttgggtttgggggcaggagtcagtcccaacctggacacagcatggacatgacgggtccctgctcagctcctggggctcctgctgctctggctcccaggtgccagatgtgacatccagatcgacccagtcctccatccctccctgtctgtccttctggtcggacacagagtcccaacctatcctacttcgccgaggcgagtggacggtactagtttacggtaaaatttttagtcggttcagtacaaacggaaaccgagggaaacctcccctagtaaccttccgtgtacttaccgacgagtacataccaagttacggaaacttcgggtacccaaggtacggttcgaggttggaggtcggagcgtacgggaacttacggttacttttaaccccngtaaccagtaccacggcctacgtccgtcgaccaaggtcctaaggtaacgtacgttacgttacgaacctaacgtaactttaactttacctacggttaaacctaattaacgttaaacttaaagtacccgttaccgttaccccgttaaagtttaccggtttaaccggaaccgggtaacgggtacctaacgggtccgtaaggacgtaaccgtaaccgaaaacgttcggtcggtaccgacgttaccgaccgtaccttacgcggtttacctcgttacctacccg

SEQ ID NO: 96252 - DNA, 755 bp, Homo sapiens
  misc_feature: GYAE6OF02JGKFA.12.37.D04.1.454.CMB.1.raw
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (279)..(279): a, c, t, g, unknown or other
  misc_feature (279)..(279): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctgctccaggtcgccagatgtgacatccgagtatcgacctagtcctccactcctcctgtctgtcttcgtgtcgganacngacgcactatcacgttcgaccgaggacggagtaggaagtactagttaacgttaatttttaagtcggttanacgacgtaacgaaacggtaacgggaacctcccctaaggtacccttcgtaatacgttaccgaaggacgtactaaccttaaccggtaagtaaaccggggtaaacggttacccgggtaccctaaaggggttaacgttgggtaacggtagggtaacgggtaggtacgggacggttaacggtaacgtaacggtttcgtttaacccaaccggttactaccgtagaaccgtaccgaacgtcccgtaggttaaccacggtacgttaaacgtacgttacgtacgtaccgtaaactaacggtttaatacttaccgtagtaccaagttaaactaattaagttcctacccgtttaaccgtagttaacccggttaccggagttaaaccgggtacacgtacgttacgaacgttaactaacgaacggtttcggtacggtactccgttaacgaccgttactccggtttacttacccgttagtttaccacccg

SEQ ID NO: 96253 - DNA, 684 bp, Homo sapiens
  misc_feature: GYAE6OF02HKTHP.12.37.D04.1.454.CMB.1.raw
  modified_base (317)..(317): a, c, t, g, unknown or other
  misc_feature (317)..(317): n is a, c, g, or t
tcagatacgacgtacacgaccggtgctcgatttagtagcatactgttgggtttgggggcaggagtcagtcccaacctggacacagcatggacatgaggtccctgctcagctcctgggctcctgctgctctggcctcccgaggtcgccagattcgtagacatccagatcgaacccagttcctccatccctccctgtctgtccttcgtggtacggacgacacgtacgtaccaaccatacctacttcgaccgaggacgagtgaacgtactagttacggttaaaatttttaagtcggttacagacaacgaaacgaggaacncccgtaagacctacgtagtactacgacgacgactacgtaccaagttacggaaagttacggggtacccaaggtagttcgaggtcggaaggtggagtcgtaagggtactagttaacctttacccacaaccagtacgacgtaccgacgtcgtacgcgtacgaccgtaggtaacgtactacgttagaacctaacgtattaacgttacaacgtacaaacttaagtaaataaacttacgtttacccgaaccctttaagttacggtttaccgggacggaaaccgggttaaacaacggtacgttacggaactaacgttaaccgaaataaccggtgtacgtacgactacctacgtagtcttacgttccttataccg

SEQ ID NO: 96254 - DNA, 787 bp, Homo sapiens
  misc_feature: GYAE6OF02HUYCD.12.37.D04.1.454.CMB.1.raw
  modified_base (170)..(170): a, c, t, g, unknown or other
  misc_feature (170)..(170): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccgaggtgccagatgtgacatccagttgacccngtctccatccttcctgtctgcatctataggagacagagtacacctagtcacttcgccgggccagtcgaggactagttagactaattagtttaggcgttggtatctagacagaacggaccgtaaggggaaacgtcccccgtaacgtccgtagattcctagttcggtacgtactactacccgtacgtttacgactaggttacgggttccgggtaccctaacgttaccgtaacggttaccgacggtacggtacgtaggttacgggtaacgttcggtaacgggtaaccgtaacggttaacctttacctaacccgtttacctaacctaaacgtaacccttaccgaacccgaaccgttccgttaccgaccgtaaccggtacccgttaaggtaacgtttacgtttaaccgtaaccttaaccttttaaccgtttaccgtaacgttaaacccgttaacggttttaaagtttaacggtttttacccttttaaccgtttaccggtttaaccgtttttcccgggtacccgtttaacgggaacccgtttaacggaagtttaacgttacttaaccgttaaccgtaaagttacggttcggtaccggttacttaccggtacctacccgtaacg

SEQ ID NO: 96255 - DNA, 777 bp, Homo sapiens
  misc_feature: GYAE6OF02GN5FK.12.37.D04.1.454.CMB.1.raw
  modified_base (202)..(202): a, c, t, g, unknown or other
  misc_feature (202)..(202): n is a, c, g, or t
tcagatacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatcgaccagtctccactcctcctgtctcgcttctgtcgganacagtactccaccatcacttgccaggcgagtggacggtactagttaacggttaaatttttaagttcggttacacgtacgaaacggtaaaccgacgggtaaaccgccccgtaaggtaccctacgtacgtacttaccgacggacggtacctactaccgtaaagtttaccggaaaacggttccggggtaaccctaacggggttaacggttcgaacggggttcgggtaacgggtacggggtacggtacggttacggggtaactaacggtttaccttttaaccccgacctaaccgtcgtaacgacgtaccgacgtacccgtggacctaacggtaccgtaaggtaacgtacgttaccggttacgaacctaagttacgtttaactttacgtacgtaacccgtaagttaagtttaacgtaaacttcgttaccccgtttaccggttaatttccggtttacggggaccgtaacggggtaaccaaggtacccgtaggtaactaccgttaacggaaaccgttacggttaccgggtcggtaactacggtacctaccggttattaccttcggttaccttcgtacccccg

SEQ ID NO: 96256 - DNA, 170 bp, Homo sapiens
  misc_feature: GYAE6OF01CNN4X.38.27.C05.1.454.CMB.1.raw
  modified_base (169)..(170): a, c, t, g, unknown or other
  misc_feature (169)..(170): n is a, c, g, or t
tcagtcgatcacgtcacgaccggtgctcgatttagacgcgatcgaagggtttgggaagaggaagactgacggtccccaggagttcaggtgctgggcacagcggccctgggctgcctggtcaaggactacttccacgtgatcgactgagcgggctggcaaggcgcatagnn

SEQ ID NO: 96257 - DNA, 170 bp, Homo sapiens
  misc_feature: GYAE6OF01DK75S.38.27.C05.1.454.CMB.1.raw
  modified_base (170)..(170): a, c, t, g, unknown or other
  misc_feature (170)..(170): n is a, c, g, or t
tcagtcgatcacgtcacgaccggtgctcgatttagacgcgatcgaagggtttggggaagaggaagactgacggtccccaggagttcaggtgctgggcacagcggccctgggctgcctggtcaaggactacttccacgtgatcgactgagcgggctggcaaggcgcatagn

SEQ ID NO: 96258 - DNA, 189 bp, Homo sapiens
  misc_feature: GYAE6OF01B38LA.38.27.C05.1.454.CMB.1.raw
  modified_base (173)..(189): a, c, t, g, unknown or other
  misc_feature (173)..(189): n is a, c, g, or t
tcagtcgatcacgtcacgaccggtgctcgatttagacgcgatcgaagggtttgggggaagaggaagactgacggtcccccaggagttcaggtgctgggcacagcggccctgggcctgcctggtcaaggactacttccacgtgatcgactgagcgggctggcaaggcgcatagnnnnnnnnnnnnnnnnn

SEQ ID NO: 96259 - DNA, 519 bp, Homo sapiens
  misc_feature: GYAE6OF01E1BQM.38.27.C05.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagcaaaacctggccaggctcccaggctcctcatttatggtgcgtccaccagggccacgtggcatcccagacagattcagtggcagtgcgtctgggacagacttcactctcgtgatcgacagactcggaacccaacagtattttgcttgtgtattactgtaccaactactatgggtcttccggcgttgacgttcggacctaagggaccaaggtggaagtcaatcgaactgtggctgcacatctgtcttcatcttcccgctac

SEQ ID NO: 96260 - DNA, 528 bp, Homo sapiens
  misc_feature: GYAE6OF01B4AZ9.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgagggggagagagccaccctctcctgcagggccagtcagactataggagcagctacttagcctggtaccagacaaaaacctggccaggctcccaggctcctcatttatggtgcgtccaccacgggccactggcactcccagacagattcagtggcagtgcgtcgtgggacagacttcactctcgtgatcgacagactggaacccaagagtattttgcttgtgtattactgtacaactactagtgggtctccggcgtgacgttcggacgaagggaccaaggtgaagtcaagtcgaactggtcggctgccacattctgttcttcattcccttccgctacg

SEQ ID NO: 96261 - DNA, 173 bp, Homo sapiens
  misc_feature: GYAE6OF01B9F7C.38.27.C05.1.454.CMB.1.raw
  modified_base (172)..(173): a, c, t, g, unknown or other
  misc_feature (172)..(173): n is a, c, g, or t
tcagtcgatcacgtcacgaccggtgctcgatttagacgcgatcgaagggtttgggggaagaggaagactgacggtcccccaggagttcaggtgctgggcacagcggccctgggctgcctggtcaaggactacttccacgtgatcgactgagcgggctggcaaggcgcatagnn

SEQ ID NO: 96262 - DNA, 189 bp, Homo sapiens
  misc_feature: GYAE6OF01AIN6F.38.27.C05.1.454.CMB.1.raw
  modified_base (173)..(189): a, c, t, g, unknown or other
  misc_feature (173)..(189): n is a, c, g, or t
tcagtcgatcacgtcacgaccggtgctcgatttagacgcgatcgaagggtttgggggaagaggaagactgacggtcccccaggagttcaggtgctgggcacagcggccctgggctgcctggtcaaggactacttccacgtgatcgactgagcgggctggcaaggcgctatagnnnnnnnnnnnnnnnnn

SEQ ID NO: 96263 - DNA, 181 bp, Homo sapiens
  misc_feature: GYAE6OF01DF5ZU.38.27.C05.1.454.CMB.1.raw
  modified_base (172)..(181): a, c, t, g, unknown or other
  misc_feature (172)..(181): n is a, c, g, or t
tcagtcgatcacgtcacgaccggtgctcgatttagacgcgatcgaagggtttgggggaagaggaagactgacggtcccccaggagttcaggtgctgggcacagcggccctgggctgcctggtcaaggactacttccacgtgatcgactgagcgggctggcaaggcgcatagnnnnnnnnnn

SEQ ID NO: 96264 - DNA, 172 bp, Homo sapiens
  misc_feature: GYAE6OF01DH8BO.38.27.C05.1.454.CMB.1.raw
  modified_base (172)..(172): a, c, t, g, unknown or other
  misc_feature (172)..(172): n is a, c, g, or t
tcagtcgatcacgtcacgaccggtgctcgatttagacgcgatcgaagggtttgggggaagaggaagactgacggtcccccaggagttcaggtgctgggcacagcggccctgggctgcctggtcaaggactacttccacgtgatcgactgagcgggctggcaaggcgcatagn

SEQ ID NO: 96265 - DNA, 511 bp, Homo sapiens
  misc_feature: GYAE6OF01EPL3V.38.27.C05.1.454.CMB.1.raw
  modified_base (390)..(390): a, c, t, g, unknown or other
  misc_feature (390)..(390): n is a, c, g, or t
  modified_base (489)..(489): a, c, t, g, unknown or other
  misc_feature (489)..(489): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggctcctcatttatggtgcgtccaccagggccactggcatcccagacagattcagtggcagtgcgtctggacagacttcactctcgtgatcgacagactggacccaanagtattttgctgtgtattactgtacaactactatgggtcttccggcgtgacgttcggccgaagggaccaaggtggaagtcaagtcgaactgtggctgcncatctgtctcatcctccgctac

SEQ ID NO: 96266 - DNA, 509 bp, Homo sapiens
  misc_feature: GYAE6OF01BTJ40.38.27.C05.1.454.CMB.1.raw
  modified_base (198)..(198): a, c, t, g, unknown or other
  misc_feature (198)..(198): n is a, c, g, or t
  modified_base (390)..(390): a, c, t, g, unknown or other
  misc_feature (390)..(390): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggganagagccaccctctcctgcagggccagtcagactataggagcagctacttagcctggtaccagcaaaaacctggccaggctcccaggctcctcatttatggtgcgtccaccagggccactggcatcccagacagattcagtgcagtgcgtctgggacagacttcactctcgtgatcgacagactggacccaangatttgctgtgtattactgtcaacactatgggtcttccggcgtgacgttcggaccaagggaccaagggtggaagtcaagtcgaaactgtggctgcacatctgtctcatcttccgctacg

SEQ ID NO: 96267 - DNA, 608 bp, Homo sapiens
  misc_feature: GYAE6OF01DPL36.38.27.C05.1.454.CMB.1.raw
  modified_base (197)..(197): a, c, t, g, unknown or other
  misc_feature (197)..(197): n is a, c, g, or t
  modified_base (239)..(239): a, c, t, g, unknown or other
  misc_feature (239)..(239): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagcccaccctctcctgcagggccagtcagactattaggancagctacttagcctggtaccagacaaaaacctggccaggcctcccaggctcctcatttatggtgcgtccaccgagggccactggcatcccagacagattcagtggcagtgcgtctgggacagacttcactctcgtgatcgacagactcggacccaacagtattttgctgttagtattactgtacaactacttagttcgggtctttccgggcgttacggtaccggtttccggacccgtaaaggggacccgtaaagggttcggtaacgttacaaacgttaccggaaacgttggtcgggtactacgggaccctaacccgtaacgttcgttacggttccctttacacttttcccgttcccccggtcttaaccg

SEQ ID NO: 96268 - DNA, 560 bp, Homo sapiens
  misc_feature: GYAE6OF01AGHYG.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactataggagcagctacttagcctggtaccagcaaaaacctggccaggctcccaggctcctcatttatggtgccgtccaccagggccactggcactcccagacagattcagtggcagtgcgtctgggacagacttcactctcgtgagtcgacagactggacccaacagtattttgcttgtgttattactgtcaacactagtcgggtcttccggcgtgtacggttcggaccgtaagggacctaagggtaggaacgtcaagtcgaacgtggtacggtcgttgactaccctaattccgttacggttaccttaccactttcccgttccccgcctacg

SEQ ID NO: 96269 - DNA, 532 bp, Homo sapiens
  misc_feature: GYAE6OF01DNMQN.38.27.C05.1.454.CMB.1.raw
  modified_base (196)..(196): a, c, t, g, unknown or other
  misc_feature (196)..(196): n is a, c, g, or t
  modified_base (390)..(390): a, c, t, g, unknown or other
  misc_feature (390)..(390): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccagggganagagccaccctctcctgcagggccagtcagactattaggagcagctacttagcctggtaccagcaaaaacctggccaggctccaggctcctcatttatggtgcgtccaccagggccactggcatcccagacagattcagtggcagtgcgtctgggacagacttcactctcgtgatcgacagactcggacccaanagtattttgcttgtgttattactgtcaactactagtcgggtctttccggcgttgaaccgttcggaccgtaaagggacctaaagggtggaagtcaagtcgaaactgtagctgcacgatcgtgtcttcattccttcccgctacg

SEQ ID NO: 96270 - DNA, 547 bp, Homo sapiens
  misc_feature: GYAE6OF01C5800.38.27.C05.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccgagggganagagccaccctctcctgcagggccagtcagactattaggagcagctacttagcctggtaccagacaaaacctggccaggctccaggctcctcatttatggtgcgtccaccgagggccacgtggcatcccagacagattcagtggcagtgcgtctgggacagacttcactctcgtgatcgacagactggacccaacagtatttgcttgtgtattactgtacaactatagtcggtcttccggcgtgtacggttcggaccgtaagggacctaaggtacggaagtctaaagtcgaacgtggtcggcttgactacctattcgttacgtctttacacttcccgttcccgcttaacg

SEQ ID NO: 96271 - DNA, 596 bp, Homo sapiens
  misc_feature: GYAE6OF01EIWH1.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagcccaccctctcctgcagggccagtcagactattaggagcagctacttagcctggtaccagacaaaaacctggccaggcctcccaggcctcctctatttatggtgcgtccaccgacgggccacgtggcactcccagacagattcagtcgcagtgcgtcgtggacagacttcactctcgtgatcgacagactcggaacccaacgagtattttgcttgtgttatttactgtacaactactagttcgggttcttccggcgttgtaccggttcggaccgtaacgggaccgtaagggtacggtaacgtcgaaagtaccgtaaacgtgggtacggtcgtacgaccgtaccctagttccgttacggttccctttacgtacctttccccgttcccgtccctacg

SEQ ID NO: 96272 - DNA, 547 bp, Homo sapiens
  misc_feature: GYAE6OF01CB474.38.27.C05.1.454.CMB.1.raw
  modified_base (199)..(199): a, c, t, g, unknown or other
  misc_feature (199)..(199): n is a, c, g, or t
  modified_base (241)..(241): a, c, t, g, unknown or other
  misc_feature (241)..(241): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgaggggganagagcccaccctctcctgcagggccagtcagactattaggancagctacttagcctggtaccagcaaaacctggccaggctcccaggctcctcatttatggtgcgtccaccagggccactggcatcccagacagattcagtggcagtgcgtctgggacagacttcactctcgtgatcgacagactggacccaagagtatttgctgtgtattactgtacaactactagtggtcttccggcgtgtaccgttcggaccgtaagggtaccaagggttggaacgtcgaaacgttcgaaacgttggtacggcttagcctacctattctcgtctttacacttccttcccgctacg

SEQ ID NO: 96273 - DNA, 594 bp, Homo sapiens
  misc_feature: GYAE6OF01DC52H.38.27.C05.1.454.CMB.1.raw
  modified_base (377)..(377): a, c, t, g, unknown or other
  misc_feature (377)..(377): n is a, c, g, or t
  modified_base (391)..(391): a, c, t, g, unknown or other
  misc_feature (391)..(391): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgagggggagagagccaccctctcctgcagggccagtcagactattaggagcagctacttagcctggtaccagcaaaaacctggccaggctccaggctcctcatttatggtgcgtccaccagggccactggcatcccagacagattaagtgcagtgcgtctgggacagacttcactctcgtgatcganagactggacccaangattttgctgtagtatttactgtacaaactaccttagttacggggtctttcccgggtcgtggtaaccggttccgggtaccgaaaggggaaccctaaagggttggaaagttacaaagtcggaaacttggtaggccgttggcaaccccgtattccccgttagttcccgtttactaacgttcctttcccccggcctaaagttcccg

SEQ ID NO: 96274 - DNA, 547 bp, Homo sapiens
  misc_feature: GYAE6OF01CO0FM.38.27.C05.1.454.CMB.1.raw
  modified_base (197)..(197): a, c, t, g, unknown or other
  misc_feature (197)..(197): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (510)..(510): a, c, t, g, unknown or other
  misc_feature (510)..(510): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagcaaaaacctggccaggctcccaggctcctcatttatggtgcgtccaccagggccactggcatcccagacagattcagtggcagtgcgtctgggacagacttcactctcgtgatcgacngactggacccaanagattttgcttgtgtattactgtacaacactagtgggttcttccgggcgtgaccgtttcggacccgtaagggaccgaaggttcgggaagttcgaaagttcgaaactggtaggctggacncctagtcttggtccttacattcccttcccgtctaacg

SEQ ID NO: 96275 - DNA, 627 bp, Homo sapiens
  misc_feature: GYAE6OF01C7ZHF.38.27.C05.1.454.CMB.1.raw
  modified_base (377)..(377): a, c, t, g, unknown or other
  misc_feature (377)..(377): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagacttagttaggagcagtctacttacgccttggtaccagacaaaaaccgtggaccaggcctcccgaggctcctctatttagtggtcgcgtccaccgagggccacgtcggcactcccagaccagattacgagtcggcagtgcgtctgggacncgtacttcactcgtcgtgactcgacacgtaaccgtcggaaccccaagtagttattttcgacgttgtagttacttactcgtactaactacgttagttcgggttaccttccgggcgttacgtaccggttacggaccggtaaaggggtccctaaagggtcggaaacgttcgaaacgttcgaaaccgttggtcggcttaggaccaccgtacgttcgtcgttccttacgtacctttcccgttcccgtcctaacgg

SEQ ID NO: 96276 - DNA, 709 bp, Homo sapiens
  misc_feature: GYAE6OF01BU97P.38.27.C05.1.454.CMB.1.raw
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggancagctacttagcctggtaccagcaaaaacctgcaggctccaggctcctaattatggtgcgtccaccagggccacgtggcactccagacagattcagtggcagtgcgtcgtgggacagacttcactctcgtgtatcgacagactacgggacccaacgagtattttacgacgttgttagttaacttacgttacggtacctaaacgtacgtttacgttcgggtttacctttcccggggtcgttacgggtacccggttttacccggggacccggtaaacgggggtaaccccgtaaaggggttacgggtaaacggttacccgtaaaggttaccggtaaaccgtttcggggttacggggtccgttaccgggtacccgtaaccccgttagttaccccggttttacgttaccccgttttaccgtaacccgttttaccccgtttaccccccgttacccgttaaccgttttaaccccgggg

SEQ ID NO: 96277 - DNA, 529 bp, Homo sapiens
  misc_feature: GYAE6OF01D8UDF.38.27.C05.1.454.CMB.1.raw
  modified_base (241)..(241): a, c, t, g, unknown or other
  misc_feature (241)..(241): n is a, c, g, or t
  modified_base (359)..(359): a, c, t, g, unknown or other
  misc_feature (359)..(359): n is a, c, g, or t
  modified_base (394)..(394): a, c, t, g, unknown or other
  misc_feature (394)..(394): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtcttttgtctccagggggagagagcccaccctctcctgcagggccagtcagactattaggancagctacttagcctggtaccagcaaaaacctggccaggctcccaggctcctcatttatggtgcgtccaccagggccactggcatcccagacagattcagtggcagtgcgtctgggacngacttcactctcgtgatcgacagactggacccaanagtatttgctgtgtattactgtcaactactagtggtcttcggcgtgacgttcggccgtaagggacctaagggtggaagtcaaagtcgaactggtaggctggacaccgatctgttcttacacttcttcccgcctac

SEQ ID NO: 96278 - DNA, 518 bp, Homo sapiens
  misc_feature: GYAE6OF01EDDW7.38.27.C05.1.454.CMB.1.raw
  modified_base (395)..(395): a, c, t, g, unknown or other
  misc_feature (395)..(395): n is a, c, g, or t
  modified_base (423)..(423): a, c, t, g, unknown or other
  misc_feature (423)..(423): n is a, c, g, or t
  modified_base (438)..(438): a, c, t, g, unknown or other
  misc_feature (438)..(438): n is a, c, g, or t
  modified_base (495)..(495): a, c, t, g, unknown or other
  misc_feature (495)..(495): n is a, c, g, or t
  modified_base (514)..(514): a, c, t, g, unknown or other
  misc_feature (514)..(514): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggctcctcatttatggtgcgtccaccaggggccactggcactcccagacagattcagtggcagtgcgtctgggacagacttcactctcgtgatcgacagactggaaccccaanagtattttgctgtgtattactgtcaacntagtggtcttccggngtcgacgttcggccgaagggacctaagggtggaagtcgaatcgaactggtcgctgcncatctgtctcatctcccgntacg

SEQ ID NO: 96279 - DNA, 526 bp, Homo sapiens
  misc_feature: GYAE6OF01C45CG.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagacaaaaacctggccaggctccagctcctcattatggtgcgtccaccaggccactggcatcccagacagatcagtggcagtgcgtctgggacagacttcactctcgtgactcgacagactcggacccaacagtattttgcttgtagttattactgtacaacacttagttgggtctttccgggcgttgaccggttcggaccgaagggaccaagggtggaagtcaagtcgaatgtggctggcaccatctgtcttcattccctccgctac

SEQ ID NO: 96280 - DNA, 577 bp, Homo sapiens
  misc_feature: GYAE6OF01CGPAC.38.27.C05.1.454.CMB.1.raw
  modified_base (236)..(236): a, c, t, g, unknown or other
  misc_feature (236)..(236): n is a, c, g, or t
  modified_base (289)..(289): a, c, t, g, unknown or other
  misc_feature (289)..(289): n is a, c, g, or t
  modified_base (405)..(405): a, c, t, g, unknown or other
  misc_feature (405)..(405): n is a, c, g, or t
  modified_base (458)..(458): a, c, t, g, unknown or other
  misc_feature (458)..(458): n is a, c, g, or t
  modified_base (495)..(495): a, c, t, g, unknown or other
  misc_feature (495)..(495): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctcaggggagagagccaccctctcctgcagggccagtcagactattaggncagctacttagcctggtaccagcaaaaacctggaccaggctcccaggctcctnatttatggtgcgtccaccagggcccactggcatcccagacagattcaggtgcgtagtggcgtcgtgggactaggacttcacttcgtcgtgatcgaacagacctacgggaacccaanagtattttgcttgtagttattacgtagtacaactactagtcgggtcttccggngtacgtacggttcggacccgtaaggggacctaagggngaacgtcaacgtcggaacttggtaggccttaggacctccgaattccgtagttacccttactattcccgttacccgcctaacg

SEQ ID NO: 96281 - DNA, 527 bp, Homo sapiens
  misc_feature: GYAE6OF01B6QRK.38.27.C05.1.454.CMB.1.raw
  modified_base (504)..(504): a, c, t, g, unknown or other
  misc_feature (504)..(504): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggctcctcatttatggtgcgtccaccagggccactggcatcccagacagattcagtggcagtgcgtctgggacagacttcactctcgtgatcgacagactcggacccaacagtattttgcttgtgtattactgtacaactactatcgggttcttccggcgttcgacgtttcggaccgtaagggacctaagggtggaacgtcaagtcgaatggtggctgcacntctgtcttcatccttcccgctac

SEQ ID NO: 96282 - DNA, 559 bp, Homo sapiens
  misc_feature: GYAE6OF01B1WOK.38.27.C05.1.454.CMB.1.raw
  modified_base (438)..(438): a, c, t, g, unknown or other
  misc_feature (438)..(438): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccaggggagagagccaccctctcctgcagggccagtcagactattaggagcagctacttagcctggtaccagcaaaaacctggccaggctcccaggctcctcatttatggtgcgtccaccgaggccactggcatcccagacagattcagtggcagtgcgtcgtggacagacttcactctcgtgatcgacagactggacccaacagtatttgcttgtgtattactgtacaactatagtcgggttcttccggngtcggtacgtttcgggaccgtaacggggacctaagggttaggaacgtacgaagtcggaacgttggtcggtctggacctaccctagttccttacgttcttacgattcccttccccgcctacg

SEQ ID NO: 96283 - DNA, 566 bp, Homo sapiens
  misc_feature: GYAE6OF01BTIJQ.38.27.C05.1.454.CMB.1.raw
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (531)..(531): a, c, t, g, unknown or other
  misc_feature (531)..(531): n is a, c, g, or t
  modified_base (561)..(561): a, c, t, g, unknown or other
  misc_feature (561)..(561): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccaggggagagagccaccctctcctgcagggccagtcagactattaggagcagctactagcctggtaccagacaaaacctgcaggctccgagctcctctatttagtggtgcgtccacgacggccacgtcggcactcccagacagtacttcgagtggcagtgcgtcgtggacncgtactcactctcgtanactcgacacgacgtcggaaccaacgtagtactttgactgtacgttaattacgtacgtactaactacttagtcgggttcttccggtcgttcgtacgttcggacgtaacgggacgtaagggtacggacgtacgaagtacgacgtgtaggcgtgaccncgtgtctcgttacctacacttccttcccgntaccg

SEQ ID NO: 96284 - DNA, 586 bp, Homo sapiens
  misc_feature: GYAE6OF01EFRRB.38.27.C05.1.454.CMB.1.raw
  modified_base (394)..(394): a, c, t, g, unknown or other
  misc_feature (394)..(394): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggctcctcatttatggtgcgtccaccaggggccacgtggcatcccagacagattcagtggcagtgcgtctgggacagacttcactctcgtgatcgacagactcggacccaanagtatttgctgtgttacttactgtacaactactagtcgggttcttccgggcgtcggtacgtttcggacccgtaaggggtacccgtaaggtcgggaacgttacgaaacgtacgaacgtggttacgggtacttggacctaacctacgttccttacggttcctttacgtacgttcccgttccccggccctaaccg

SEQ ID NO: 96285 - DNA, 537 bp, Homo sapiens
  misc_feature: GYAE6OF01CLEF4.38.27.C05.1.454.CMB.1.raw
  modified_base (391)..(391): a, c, t, g, unknown or other
  misc_feature (391)..(391): n is a, c, g, or t
  modified_base (405)..(405): a, c, t, g, unknown or other
  misc_feature (405)..(405): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggctcctcatttatggtgcgtccaccagggccactggcatcccagacagattcagtggcagtgcgtctggacagactcactctcgtgactcgacagactggaacccaanagtatttgctgttntattactgtacaactactagtggtcttccggcgttgacgttcgaccgtaagggtaccaagggtggtagtacaagtacgaacgttggcggtctagccacctacgtcttgtcttacattcccttcccgctaccg

SEQ ID NO: 96286 - DNA, 601 bp, Homo sapiens
  misc_feature: GYAE6OF01CH1W3.38.27.C05.1.454.CMB.1.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (293)..(293): a, c, t, g, unknown or other
  misc_feature (293)..(293): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctntcctgcagggccagtcagactattaggagcagctacttagcctggtaccagcaaaacctggccaggctccaggctctcatttanggtgcgtccaccacgggccactggcatccagacagattcagtggcagtgcgtctgggacagacttcactatcgtgatcgacagactcggaacccaactagtattttgcttgtgttatttacgtagtacaacgtacttagttgggttcctttccgggcgttcggtaccggtttcgggaccgtaacggggacctaagggtacggaagtcgtaaacgtaccggaaacgttggtacgggtccgttaggaccctaacccgtactttccgttacgttcctttacctacgtttcccctttccccgcccgttaacg

SEQ ID NO: 96287 - DNA, 606 bp, Homo sapiens
  misc_feature: GYAE6OF01B3LXW.38.27.C05.1.454.CMB.1.raw
  modified_base (223)..(223): a, c, t, g, unknown or other
  misc_feature (223)..(223): n is a, c, g, or t
  modified_base (283)..(283): a, c, t, g, unknown or other
  misc_feature (283)..(283): n is a, c, g, or t
  modified_base (520)..(520): a, c, t, g, unknown or other
  misc_feature (520)..(520): n is a, c, g, or t
  modified_base (578)..(578): a, c, t, g, unknown or other
  misc_feature (578)..(578): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttggcgtgaggagccgtgggcctnagtgattgtccctgccaggcttccggatatatcttcgacttctactatttacacgtggtncgccaggtccctggacaagggcctgagtgatgggatgcatccaacccagaactggacgacaacaaagtctagaccacagtaacgttcgagggcagggtacacgatacggaaccgagaacacgtccaatcgaaatacacgaccctacgaggaaactcgaacgaccttaaccctaaaagtctaacgaaccgaccgaccggtacccttacttacgttaactggtacgacgaagacggacnggtacgttaccctagttacggtaagttacggttcgttccgggttttagatttacggtntttttacggtagttttcgggtaccgggg

SEQ ID NO: 96288 - DNA, 596 bp, Homo sapiens
  misc_feature: GYAE6OF01A2LRH.38.27.C05.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagacaaaaacctggaccaggcctccgaggctcctcatttatggtgcgtccaccgagggccacgtggcactccagacagattcagtggcagtgcgtcgtaggacagacttcacgtctcgtgactcgacacgacgtacggaacccaacgtagtacttttcgcttaggttagttaacttacttgtaccaaactacgttagttcgggttaccgttccgggtcgttcgtaccggtttcgggacccgtaaacggggtaccgtaaagggtacggaacgtacaacgtacgtaacgtcggtggctgaccgtaacctgttctgtccttactacttccttcccgctacg

SEQ ID NO: 96289 - DNA, 601 bp, Homo sapiens
  misc_feature: GYAE6OF01DWPKW.38.27.C05.1.454.CMB.1.raw
  modified_base (197)..(197): a, c, t, g, unknown or other
  misc_feature (197)..(197): n is a, c, g, or t
  modified_base (396)..(396): a, c, t, g, unknown or other
  misc_feature (396)..(396): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagcccaccctctcctgcagggccagtcagactattaggagcagctacttagcctggtaccagcaaaaacctggccaggctcccaggctcctctatttatggttgcgtccaccacgggccactggcactcccagacagatcagtggcagtgcgtctgagacagacttcactctcgtgatcgacagactcggacccaanagtattttgctgtgttattactgtacaactactagtcgggttcttccgggcgttaggtaccgtttccgggaccgtaaacggggtacctaaaggggttcggaacggttacgtaaagttaccggtaaacgttcgggttacgggtaccttggcccaacccgttagttcctttcggttacctttactacgttcccgtttccccgtaccc

SEQ ID NO: 96290 - DNA, 506 bp, Homo sapiens
  misc_feature: GYAE6OF01BVRFN.38.27.C05.1.454.CMB.1.raw
  modified_base (396)..(396): a, c, t, g, unknown or other
  misc_feature (396)..(396): n is a, c, g, or t
  modified_base (410)..(410): a, c, t, g, unknown or other
  misc_feature (410)..(410): n is a, c, g, or t
  modified_base (484)..(484): a, c, t, g, unknown or other
  misc_feature (484)..(484): n is a, c, g, or t
  modified_base (489)..(489): a, c, t, g, unknown or other
  misc_feature (489)..(489): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggcctcctcatttatggtgcgtccaccagggccactggcatcccagacagtatcagtggcagtgcgtcgtgggacagacttcgactctcgtgactcgacagactcggacccaanagtatttgactgtntattactgtacaacactatggtctcggcgtgacgttcggacaagggaccaggtggatcagtcgactgtgctgcncatcngtctcatctccgctacg

SEQ ID NO: 96291 - DNA, 606 bp, Homo sapiens
  misc_feature: GYAE6OF01DW7M1.38.27.C05.1.454.CMB.1.raw
  modified_base (239)..(239): a, c, t, g, unknown or other
  misc_feature (239)..(239): n is a, c, g, or t
  modified_base (359)..(359): a, c, t, g, unknown or other
  misc_feature (359)..(359): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgaggggagagagccaccctctcctgcagggccagtcagactattaggancagctacttagcctggtaccagacaaaaaccgtggaccaggcctcccaggcctcctacatttatggtgcgtccaccgagggccacgtggcactcccagacagatcagtgcagtgcgtcgnggacagacttcacttctcgtgactcgacagacctacggaacccaagagtattttgcgttgtagttaactttacgtgtacaactacgttagtcgggttcttccggcgtcggtaccgttcggaccgtaaagggtacctaagggtacggaacgtacgtaaacgtcggaaacgttggtacggtccgtagacctaaccctagttccgttacgtttaccttaccgtaactttccctttccccggccttaacgg

SEQ ID NO: 96292 - DNA, 514 bp, Homo sapiens
  misc_feature: GYAE6OF01B50TO.38.27.C05.1.454.CMB.1.raw
  modified_base (392)..(392): a, c, t, g, unknown or other
  misc_feature (392)..(392): n is a, c, g, or t
  modified_base (436)..(436): a, c, t, g, unknown or other
  misc_feature (436)..(436): n is a, c, g, or t
  modified_base (509)..(509): a, c, t, g, unknown or other
  misc_feature (509)..(509): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggctcctcatttatggtgcgtccaccagggccactggcatcccagacagattcagtggcagtgcgtctgggacagacttcactctcgtgatcgacagactggaccccaanagtatttgctgtgtattactgtcaactctagttggtcttccggngtgacgttcggcctaagggaccaagggtggaagtcaatcgatgtggctgcacatctcgtcttcattcttccgngtacc

SEQ ID NO: 96293 - DNA, 525 bp, Homo sapiens
  misc_feature: GYAE6OF01BLN2A.38.27.C05.1.454.CMB.1.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
  modified_base (350)..(350): a, c, t, g, unknown or other
  misc_feature (350)..(350): n is a, c, g, or t
  modified_base (441)..(441): a, c, t, g, unknown or other
  misc_feature (441)..(441): n is a, c, g, or t
  modified_base (501)..(501): a, c, t, g, unknown or other
  misc_feature (501)..(501): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagcaaaaacctggaccaggctcccaggctcctcatttanggtgcgtccaccagggccactggcatcccagacagattcagtggcagtgcgtntgggacagacttcactctcgtgatcgacagactggacccaacagtattttgctgtgtattactgtacaactactagtcggttcttccgggntgacggttcggacgtaagggacctaagggtcggaagtacaatcgaactggtggctgcacntctgtcttcattccttcccgctac

SEQ ID NO: 96294 - DNA, 568 bp, Homo sapiens
  misc_feature: GYAE6OF01AYGMH.38.27.C05.1.454.CMB.1.raw
  modified_base (196)..(196): a, c, t, g, unknown or other
  misc_feature (196)..(196): n is a, c, g, or t
  modified_base (237)..(237): a, c, t, g, unknown or other
  misc_feature (237)..(237): n is a, c, g, or t
  modified_base (347)..(347): a, c, t, g, unknown or other
  misc_feature (347)..(347): n is a, c, g, or t
  modified_base (398)..(398): a, c, t, g, unknown or other
  misc_feature (398)..(398): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccagggganagagccaccctctcctgcagggccagtcagactattaggancagctacttagcctggtaccagcaaaaacctggccaggctcccaggctcctcatttatggtgcgtccaccagggccactggcatcccagacagattcagtgcagtgcgtntggacagacttcactctcgtgatcgacagactggacccaacagtatttcgnttgtgttattactgtacaactactagtcgggtcttccggcgttggaccgttcgggacctaaacggggacctaagggtacgaacgtcgaaagttccgaaacgttcggtacggtcgttaggacctaaccctagttccgtacgttccttcaactttcccttcccgccttaacg

SEQ ID NO: 96295 - DNA, 553 bp, Homo sapiens
  misc_feature: GYAE6OF01BDNIX.38.27.C05.1.454.CMB.1.raw
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatgggatgcatccaacccagaactggacacaacaaagtctgacacagaagtttcgagggcagggtcacgatacgaccgagacacgtccatacaatacacgcctacctaggaactcacgtacctacctaaatctacgacgacacggcctcgtacttacgtgtcgcgagacgcagtacgttaccgagttggtaagtagtcgtcggtttacgtattgttcttttgtagtttcgtacgggg

SEQ ID NO: 96296 - DNA, 534 bp, Homo sapiens
  misc_feature: GYAE6OF01AVIH1.38.27.C05.1.454.CMB.1.raw
  modified_base (446)..(446): a, c, t, g, unknown or other
  misc_feature (446)..(446): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggctcctcatttatggtgcgtccaccgagggccactggcactcccagacagattcagtggcagtgcgtctgggacagacttcactctcgtgatcgacagactcggaacccaagagtattttgcttgtagttattactgtacaactactagtgggttcttccggngtgacgttcggaccgtaagggaccagggtacgaagtcaatcggaactggtcggctgcacctatctgtccttacacttcctcccgctac

SEQ ID NO: 96297 - DNA, 631 bp, Homo sapiens
  misc_feature: GYAE6OF01AUPP2.38.27.C05.1.454.CMB.1.raw
  modified_base (238)..(238): a, c, t, g, unknown or other
  misc_feature (238)..(238): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggancagctacttagcctggtaccagcaaaaacctggccaggctcccaggctcctcatttatggtgcgtccaccagggccactggcatcccagaccagattcagtggcagtgcgtctgggacagacttcactctcgtgactcgacagactggaacccacgtagattttgcctgttgtacttactgtacaactactagttcgggtccttacccgggtcgttacggtaccggtttccgggacccgtaaacggggtacccgtaaagggttacgggaacgttaccgaaacgtccggtaaaccgttgggttacgggtaccttcgggacctaacccgtaacgttacccgttacggtttaccctttaccgtaaccttaccccgttttacccccgccgttaaccg

SEQ ID NO: 96298 - DNA, 732 bp, Homo sapiens
  misc_feature: GYAE6OF01BJ4A8.38.27.C05.1.454.CMB.1.raw
  modified_base (244)..(244): a, c, t, g, unknown or other
  misc_feature (244)..(244): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaagtgtgttgacgcagtctccgaggcaccctgtctttgtctccgaggggagagacgcccacctctcctgacgacgggccagtcagactagttaggancagctactagctaggtaccagactaaaaccgtgaccgaggcctaccgacggtcctcctactatttagtggtcgtccgtccaaccgcgggacccacgtcggaccacgtacccaagacagtacttacgaggtcgacgtaggtcggtacggtcgtacgggacctacggtaccttcaccgttcgtacggtagtactacggacgtaacgaccgttaccggaaccctaacgtacgttaacgttttcggaccgttttaggttaacgtttaacgtttaccgtacggtaacctaaacgttaccgtttaacgggttccgggtttaccgttcccgggtacgttaccgggtacccgggttaccgggaacccggtaaacggggtaccgtaaaggggtacggtaaacgtaccgaaacgttaccggtaacgttgggtacggtacgtacgacccgtacctagtccgttacgttacccttacttaccttcccgttcccgacgtac

SEQ ID NO: 96299 - DNA, 566 bp, Homo sapiens
  misc_feature: GYAE6OF01D3WQS.38.27.C05.1.454.CMB.1.raw
  modified_base (197)..(197): a, c, t, g, unknown or other
  misc_feature (197)..(197): n is a, c, g, or t
  modified_base (239)..(239): a, c, t, g, unknown or other
  misc_feature (239)..(239): n is a, c, g, or t
  modified_base (394)..(394): a, c, t, g, unknown or other
  misc_feature (394)..(394): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagcccaccctctcctgccagggccagtcagactataggancagctacttagcctggtaccagcaaaaacctggccaggctcccaggctcctcatttatggtgcgtccaccagggccactggcatcccagacagattcagtggcagtgcgtctgggacaggacttcactctcgtgatcgacagtactggacccaanagtattttgctgtgtattctgtcaacacttagtgggttcttccgggcgtagaccggttcggacccgtaagggtaccaagggttggaacgtcgaaacgttcgaaacgtggttacggcgttgacctaccgaacttcgtcgttcttacgtactttccgttccccgaccttaccgg

SEQ ID NO: 96300 - DNA, 610 bp, Homo sapiens
  misc_feature: GYAE6OF01EQF9B.38.27.C05.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagacgccaccctctcctgcagggccagtcagactattaggagcagctacttagcctggtaccagacaaaaaccgtggccacggctcccaggcctcctctatttatggtcgcgtccaccgacgggtccacgtcggcactcccagacagacttcgagtcggcagtcgcgtcgtggacacgtacttcactctcgtagactcgacgacgacgtcggaacccaacgtagtacttttgcttcgttagttatttactcgttacaactacgttagtcgggttcgtcccgggtgttcggaccgtttccgggaaccgtaagggtaccgtaagggtacggtaacgtcgaaacgtaacgtacgttaggtcggacgttgaccgaccttagttccgtagtttctactacttcccttcccgcttaacg

SEQ ID NO: 96301 - DNA, 616 bp, Homo sapiens
  misc_feature: GYAE6OF01C5ALQ.38.27.C05.1.454.CMB.1.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
  modified_base (375)..(375): a, c, t, g, unknown or other
  misc_feature (375)..(375): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccagggganagagcccaccctctcctgcgagggccagtcagactataggagcagctacttagcctggtaccagacaaaacctgccaggctccaggcctcctctatttanggtgcgtccaaccgtagggccactggcatcccagacagattcagtgctagtgcgtcgtgggacagtacttcactctcgngatcgacagacgtacggaccctaacgtagtaacttttgccgttagttacgttaatttaccgtagtacctaaacgacgtttagttcggggtttacttcccgggcgttcgtaaccggttccggacgtaaacgggtaccaagggttcggaaggtctaaacgtcgaaacgttggtacgggtacctggtacccacgttaacgttcctaggtttaccttacacctttacccgttccccgcgttaccg

SEQ ID NO: 96302 - DNA, 540 bp, Homo sapiens
  misc_feature: GYAE6OF01CIFM3.38.27.C05.1.454.CMB.1.raw
  modified_base (391)..(391): a, c, t, g, unknown or other
  misc_feature (391)..(391): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactataggagcagctacttagcctggtaccagcaaaaacctggccaggctcccaggctcctcatttatggtgcgtccaccagggccactggcatcccagacagattcagtggcagtgcgtcgtgggacagacttcactctcgtgatcgacagactggacccaanagtatttgctgtgtattactgtacaactactagtcggtcttccgggcgtcgtacggttccggaccgtaacggggacctaagggtggaacgtcaagtcgaactggtacggctgactaccgatcgttgtccttcacttccttcccgctacg

SEQ ID NO: 96303 - DNA, 565 bp, Homo sapiens
  misc_feature: GYAE6OF01EQ2J8.38.27.C05.1.454.CMB.1.raw
  modified_base (285)..(285): a, c, t, g, unknown or other
  misc_feature (285)..(285): n is a, c, g, or t
  modified_base (359)..(359): a, c, t, g, unknown or other
  misc_feature (359)..(359): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtctgggttgcgtgaggagccgtggggcctcagtgattcgtcccctgccaggcttccggatatatcttcgacttctactatttacactgggtncgccaggtccctggacaagggcctgagtggatgggatgcatccaacccagaactggcacaacaaagtctgacanagtaagttcgagggcagggtcacatcgaccgagacacgtcatcaatacacgacctaccgtagaactcacgtcctaaccctaaatcagacgacacgggcctatattccgtagtcgacgagcggactacggtacttaccgtacgtttaggtaacttaggttcggttacggttttcgagttgttaccttttgtagtttcggtacggggg

SEQ ID NO: 96304 - DNA, 679 bp, Homo sapiens
  misc_feature: GYAE6OF01BPQEK.38.27.C05.1.454.CMB.1.raw
  modified_base (192)..(192): a, c, t, g, unknown or other
  misc_feature (192)..(192): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctccagatacgacggagaaagtgtgttgacgcagtctccaggcacctgtcttgctcgagggganagacgccacctctcctgacgaggccagtcagactagttaggagcagtctacttagcctaggtaccagtacaaaaaccgtcggaccacggcctacccgacggcctcctactaagtttagtcgggttcgaccgtaccaccgacgggccacgtcggacactccgaagacagtacttcgaggtcgacgtagtggcgtacgtacggggaacacggtaccttacgaacttcgtacgtgaacgtacgacgaacgacgtacgggaacccaagtacgttacgttttgacgtttagttacgttaatttacgtagttaacctaaacttacgtaacgttcgggttaccgttaccgggtcgttaacggtaccggttccgaaccgggttaaacgggaaccgtaagggtacggaacgtacgtaaggtaccgtacggttagcggtacgtggacctacgtacttctacggttaccttactaacttcccgttccctacgttaccg

SEQ ID NO: 96305 - DNA, 582 bp, Homo sapiens
  misc_feature: GYAE6OF01CA955.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggccaccctgtctttgtctccgaggggagagagcccaccctctcctgcagggccagtcagactattaggagcagctattagcctggtaccagacaaaaacctggccaggcctccaggctcctcatttatggtgcgtccaccgtagggccacgtggcatcccagacagattcagtgcagtgcgtcgtgggacagtacttcactcgtcgtgatcgacagactcggaacccaagagtatttgcttgtagtattactgtacaacacttagtcggttccttcgggcgtacgtaccgttcggaccgtaaggggacctaaagggtggaagtaccgtaaagtaccggtaaacgttggtacggtctagacctaccgtagttccgtacgttccttactaacttcccgttccccgcttaaccg

SEQ ID NO: 96306 - DNA, 532 bp, Homo sapiens
  misc_feature: GYAE6OF01AMZ6W.38.27.C05.1.454.CMB.1.raw
  modified_base (198)..(198): a, c, t, g, unknown or other
  misc_feature (198)..(198): n is a, c, g, or t
  modified_base (239)..(239): a, c, t, g, unknown or other
  misc_feature (239)..(239): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggganagagccaccctctcctgcagggccagtcagactattaggancagctacttagcctggtaccagcaaaaacctggccaggctcccaggctcctcatttatggtgcgtccaccagggccactggcatcccagacagattcagtggcagtgcgtctgggacagacttcactctcgtgatcgacagactcggacccaacgagtattttgcttgtcgttaattactgtacaacactagttgggtcttccgggcgtgaccgttcggaccgaagggaccaaggtggagtcagtcgaacgttgtggctgcacctatctcgtcttacattccttcccgctacg

SEQ ID NO: 96307 - DNA, 627 bp, Homo sapiens
  misc_feature: GYAE6OF01EV5CW.38.27.C05.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcacctgtctttgtctccgaggggnagacgccaccctctcctgcagggccagtcagactagttaggagcagctacttagcctaggtaccagacaaaaacctggaccaggctaccaggctcctctatttatggtcgcgtccaccgtagggccacgtcggacactcccagacagtacttcgagtgcagtcgcgtcgtggactagacttcactcgtcgtgatcgacagactcggacccaagtagtatttgacttgttagtattacgtagtactaacgtactagttcgggtactttccgggcgttacgtaccggttccggaaccgtaaacggggaccttaaaggggtcgtaacggtacaaaggtaccggtaaacgtcgggttacggtcgtacgaccgtaacccgaagtttcccgtacgttaccgtttactaacgtttcccctttcccggaccttaaccgg

SEQ ID NO: 96308 - DNA, 721 bp, Homo sapiens
  misc_feature: GYAE6OF01C82RG.38.27.C05.1.454.CMB.1.raw
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaagtgtgttgacgcagtctccaggccaccctgtctttgctccgagggganagacgcccaccctctcctgcgagggccagtcagactagtaggagcagctacttagcctggtaccagacaaaactgaccaggctccagcctcctnattagnggtcgccgtccaccgnggccacgtggcactccagacagatacgagtgactagtgcgtcgtgggacagtacttcactcgtcgtgactacgaacgacgtaccgtaccggaaccctaacgtaggttacttttcggaccgtttaggttaacgtttaacgtttaccgttacggtttaaacccaaaccgtacgtttaacggtttacggggtttaccgtttaccccgggtacgttaaccgggttaaccggttttacccgggaacccgggtaaaggggtaacccgtaaacggggtttacggggtaacgttaaccggtaaacgtttaccgggaaacggtttcggtacgggttacctaccggaccgtaaacccgttagttacccgtacggtttaccctttacgtacgtttcccccgttacccgtccgttaaacg

SEQ ID NO: 96309 - DNA, 742 bp, Homo sapiens
  misc_feature: GYAE6OF01B3JFK.38.27.C05.1.454.CMB.1.raw
  modified_base (198)..(198): a, c, t, g, unknown or other
  misc_feature (198)..(198): n is a, c, g, or t
  modified_base (240)..(240): a, c, t, g, unknown or other
  misc_feature (240)..(240): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgagggganagagcccaccctctcctgcgagggccagtcagactattaggncagtctacgttagcctggtaccagaccaaaaaccgtcggaccacggcctcccgaggtcctcctactatttagtcggtcgccgtacccaccgacgggcccacgtcggacctacgtacccgaagaacagtacttcgaggtggcgtagtcgcgtcgtacgggactacgtacttcgacgtcgtcggtagtacgtaccgacgtacgtaccgtacggaaaccctaacgtaaggttacttttagaccgtttagttacgttaactttacgttacgtaacctaaaccgttacgtttaacggttcggggttaccgtttacccgggttacggttaccggttaacccgggtttaccgggacccgggtaaaccggggtaacccgttaaaggggtaccggtaacggtaaccgtaaacggttaccggtaacggttacggtcggtacccgtagtaccgtaaccgttacttccgttacgttaccttacctaccgtttccccgttaccccgcttaaccgg

SEQ ID NO: 96310 - DNA, 616 bp, Homo sapiens
  misc_feature: GYAE6OF01D0O59.38.27.C05.1.454.CMB.1.raw
  modified_base (345)..(345): a, c, t, g, unknown or other
  misc_feature (345)..(345): n is a, c, g, or t
  modified_base (363)..(363): a, c, t, g, unknown or other
  misc_feature (363)..(363): n is a, c, g, or t
  modified_base (404)..(404): a, c, t, g, unknown or other
  misc_feature (404)..(404): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttgcgtgaggaagccgtgggcctcagtgattcgtccctgccaggccttccggatatatcttcgactttctacttaatttacacgtgggtgcgcacggtcctggacgaaggctgagtggatggatggctataccaacccagtacncggacaacacgaaagtcngacagaagtaattcgaggtcagggtacaccatacgaccganactaccgtacaagtacaatacgacgacctacgtacgaactcgaaccgtacctaacctaaatccgtacgaacgacctaccggccgttaactacgttacgacgtggacggtaagacggtactaagtccggttaactacggttcggttaagttaacggttggttaccggtttactaggttcggttagttttcggtaacgttcgggtaaccggggg

SEQ ID NO: 96311 - DNA, 568 bp, Homo sapiens
  misc_feature: GYAE6OF01CYKKY.38.27.C05.1.454.CMB.1.raw
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
  modified_base (412)..(412): a, c, t, g, unknown or other
  misc_feature (412)..(412): n is a, c, g, or t
  modified_base (538)..(538): a, c, t, g, unknown or other
  misc_feature (538)..(538): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcacctgtctttgctccagggganagagccacctctcctgcagggccagtcagactataggancagctactagcctggtaccagacaaaacctggaccaggctcccgaggctcctcatttatggtgcgtaccaccgacgggccacgtcggcctacgtccccaagaccagacttacgaggtcggacagtcgcgtcgtgggacaggtactcacgtctcgtgactcgacagactcggacccaanagtatttgcttgtagtacttactgtacaactactagttcgggtcttccgggacgttggtacggttcggaccgaacgggacctaagggtgaagtctaagtacgaaacgtggtacgtcgtagccgacngttctcggttctactacttcctccgctacg

SEQ ID NO: 96312 - DNA, 792 bp, Homo sapiens
  misc_feature: GYAE6OF01AOSX9.38.27.C05.1.454.CMB.1.raw
  modified_base (247)..(247): a, c, t, g, unknown or other
  misc_feature (247)..(247): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaagtgtgttgacgcagtctccaggccaccctgtctttgtcctccgagggggagagacgcccaccctctcctgcgagggccagtcagtactagttaggacncaagcttactagcctaggtaccagaccaaaacctggaccacggcctcccgaggcctcctactactttagtcggtcgtccggtccaccgtaccgggcctaacggtcggtacctaccgtacccgaagaccgtaagtacgttacgaacggtcggacgtacggtcggtacgtcggtagggaccgtacgtaccgttactacgtaccgtacgttacgtacgtaccgaacgtacggtaccgtaccgggtaaaccctaggtaacgttacgtttcggtatttcgggtaactttaacgttacgttacgtaaccgttaaactacggttacggtttaccggggttaccggtttacccgggtacggttaccggttaacccgggtttccggaaaccccgggttaacgggggtaaacccgttacgggttaacggggtaacgttaccggtaaccgttaccgggtaaaccgttcggggtaccgttccgggtaacgacccttaccggtacgtacccgttttcggtaacccttccgaccttttccccgtcccggcgttaacccg

SEQ ID NO: 96313 - DNA, 612 bp, Homo sapiens
  misc_feature: GYAE6OF01DISX5.38.27.C05.1.454.CMB.1.raw
  modified_base (297)..(297): a, c, t, g, unknown or other
  misc_feature (297)..(297): n is a, c, g, or t
  modified_base (355)..(355): a, c, t, g, unknown or other
  misc_feature (355)..(355): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgaggggagagagcccaccctctcctgcgagggccagtcagactattaggagcagcctacttagcctggtaccagacaaaactggccaggctccagctcctctattanggtgcgtccacgcggccacgtggcactccagacagtattcgagtggcagtcgcgtcgngggacagtacttcactcgtcgtgtatcgacacgtacgtacggaacccaacgtagttacttttggctttaggtagttacttactgttaccaactacttagttcgggttacttccgggtcgttacggtaccggttccggaccggtaacggggaaccgtaagggtacggtaacgtcgtaaacgttcggaaccgtttggacggtcgtacgacctaccgtagttccgttcgttaccttactactttcccgttcccgcttacg

SEQ ID NO: 96314 - DNA, 571 bp, Homo sapiens
  misc_feature: GYAE6OF01EZVFF.38.27.C05.1.454.CMB.1.raw
  modified_base (198)..(198): a, c, t, g, unknown or other
  misc_feature (198)..(198): n is a, c, g, or t
  modified_base (239)..(239): a, c, t, g, unknown or other
  misc_feature (239)..(239): n is a, c, g, or t
  modified_base (405)..(405): a, c, t, g, unknown or other
  misc_feature (405)..(405): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggganagagccaccctctcctgcagggccagtcagactattaggancagctacttagcctggtaccagcaaaaacctggccaggcctcccaggctcctcatttatggtgcgtccaccgagggccactggccatcccagacagtacttcgagtggcagtcgcgtcgtgggacagtacttcactctcgtgatcgacacgactacggaccctaanagttatttgcttgtagttacttacttgtacaactacgttagttcgggtcctttccgggacgtgtaccggtttaccggccgtaaagggtaccaagggttcggaacgttcgaagttaccgaacgtggtcggctgacacctatcgtcgtcttcacttcctcccgctacg

SEQ ID NO: 96315 - DNA, 707 bp, Homo sapiens
  misc_feature: GYAE6OF01CCWXM.38.27.C05.1.454.CMB.1.raw
  modified_base (221)..(221): a, c, t, g, unknown or other
  misc_feature (221)..(221): n is a, c, g, or t
  modified_base (285)..(285): a, c, t, g, unknown or other
  misc_feature (285)..(285): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaagacgcccactcccaggtgaaattggtccagtcgtgggttgcgtgaggagctgggcctnagtgattcgccctgccgaggtccttccggatatatcttcgacttctactatttacagtcggtanccgctacggtccgtggacgaaggcctagagtggagtgggatggacactaccaaccccgagaaccgtggaccgtaacgaacgtaaacgtcgtagactaacgtaaaggttaacggtttacgaaggggtaccgtacgggtaccaaccgtacgtaccgaacccggtaacgtaccgaaccggttcccaacttaccgaaacgttaccgaaccgtaacccgttaacgtaaccgggaaaccttacgaaccgtacccttaacccgtaaaatttccgaaccgaaccggtacccgaaccggtacccgtttacgtaccgttaaccctggttcgacgtaacgacggtacccaggtaccgttacccgtagtttaacggtagttacggttacggtcgttttcggtaattcgttattttcggacgtttcggtaacggg

SEQ ID NO: 96316 - DNA, 754 bp, Homo sapiens
  misc_feature: GYAE6OF01CE6Y6.38.27.C05.1.454.CMB.1.raw
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgagaagccgtggggcctcagtggattcgtcccctgccaggcttccggatatactcttcgacttctactatttaacactgggtgcgccgaggtcccctggacaagggcctgagtggatgggatgcatacccaaccccagaacgtggacgaacaacgaaacggtctaggaccaacgtaaggtaaggttttccgaagggggtaccaacgggggttaccaacccgtaagttaccggaacccgggaacgaacccgtaaccgtacccgtaactaacctaaacgtaaacctaaccggtacccttaacccgtaaccgggtaaccttacgaccgtaccttaacccttaaaactcgtaacggtaacgaacccgtaaccggtacccggttaccttaacgtttaccgttcgtacggacggaacggtacgggacctaacgggtaaccgttacccgttaacgtttagggttaaagttaacggggtttaccggttacggggttttacggtaactttcgggtttacccgtttttaagttacggttttaccggttaccgggggg

SEQ ID NO: 96317 - DNA, 615 bp, Homo sapiens
  misc_feature: GYAE6OF01BFFD8.38.27.C05.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcacctgtctttgtctccgagggganagagccaccctctcctgcagggccagtcagactagttaggagcagctacttagcctggtaccagacaaaaacctggaccaggctcccaggcctcctcatttagtggtgcgtccaccgagggccacgtggcactcccagacagattcaggtcgcagtgcgtcgtggacagacttcactcgtacgtagagtccgacacggtacctacgggaaccccaagtagtattttcgacttggttagttacttacttggtacaaaccgtattagttcgggtccttccgggtcgttcggtaaccggttccgggaacctaacggggtaccgaaagggttcggaagtacgtaaggttacgaacgttcggtggtacgttcggacctaaccgtattcgtcgtttacttaccactttcccttcccgacttacg

SEQ ID NO: 96318 - DNA, 600 bp, Homo sapiens
  misc_feature: GYAE6OF01DO5HC.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgaggggagagagcccaccctctcctgcagggccagtcagactattaggagcagctacttagcctggtaccagacaaaacctggccaggcctcccaggcctcctctatttatggtgccgtccaccgacgggccacgtggcactcccagacagtactcaggtgacagtgcgtcgtggacagtacttcacgtctcgtgactcgacacgacgtacggacccaagtagtatttgactgttagttacttacgtctacaactacgttgtcggttcgttccggcgttcgtacgttcggaccgtaagggaccgtaagggtggaacgtactaacgtcgaaacgttggtacggtcctacggacctaaccgacgttcgttacgttccttacgtaccttttcccggtccccgtacgttaaccg

SEQ ID NO: 96319 - DNA, 682 bp, Homo sapiens
  misc_feature: GYAE6OF01BHU9R.38.27.C05.1.454.CMB.1.raw
  modified_base (198)..(198): a, c, t, g, unknown or other
  misc_feature (198)..(198): n is a, c, g, or t
  modified_base (397)..(397): a, c, t, g, unknown or other
  misc_feature (397)..(397): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgagggganacgagccaccctctcctgcaggccagtcagactattaggagcagctacttagcctggtaccagacaaaaaacctggacctacggcctcccgaaggctccctactacgtttaatggtcgtccgtaccgaccgacgggcctaccgtggcctacgtaccccaagactaaggacttcgagtcggacagtcgcgtacgtggacngtacttcactcgtcgtagactcgactacgacgtcgaaccctacaggttacttttacgacgtttggttaactttaacgttacgttacgtaaccgtaactacgttaggttcgggtttaccgttaccgggtacggttcgtaaccgggttacggaccggtaaacgggccgttaaagggttacgggtaacgtaacgtacggttaaccgtaacgttggttacggtcgttacgacgtaccggttacttcgttacgttcttacccgactttcccgtccccgtgtttaaccccg

SEQ ID NO: 96320 - DNA, 591 bp, Homo sapiens
  misc_feature: GYAE6OF01BM52I.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgaggggagagagccaccctctcctgcgagggccagtcagactattaggagcagctacttagcctggtaccagacaaaactggccaggcctcccaggcctcctcatttagtggtacgcgtccaccgacggccactcggcactcccgagacagtacttcagtggcagtgcgtcgtggacagacttcacttctcgtgatacgactacgacctacggacccaagtagtacgtttgcttgtagttaacttactgttacaactactacgttcggttcgtaccggtgtacgtaccggttaccggaccgaacgggtaccgtaagggtaggaacgtacgaagtacgtaaacgtggtacggcgtgacctacctagtcgttacgttctacgtacttcccttcccgcttaacg

SEQ ID NO: 96321 - DNA, 635 bp, Homo sapiens
  misc_feature: GYAE6OF01CCEQJ.38.27.C05.1.454.CMB.1.raw
  modified_base (198)..(198): a, c, t, g, unknown or other
  misc_feature (198)..(198): n is a, c, g, or t
  modified_base (239)..(239): a, c, t, g, unknown or other
  misc_feature (239)..(239): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgagggganagagcccaccctctcctgcagggccagtcagactataggancagctacttagcctggtaccagcaaaaacctggaccaggctcccaggcctccgtctatttactagggtgccgttccaaccgaggggcccaacgtcgggaccactccccaagtaaccagtattcagtggacagtgacgtcgtgggactaggacttcgactcgtcgtagagtccgacacgaccgttcggaacccaacgtagtaattttgccttaggtgttaattaccgtagtacaactacgtaagtcggttacgttccgggcgtcgtacggttccggaaccgtacgggtaaccgtaagggtacggaacgtacgaaagttccggaaacgttgggtcggtctacggacctaacgacgttcgtcggtttaccttactactttcccttccccggcttaaccg

SEQ ID NO: 96322 - DNA, 627 bp, Homo sapiens
  misc_feature: GYAE6OF01BPYOE.38.27.C05.1.454.CMB.1.raw
  modified_base (193)..(193): a, c, t, g, unknown or other
  misc_feature (193)..(193): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctccagatacgaccggagaaagtgtgttgacgcagtctcaggcacctgtctttgctccagggganagacgcccaccctctcctgcagggccagtcagactataggagcagctacttagcctggaccagacaaaactggcaggctcccaggctcctctatttatggtgcgtccaccgagggccacgtggcactcccagacagtattcagtggacagtgcgtcgtggacagaccttcactctcgtacgtactcgacaggtacctacggaacccaagacgttacttttcgcgttagttagttacttactacgtactaaactacgttacgttagggttcccgtttcgggcgttacgtaccggtttaccggaccggtaaacgggtacgtaagggtacggaacgttaacgaacgtacgtaaacgtgggtacgcgttacggaccgttacctacgttaccgttacggttacctttaccgtaacctttccccttccccgccgttaacg

SEQ ID NO: 96323 - DNA, 770 bp, Homo sapiens
  misc_feature: GYAE6OF01BTU5I.38.27.C05.1.454.CMB.1.raw
  modified_base (196)..(196): a, c, t, g, unknown or other
  misc_feature (196)..(196): n is a, c, g, or t
  modified_base (251)..(251): a, c, t, g, unknown or other
  misc_feature (251)..(251): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctccagatacgaccggagaaagtgtgttgacgcagtctccgaggcaccctgtctttgctcgagggganagacgccaccctctccgtgacgacgggccaagtccgaagtacctaagttaggganccgaagccttaacgttacgccgtagggttaacccaagtaaccaaaaaaccgtcggaccgaacggcctacccgaacggcctacccgtactaacttttacgtcggttcgaccgtaccgaccgaacgggtccaacgtcggaccactcccgaacgaactacgtacgttacgaacggttcggaccgtaaggttcggacgttacgggtacgggtaaaccgtaccggttaaccgttccgtaaccgtttccgtacggttacggtaaccgttaccgaacgtaacggttaacccgaccggtaaaccctaaaccgttagttaacttttacggacgtttacggtaacgttaactttacggtctaacgtaaccgtagtaacggttcggttacgttaccgtcggtacgtaccggttaccggaacggaacgggtacgtaagggtacggaacgtacgtaacgtacgtacgttggtacgccgttacggactacgtcttcgtacgttacctcgttacctcccgttaccgcctaacgg

SEQ ID NO: 96324 - DNA, 605 bp, Homo sapiens
  misc_feature: GYAE6OF01EPZRJ.38.27.C05.1.454.CMB.1.raw
  modified_base (198)..(198): a, c, t, g, unknown or other
  misc_feature (198)..(198): n is a, c, g, or t
  modified_base (239)..(239): a, c, t, g, unknown or other
  misc_feature (239)..(239): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgagggganagagccaccctctcctgcagggccagtcagactattaggancagctacttagcctggtaccagacaaaaactggaccaggctacccaggcctcctactatttactggtcgcgtccgaccgagggccacgtcggccactccagacgagtactcgagtggcagtcgtacgtcgtaggacagtacttcactctcgtgatacgacacgacgtcggaacccaacgtagtaattttcgcttagtagttaacttactagttacaactactaggtcgggttcttccgggcgtcgtaacggttccggaccggtaagggtaccgtaagggtaggtaacgtacgaagtaccgtaacgttgtcgggtctagacctactaacttcgtacgttaccttactacgtttccctcccgcttacg

SEQ ID NO: 96325 - DNA, 807 bp, Homo sapiens
  misc_feature: GYAE6OF01AKR5L.38.27.C05.1.454.CMB.1.raw
  modified_base (196)..(196): a, c, t, g, unknown or other
  misc_feature (196)..(196): n is a, c, g, or t
  modified_base (244)..(244): a, c, t, g, unknown or other
  misc_feature (244)..(244): n is a, c, g, or t
  modified_base (755)..(755): a, c, t, g, unknown or other
  misc_feature (755)..(755): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctccagatacgaccggagaagtgtgttgacgcagtctccaggcaccctgtctttgtctccgagggganagacgcccaccctctcctgcgagggccagtcagtacttagttaggacncacgtcttacttagccctgggtaccaagaccaaaaaccgtggaccgaggcctacccgaggtcctcctactatttagtcggtcgccgtaccaccgcgggcctacgtcggaccactcccgaacgacgtacgtacttacggacgtcggacgacggttcggcgttacggtacggggaacctacggtacccttcgtaaccgttccgtaccggtagtaccgttaccggaacgtaccgggtaacccgtaccgggtaaacccctaaacgtaacggtttaccgtttttaggtaccgtttaggttacggttttaacctttaaccgggttacttaaaccgtaaccttaacgtttaacgggtttacccggggtttaccgtttaccccgggtacggttaccggtttaaccgggttacccgggtaaacccggtaaccgggggtaaccgttaaacggggttacggtaacgttaaccgtaacggtccgtaaacggttcgggttacggtaccgtacgtaccgtacccncgttacgtttccgttacgttaccctacgtttcccgtaccccgtcttaaccgg

SEQ ID NO: 96326 - DNA, 765 bp, Homo sapiens
  misc_feature: GYAE6OF01EEAGV.38.27.C05.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccagggganagagccacctctcctgcagggccagtcagactattaggagcagtctacttagcctggtaccagacaaaaccgtggccaggcctcccgaggcctcctctatttagtggtgcgtccaccgacgggccacgtcggctacgtcccagaccagacttcgaggtcggcaggtcgacgtcgtacgggacacggtaccttcgaaccgttcgtacggtagaacgttccggaaccgtacggtacccgttaccgggaaccccctaaacgtaacggttaacgtttttacggaccgttaggtttaacggtttactttaaccgttcggttaacctaaaccgtacgtttagggttccggggtttacccgtttaccggggtacggttacggtacccgggtttaccgggaacccggtaaacggggtaccgttaaacggggttacggtaaacgttaccgtaaaacggttaccggtaaacggttcgggttaccgggtacgttaccggtaaccgtaacccgtaacgttccgttaccggtttccctttaaccgtaccgttttaccccggttccccggtaccttaaaccgg

SEQ ID NO: 96327 - DNA, 780 bp, Homo sapiens
  misc_feature: GYAE6OF01ETEV4.38.27.C05.1.454.CMB.1.raw
  modified_base (770)..(770): a, c, t, g, unknown or other
  misc_feature (770)..(770): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctgctccagatacgaccggagaagtgtgttgacgcagtctccgaggcaccctgtctttgtctccgaggggagagacgcccaccctctcctgcgacggccagtcagactagtaggagcagctactgcctggaccagacaaaccgtgaccacgcctaccgagcctcctacgtatttagtggtctccgtccgaccgacgggacctacgtacggacctaccacccgtaagaccgtaagtacgttacgaggtcggacgtacggtcggtaccgttacgggacggaaccgtacggttacccttaccgtaacgtttcgtaccggttagtaaccgtacggtacgaaccggtaacccgtaaccggtaaaccccctaaaggttgtttaaccgttttcggactttacgggttaactttaacgtttaccgtacgttaacccgttaaacgtaccgtttagggttacccgggtttaccggttacccgggtacgggtttaccggttacccgggtttacccggaaaccgggttaacgggaacccggtaaggggttaccgtaacgtaaccggtacgtaaccgggttacggtacggtcggttacccgtacgtaccctacgttaccgttcgttaccgttacccttacgtaccctttccccgtcccnccgttaacgg

SEQ ID NO: 96328 - DNA, 674 bp, Homo sapiens
  misc_feature: GYAE6OF01CZA38.38.27.C05.1.454.CMB.1.raw
  modified_base (549)..(549): a, c, t, g, unknown or other
  misc_feature (549)..(549): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtctttcgttggtggcagcagtacgaaaggcgcccactcccgaggtacgaaagttcggtcctaggtcgttggggtttggcgtggaggacgccgtggggcctcgagtgtacttcgtccccgtgtcccgaggtccgttaccggatatacttcgttccgtacttacttacttatttacacgttgggtcgcgtccgacggtccctagggtaaccgaacgggtcctaggacggtaggacgttggggaatcggctacgtacccgaaacccgtagaacgtcggacgaacaacgtaaagtcacgcgaacgaagttaacgttcgaagggtcgtacggtacaccgagtaccgaccgagaccgactaccatacaacgtacacgtaccctacgtacgaacctacaccgtacctaaccgtaanacgtacgaaccgaccgaccgttaccgtacttacgtacgtgacgacgacggatcgacgtacgtacgtacgtagtacgtcgtacggttcgtttacgtacgttgttagtttcgttggttcggtacggg

SEQ ID NO: 96329 - DNA, 796 bp, Homo sapiens
  misc_feature: GYAE6OF01DD45A.38.27.C05.1.454.CMB.1.raw
  modified_base (199)..(199): a, c, t, g, unknown or other
  misc_feature (199)..(199): n is a, c, g, or t
  modified_base (216)..(216): a, c, t, g, unknown or other
  misc_feature (216)..(216): n is a, c, g, or t
  modified_base (246)..(246): a, c, t, g, unknown or other
  misc_feature (246)..(246): n is a, c, g, or t
tcagtcgatcacgtcacgaccggtgctcgatttagacgcgatcgaagggtttgggggagctgctcagttaggacccagagggaaccatggaaaccccagcgcagcttctccttcctcctgctactctggctcccagatacgaccggagaaagtgtgttgacgcagtctccaggccaccctgtctttgctccggaggganacgaaccaccctctccngcgacgggccagtcaagtactagttaggancagcctacgttacgccgtaggtaccagtaaccgaaaaccgtcggaccgacggcctaccgacggtcctcctctacgtttacgtcggtcgtcctaccgacgacggccacgtcgactacgtcccagacgtagtacttacgagtcggacgtacggtacgtccggttacggacgggaacctacggttacccttctaacccgttcgttaccggtagtaccgtacggaacacggtaccgtaccggaaccctaagtacgtttacttggacgtttcgttagttaaccgtttactacggttaaacctaaccgttacgtttacggttccggtttacccgggttacggttacgggttaccggttaccggggttaacccgggaacccgggtaacggggtaaccccggtaaagggttacggtaaaccggtacgtaaacggttaccgggtaaccgttggttaacccgcggtttaacccgacccttaaggttcccgttcgtttaccggttaccccttttacggtacccctttaccccggttaccctacccgttaggtttaacccgg

SEQ ID NO: 96330 - DNA, 770 bp, Homo sapiens
  misc_feature: GYAE6OF01BFPH4.38.27.C05.1.454.CMB.1.raw
  modified_base (199)..(199): a, c, t, g, unknown or other
  misc_feature (199)..(199): n is a, c, g, or t
  modified_base (242)..(242): a, c, t, g, unknown or other
  misc_feature (242)..(242): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggccaccctgtctttgtctccgagggganagacgcccaccctctcctgcgagggccagtcagactataggancagctactgcctggtaccagactaaaaccgtggaccaggcctcccgaggcctctactatttgtaggtcgccgtccaccgacgggccacgtcggacactcccgagacagtactcgaggtcggactacggtggtcgtacgtcggggactacggtaccttaccaccgttcgtacgtgtacgtaccggaacgtaacgtacgtaccggaaccccgtaacgtacggttacttttcggaccgttaggttacgtttaacgtttacgtacgttaacctaacgttacgttacggtttcggggtttacccgtttacccgggtacggttacggtaccgggtttacccgggaacccggtaaacgggggtaacccgtaaaggggttacggtaaacggttaccggtaaacggttaaccggttaaaccggttcgggttacgggtaccgttacggtaccccgtaacccgttaaccggttcccgttacggtttaccctttacccgttaccctttcccccgggttacccccgtaccgtttaacccgg

SEQ ID NO: 96331 - DNA, 542 bp, Homo sapiens
  misc_feature: GYAE6OF01EJS7L.38.27.C05.1.454.CMB.1.raw
  modified_base (381)..(381): a, c, t, g, unknown or other
  misc_feature (381)..(381): n is a, c, g, or t
  modified_base (410)..(410): a, c, t, g, unknown or other
  misc_feature (410)..(410): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccgaggggagagagccaccctctcctgcagggccagtcagactattaggagcagctattagcctaggtaccagcaaaaacctggccaggctcccaggctcctcatttatggtgcgtccaccaggggccactggcactcccagacagattcagtggcagtgcgtctgggacagtacttcactctcgtgatcgaanagactcggacccaagagtatttgcttgtnttaattctgtacaactactagtggtcttcggcgtggtaccgttcggccgtaacgggacctaaggtacggaagttacaagtacgaacgtgtggctgctacccagttctcgttcttactattcttcctgtaccc

SEQ ID NO: 96332 - DNA, 561 bp, Homo sapiens
  misc_feature: GYAE6OF01BTXNX.38.27.C05.1.454.CMB.1.raw
  modified_base (490)..(490): a, c, t, g, unknown or other
  misc_feature (490)..(490): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgcccaggcttccggatatatcttcgacttctactatttacactgggtgcgccaggtcccctggacaagggcctgagtggatgggatgcatcaaccccagaactggaccacacaagtctgcacgagtaagtttcgagggcagggtcaccgatcggacccgagaccaccgtccatacaatacacgcctaccgtgaacctcatcctaccctaaatcctagacgacgaccggtccgtactattactgtgacgagnggcagcgttaccgacttaggtactaggtcgtcgggttttacgagttcgttattttgtagtttcggtcgggg

SEQ ID NO: 96333 - DNA, 692 bp, Homo sapiens
  misc_feature: GYAE6OF01BHDPN.38.27.C05.1.454.CMB.1.raw
  modified_base (198)..(198): a, c, t, g, unknown or other
  misc_feature (198)..(198): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacggaccggagaaagtgtgttgacgcagtctccaggcacctgtctttgtctccgagggganagacgcccaccctctcctgcgagggccagtcagtactagttaggagcagtactacttacggccttaggtaccagaacctaaaaaccgtcggaccacggcctacccgaggtcctcctactagtttagtcggtcgccgtccgaccgacgggcctacgtcggacctactccgagacgagtacttcgaggtcggacgtacggtgtaccgtcgtacgggacacggtacttacgacttcgtcgtagtaccgtacgacgacgtaccgtacggaaccctaactacgttagtttcgtcgttagttacgttaacttacgttacgtacctaacgttacgttacggtttcggttccgttccgggtcggttaccggtaccggttacggaccggtaacgggtaccggtaacgggtacggtaacgtacgacggtacgtaccgtagggtcgtacgtcgaccgtcgacgtttcttacggttccttactaccgttcccgttcccgtcttacg

SEQ ID NO: 96334 - DNA, 804 bp, Homo sapiens
  misc_feature: GYAE6OF01DF9JF.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgcttactctggctcccagatacgacggagaaagtgtgtgacgcagtctccgaggcctacccttgtctttcgtcctaccgaggggagacgacgccctaccctctccgtggcgacgggccaagtcgacgtactagttaggacgcaggtcttaacgtgccctggaccagaccaaaaaccgtggaccaggcctacccgaggtcctccgtactacgtttacgtcgggttacgtccgttacccgaacccggacgggaccaacgttcgggacctaacgttccccgaagaaccagggtactttaccgaaggtcggactacggtcgtaacggtccgtagggaccgtaacgttaccgttccgtaacttccgtttaccgggtaacgtacggttccggaaaccgtaacgggtaccgtaacccgggtaaacccaacgttaaggtttaccgttttgtaacccgtttagggtttacttaacggtttacgtacgttaaacccgtaaacttacggtttacgtttaccggggttcttaacccgggtcgggtttaccgtaccggtttaccgggaccgtaaacggggtaaccgttaagggtacggaacgttacgtaaacgttccgtacggtacggtcggtaccgtgaccctaaccgtcgtttataccgtttacctacgttacccgtttcccttcccgcgttaacgg

SEQ ID NO: 96335 - DNA, 761 bp, Homo sapiens
  misc_feature: GYAE6OF01C97JB.38.27.C05.1.454.CMB.1.raw
  modified_base (195)..(195): a, c, t, g, unknown or other
  misc_feature (195)..(195): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgacggagaagtgtgttgacgcagtctcaggcaccctgtctttgtctccgagggganagacgccacccgtctccgtagcgagggcccagtaccagtacttaagttaggagcagctacttagccttaggaaccagaacaaaacctggaccgacggcctacccgacgtcctccgtactagtttatcggtcgaccgtaccgaaccgcggtaccacgtacggactaccgtacccgagaacgtaaggtacttcgaagggtcggactacggtcgtcgtcgtagggacctaggtaccttctaccgtcgttcgtagtacgtacgtacgacgtaaccgtacccgggaaaccctaacgtaaggttacttttacggtactttaggttacgtttaagtttaccgtacggttaacctaaaccgttacgtttaggttccggttaccgttacccgggttcggttaaccggttaccgggttacccgggaacgaaccggggtaaacgttacggggttaaggtaaccgttaacggaaacgttccgtaaaccggttaggaccggttactacgggtacctaaccgttacgttaccgttaacggtttcctacgttaccctttacccgttcccgtacgttaaccg

SEQ ID NO: 96336 - DNA, 795 bp, Homo sapiens
  misc_feature: GYAE6OF01BBXNW.38.27.C05.1.454.CMB.1.raw
  modified_base (198)..(198): a, c, t, g, unknown or other
  misc_feature (198)..(198): n is a, c, g, or t
  modified_base (243)..(243): a, c, t, g, unknown or other
  misc_feature (243)..(243): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaagtgtgttgacgcagtctccaggccaccctgtctttgtctccgagggganagacgcccaccctctccgtgcgaggccagtcagactagttaggancagctacttgcctggtaaccagaaccaaaaccgtcggaccacggcctacccgaggtcctcctatactttagtggtacgtcctacccgaccgaccggtacccacgtggaccactacccgaagtaacgagtacgttacgtacggtcggaccgtaggtcggtccgtcgtacggggtaacctaccgtaccttcctaccgttaccgtacggttagtaaccgtacggtaaccctaacggtacccgtacggaaaccctaacgtaggtttacgtttacgtcgttaggtttacgttacgttacttacggtaacctaaaccgttacgtttcggttaccggggtttccgttacccgggtaccggtttacggtaaccggttcccgggaaccgtaaccggggtaaccgtaacgggtaacgggaacgttaaccgtaaccggttaccggttaccgttacgggtacccgggtcgttccgggaacccctaaccggttacgttaccccgtttacgtttacccgttacccttacccgtttacccccgtccccggtaaccctttaaacccgg

SEQ ID NO: 96337 - DNA, 644 bp, Homo sapiens
  misc_feature: GYAE6OF01ESXXY.38.27.C05.1.454.CMB.1.raw
  modified_base (603)..(603): a, c, t, g, unknown or other
  misc_feature (603)..(603): n is a, c, g, or t
tcagtcgatcacgtcacgaccggtgctcgattttagacgcgatcgaagggtttgggggagctgctcagttaggacccagagggaaccatggaaaccccagcgcagcttctcttcctcctgctactctggctccagatacgaccggagaaagtgtgttgacgcagtctccaggcaccctgttctttgtctccgaggggagagagccaccctctcctgcgagggccagtcagacttagtaggagctacgctacgtacgccgtacggtaccaagactaaaaaccgtcggaccacgggcctacccgtacggcctacctactattttacgtggtcgtccgtaccgaccggacgggtcctacgtcggacctactcccgaagacgagtacttacgacggtcggcacgtcggcgtcgtacgggacacgtaccttctactcgtcgtagactacgactagtacctcggaaccaacgtagttacgtttgacgttgttagtacttacgtcgtactaacgtactaggtcggttacgtcggtcgtacgtacggttccggacggtaacggacgtaggtacgaacgttacaacgtacggtacgtgttcggtctgtaccncgtacgttcgtacgttcctacgttactcccgttccgctacg

SEQ ID NO: 96338 - DNA, 741 bp, Homo sapiens
  misc_feature: GYAE6OF01CHDC8.38.27.C05.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggccacccttgttctttgtctccgagggganagacgcccaccctntcctgcgagggccagtcagtactagtacggagcagtcttacgtacgccgttggtaaccacgaaccaaaaaccgtggaccgaggccctacccgaggtcctacctactagtttacgtggtcgtccgtacccgaccgacgggtcccacgtcggacctacctacccgtaagaacgtagtacttacgacgggtgaccgtaggtcggtaccgttcggttacgggaacctacggttaccctttacgtaaccgttccggttacggtgtaaccgtcgtaccgaacgtaccgtaccggaaacccctaagtacgtttacgttttacgacgtttagttactttactttacgtacgttaaccaaacgtacgttaggttcgggttcgttaccggtcggtacggttacccggttaaccgggaccggtaaacgggtaaccgtaagggtacgtaacgtactaacggtaccgtagtcggtcggtcgttaccgacgtaccgtactcgttacgttccgttacttacccttccgtacccgtcttacg

SEQ ID NO: 96339 - DNA, 669 bp, Homo sapiens
  misc_feature: GYAE6OF01EY8CZ.38.27.C05.1.454.CMB.1.raw
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggacgcccacctcccgaggtagaaattggtcctagtcgtgggtttggcgtggaggagccgtgggcctcgagtgtattcgtcccctgccgaggtccttcggatagtactcttcgacttcttactattactacgtgggtcgcgccgtacggtccctggacgaacgggccgtgaggtggagtgggatgacactacccaacccagacgtaggaccgacaacgaaacgtcacgacaacgacgtaacgttcgagggtacgacgggtcaccgatacggacccgagaccgtaccgtaccacgtactaacgtaacgacgtaccgtaccgtacggaacctaccgaccgtacccttaacctaaactaccgtacgaaccgaccgacccggtaccgtacttaacgttacgttgacggacgaggagccgtacgtacgttccgtacgttaggttaacgttaggttcggttacggttttacgtacgtttcgtttagttttcggttcggttcgggtaccgggg

SEQ ID NO: 96340 - DNA, 859 bp, Homo sapiens
  misc_feature: GYAE6OF01BFBBU.38.27.C05.1.454.CMB.1.raw
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtcgtgggtttggcgtgaggaagcgtggggctcgagtgattcgccctgccgaggcttccggatatatcttcgacttctactattacacgtgggtcacgccgacggtcccgtaggacgaaggggcctcggtaggcggaagtcgggtatggacactaccaaaccccgagaaccgtcgggaccgaaccgtaacgtaaaacggtccgtacggaccgtaacgtaacgggtaaacggtttacggaagggggtacccgtaaggggtacccaaaccggtacggttaccgggaaacccggaacggtaaccctaaccggttacccaacgttaaccgtaaacctaacccgtaaccggtacccgttaacccggtaaccggtaaacccgtaccgtaaaccgtaacccctttaaaccccgtaaaacgttacccgttaaccgggaacccgtaacccggtaaccccggggttaccccgtttaacgttttaaaccgttaaccggtttcggtaaccggtaccgggtaaccggggtacggttaaaccgtaccgggttaaacccgtttacccggtaaacgggtttaccgggttaaacgttaaacgggtttcgggttttaaccgggttttacgttacgtttcggtttacgtttttacgggtaaccgtttttcggggtaaacccggggg

SEQ ID NO: 96341 - DNA, 1070 bp, Homo sapiens
  misc_feature: GYAE6OF01DXGVP.38.27.C05.1.454.CMB.1.raw
tcagtcgatcacgtcacgaccggtgctcgatttagacgcgatcgaagggtttgggggagcatcacccagcaaccacatctgtcctctagagaactcccctgagagctccgttcctcaccatggactggacctgggaggatcgtcttcgttggtggcagcagtacaaaggacgcccacctcccgaggtagtaaagttcggtcctaggttccgttggggtttggcggttaggaacgggaacggtccggtcgggggtccctcgtaaggtgtacgtttccggtcccccgtcggccgtacgggtccgttacccgggtaattacgttacttccgtttccgtaaccttttaccttaacgtttaacttttaaccgtacggtttcggggtcgtcccggtaccgtaccgggttccccgtaggggaaccggtaacggggtccttagggtaacggttgggtaggttaggggtacgtaccgactaaccgtaccccaaaaccccgtaacggtaaccgtaccgggaaccgtaaaccgtaaaccggtaaacggttccgtaacggaacccgtaaacgttaacgggttaaaccggtttacggggaaaccggggtaccgggtaccgggttaacccgaacccggtaaacggttaccccgggaaacccccggtaacggtaaccccgttaaaccccggttaaccccgaaacgttaaccccgtaaaaaccgtacccgtaaccgggtaaccccccgtttaaacccgggttaaacccgggtaaaccccttacccggttaaacccgttaaccccccttttaaaaacccgggttaaacccgtttaacgggtaaacccggtaaaccccggtaaccccgggttaaaccccggggttcccttttaaacccggtttaccgttttaaccggttcggggtaaccgtaaccggggtacgggtaaccgtaacggttccggttaaaccggtttaccccgtaagggtttttacggtaaacgggttttacggttaccgggttttaccggttttacggtacgttttcggtttaaccgttttcggtttacgggttcggggtaacccgggg

SEQ ID NO: 96342 - DNA, 885 bp, Homo sapiens
  misc_feature: GYAE6OF01BDO1C.38.27.C05.1.454.CMB.1.raw
  modified_base (200)..(200): a, c, t, g, unknown or other
  misc_feature (200)..(200): n is a, c, g, or t
  modified_base (876)..(876): a, c, t, g, unknown or other
  misc_feature (876)..(876): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgttctttgtcctccgagggganagacgccaccctctcctgcacggccagtcagactagttaggagcagctacgttagcctcgtaaccgagaacctaaaaacccgtcggacccgacggtcctaccccgacggtaccttcccgtactacgttttagttacgggtcggtacccgttaccccgaacccggtacggggtacccctaccggttacgggacccttaacccgtaccccgtaacggtaacgaaacggtacgtttaccgacgggtaccgggtaccgtaacggttcgggaccggttacccgggttaggggaacccgtaaccggttaacccttttacccgtaacctttacccgggtaccggtttacggtaacggttaacccgggtaaaccgtaaccgggttaaccccggttaacccggggaaaccccctaaacgtttaacgggttttaaacttttccgggtaacgttttcggtttaaacgggtttaccttttaccggttaaccgggtttaacccaaaaccgttaccgtttaacgggttttaccggggtttcccgtttaccccggggttccggttaacgggttacccgggttacccgggaaccgtaacggggtaaccgtaaggggtacgtaacgtacgtacgtcgtaaacgtcggtacgtcgactacgaccttacgtcttacgtacttcctacgtttcccnccgtctacg

SEQ ID NO: 96343 - DNA, 890 bp, Homo sapiens
  misc_feature: GYAE6OF01DFWQH.38.27.C05.1.454.CMB.1.raw
tcagtcgatcacgtcacgaccggtgctcgatttagacgcgatcgaagggtttgggggagcatcacccagcaaccacatctgtcctctagagaactcccctgagagccttcccgttcctccaccatggactggaccgtggaggatcgttcttcgttggtggcagcagtacgaaaggaccgacccacctacccgaggtagtaaagttcggtacctaggttcggttggggtttggcggtaggacgggaacgtccggtcggggcctcgtaggtgtacgttccgtccccgtcggccgtacggttccgttaccggtattacttacgttccgttaccgttacctttacgttaaccttaacgttttaaccgtacggttcggggtaccgtcccggtaccggtaccgggttccccgtaggggaacccggtaacgggggtccgttagggtaacggggttacggggtaaggtaggggtacgtcgtaccgtaaacccgttaaccccgaaaccccggtaacggaccggtacggaaccgtaaccgtaaacgtaacgtccgtacgaaccgtaagtacggttaacggtacggacgggtaccgtaaccgggacctaaccggtacgtaccggaacccggacgtacccgtaaccgttaccgaacgtaacctaacgtaccgtaccgtacccgtaaccgtaacgtcctaaccgaacccgtaccctaaaccgtacgttaccgaaccggaacccgtaccgtaaccggttaccgttaccgtaacgttacggtacggacggacggtaggaccgtacgaaacggtttcccgtaacgtttacgggttaagttaggtttacggttaccggtttacgttcggtacgtttcgtttagtttcggttcgggtcggtaaccggg

SEQ ID NO: 96344 - DNA, 673 bp, Homo sapiens
  misc_feature: GYAE6OF01BM5OM.38.27.C05.1.454.CMB.1.raw
  modified_base (401)..(401): a, c, t, g, unknown or other
  misc_feature (401)..(401): n is a, c, g, or t
  modified_base (434)..(434): a, c, t, g, unknown or other
  misc_feature (434)..(434): n is a, c, g, or t
  modified_base (657)..(657): a, c, t, g, unknown or other
  misc_feature (657)..(657): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtctttcttggtggcagcagtcaaaggagcccactacccaggtgaaattcggtccagttcgtgggtttggcgtgaggagccgtgggctcagtgtattcgtccctgccgagtctcggatatatctcgtacttctacttacttacacgttgggtagcgcctacggtaccgtcggaacgaacgggtcctggacgtggagtagggactcggctactaccgaaccccgacgtaacgcggacgaaccaacgtaaagtctacgacgaanaacgtaacgtttcgaggggctagggaccaacgnggtacgacccgagtaccgacgtacctacgtacaactaaccgacgtacccgtaaccgtaccgtaaccgtacaccgtaacctaaccgtaaaccttacgtaccgaaccgtaccgaaccggtccgtaccgtttacgttacgttacgagaccgtaggacgcggtaacgtacgttaccgtgtttagtaacggtacgttcggttacggtttctaacgttgtttacgtttnttgtttcggtaccggg

SEQ ID NO: 96345 - DNA, 969 bp, Homo sapiens
  misc_feature: GYAE6OF01BVYB3.38.27.C05.1.454.CMB.1.raw
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (390)..(390): a, c, t, g, unknown or other
  misc_feature (390)..(390): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcacctgtctttgtctccgaggggagagagccaccctctacctgcgagggccagtcaggactattacggagtcagctactagcctaggtaccagacaaaaaccgtcggaccaggcctacccgaaggtcctccgtactattagtggtcgcgtccacgcggccacgtggacactccagacagntacnggtcgcgagtcgcgtcgtggactaagtccttacncttaccgtgttagactaccggtacgaacgtaaccgttacgggaaccccctaaagtacggttaacgttttccgtacgtttacggtaacgttttacgtttaacgttaaccgttaaccgtaaaacccggttaaccgttttaacggtttcccggggggttttaaccccgtttaccccggggggttaaccggtttaaccggggtttaacccccgggggtttttaacccgggaaacccccggggttaaaaacccgggggttaaacccgggtttaaaaccgggggtacgggggtttaaaacccggttaacgggttaaaacccggtttaaaccccggggttaaacgggtttttaccgggggttaaccccgggggttaccgggtttaaaccccgggtaaccccccgggttaaaaaccccgttttaaacccccggggttttttccccggggttttaacccgggtttttttaaaaaccccccccgtttttcccggggtttttaaaaccccccccgggtttttttcccccccgggtttttaaacccccccccggggggttaaacccccccctttttttaaaaccccggggg

SEQ ID NO: 96346 - DNA, 739 bp, Homo sapiens
  misc_feature: GYAE6OF01D4B0B.38.27.C05.1.454.CMB.1.raw
  modified_base (596)..(596): a, c, t, g, unknown or other
  misc_feature (596)..(596): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtacgaaaggacgcccactcccaggtagaattcggtccagtcgtgggtttggtgtgaggaagccgtggggcctcgagtgtagttcgtccctgccgaggtccttaccggatatactcttcgtacttctacttatttacacgttggtgccgcctacggtccctggaccgaaggggccttggaggtggagtgggatcggactactacccaacccgagaacgtcgggaccaacaacgtaaagtcctagaccaacgaacggttaacgtttcggaacggggtaccgtacgggttaccaaccgtaacggtcccggaacccggtaagaccgtaccgtaccaactacaaactaccgaactaccctaccgtaacgaacctcgacgtaccctaaccttaaactccgtaacgaccgaaccggtaccgtacccgttatttaaacttaccggngttacggacgggtaacggaccggtagtacgttaacccgttacccgttaaggtttagggttaacgttacgggtttcggttaccgggtttttacgaagttttcggtttacgttttttacgggtacgttttcggggtaacccgggg

SEQ ID NO: 96347 - DNA, 700 bp, Homo sapiens
  misc_feature: GYAE6OF01D3IWW.38.27.C05.1.454.CMB.1.raw
  modified_base (152)..(152): a, c, t, g, unknown or other
  misc_feature (152)..(152): n is a, c, g, or t
  modified_base (173)..(173): a, c, t, g, unknown or other
  misc_feature (173)..(173): n is a, c, g, or t
  modified_base (188)..(188): a, c, t, g, unknown or other
  misc_feature (188)..(188): n is a, c, g, or t
  modified_base (246)..(246): a, c, t, g, unknown or other
  misc_feature (246)..(246): n is a, c, g, or t
  modified_base (308)..(308): a, c, t, g, unknown or other
  misc_feature (308)..(308): n is a, c, g, or t
  modified_base (494)..(494): a, c, t, g, unknown or other
  misc_feature (494)..(494): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctgggaggatcgtcttcgttggnggcagctagtacgaaagggcnccctactccgaggtntaaagttcggtactagttcgtgggtttcggcgtggaggacgccgtggggcctgagtgnttcgtccctgccgaggtctcggatatctcttcgacttcttacttacttacgagttcgggtcnccgtacgtacggtccccgtaggaacggacgggtcgtggtagggtaggacgttgggattcgacctacgtacccaaccgagtacgcgacaacaacgtacgtcagaacaagtaggttaacgtcggaggtaccgtaggtacccaacggactacgggacccgacgtacctacgactacaaactacccgtanaccggtacttaacccgataaccgtcgtaactacctaacctaagttcgtaacgaaccggtaccgtacccgggtctaacgtttacgttacgtacggtacggacggaacgtaccgggtataccggttacgtttacccgtaaggttctaacggttagggtcgttttccctagggtactttcggtttaagtgttaacggttcggtacgggg

SEQ ID NO: 96348 - DNA, 742 bp, Homo sapiens
  misc_feature: GYAE6OF01CUW1Q.38.27.C05.1.454.CMB.1.raw
  modified_base (293)..(293): a, c, t, g, unknown or other
  misc_feature (293)..(293): n is a, c, g, or t
  modified_base (711)..(711): a, c, t, g, unknown or other
  misc_feature (711)..(711): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggacgcccactcccaggtgaaattggccagtcgtgggttggcgtgaggagccgtggggcctcgagtgattcgtcccctgccaggtcttccggattatattcttcgactttctactatttacagttgggtncgccacggtccctagggaacgaacgggcctggacggtggagtgggatcgactacgtaccgaaccccgagaaccgtcgggaccgaacaaccgtaaagtccgtacggaaccaacgtaaggtaaacggtttcgaacggggtaccacgggggttaccaaccgtaacggtaccgggaaccccggtaacggaaccctaaccgggttacccaactaaccgaaaacttaaccgaaccggtaccctaaccggttaacgggaaccctacgtaaccggtacccttaaacccttaaaacgtcgtaacggaacccgtaaccggtaacccgggtacccttaaccgttacgttaccggttggttaaccggacgaacggacggtacgacggttacgttacccgtagttaggtaagttagtcgggttacgtttanacgttgttactttagtcgtttcgggtacggg

SEQ ID NO: 96349 - DNA, 681 bp, Homo sapiens
  misc_feature: GYAE6OF01CMQAT.38.27.C05.1.454.CMB.1.raw
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (318)..(318): a, c, t, g, unknown or other
  misc_feature (318)..(318): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccgagggganagacgccaccctctcctgcagggccagtcagactagtaggncagctacttgcctggtaccagacaaaaacctggaccaggcctcccaggtcctccgtcatttatggtcgccgttccaccgngggcccacgtcggcactcccagacagtactcaagttcggcagtcgcgtcgtcgggacagtacctcgacctcgtcgtagtacttcgacagtaccgtacggaccctaacgacgttagtttcgccgtttagtacgttatttacgtgttactaacgtacgtacgttcgggttcctttccgggcttacgggtaccggtttccgggacccggtaaaggggtaccccgaaggggttacggaacgttaacgaaccgttacgtaaacggttgttaccgggtcttaccggtaaccctacccggttacgttccgtttaccggttacctttacccgtaacccgtttccccggttccccgtaacctttaacccggg

SEQ ID NO: 96350 - DNA, 742 bp, Homo sapiens
  misc_feature: GYAE6OF01DS7P5.38.27.C05.1.454.CMB.1.raw
tcagtcgatcacgtcacgaccggtgctcgatttagacgcgatcgaagggttttgggggaggctgctcagttaggacccagagggaaccatggaaaccccagcgcagcttctcttcctcctgcctactctgctccgagactacgaccggagaaagtgtgttgacgcagtctccaggcaccctgtctttcgctcgagggtagagacgccacctctcctgcacgggccagtcacgactagtaggagcgagcctacgttagccgtggtaccaagaacgaaaaccgtggaccaggcctccccgaggccttcctactatttacgtaggtcgccgtaccacgacggccaacgtcggacctacgtccccgaagtaaccacgtacttaccgaggttcggactaggtccgacggttacggtacggacgtacgtacttccgtaccgtcgtacgtacgacttcgaacgtacgaccgtacgaccccaaagtcgttacgtttcgcgttagttagttacttacgttacgttactaaacgtacgtacgtttcgggtacccttaccgggtcggttacggttcccggttacgggtaaccggtaacggggaccgttaaggggtaacggtaacgtaccgtaaaggtaccggtaacgttacggggtacggtccgttaacggtcccgtaaccgttacgtttcccgtaacggttttccctttaacgttacccgttttaccccggttccccgcgttttaaacccgg

SEQ ID NO: 96351 - DNA, 782 bp, Homo sapiens
  misc_feature: GYAE6OF01C3L22.38.27.C05.1.454.CMB.1.raw
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
  modified_base (769)..(769): a, c, t, g, unknown or other
  misc_feature (769)..(769): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctccagatacgacggagaaagtgtgttgacgcagtctccaggcaccctgtcttgctcgaggggangtacgccaccctntccgtgcgagggccagtcaagtactagtaggacgcacgtccttaactacgccgtacggaaccaagaaccgaaaaaccgtcggaccgaacggtcctacccgtaaccgggtccttaccttacttaacgtttaacgtcgggttacgtacccgttacccgaaccggtcggggaccccaacggtttccggacctaaccgtaccccgaacggaaccgtacgtaacgttacggtaacggttcgggacctaaggttcggaccggttacggacgggtaacctacgtaccgttccgaacctttcgtacggtacggtaactaccggaacgtacgtaccggtacgaaccccgtaaagttgtttacggtttacgcgttagggttaacgttaacgttacctagttaccaacgttaacgtagggtttaccggtgtacccgtcggttaacggtaccggtttcggaaaccggaacggtaaccgttagggtaacggacgtactaacgtacgtacgtagggtaccggtctaccggaactccccgtttatacccggtttattacccgttacctacgtttcccncccgtacgtacgg

SEQ ID NO: 96352 - DNA, 764 bp, Homo sapiens
  misc_feature: GYAE6OF01BOASH.38.27.C05.1.454.CMB.1.raw
  modified_base (219)..(219): a, c, t, g, unknown or other
  misc_feature (219)..(219): n is a, c, g, or t
  modified_base (283)..(283): a, c, t, g, unknown or other
  misc_feature (283)..(283): n is a, c, g, or t
  modified_base (733)..(733): a, c, t, g, unknown or other
  misc_feature (733)..(733): n is a, c, g, or t
  modified_base (748)..(748): a, c, t, g, unknown or other
  misc_feature (748)..(748): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgccttacctcgtgcctacccagtactaccggaccggaagtaagtgttgtcgacgcagtcctccgaggcctacccttgttcttttcgcctccggaagggganacgaccgcccctacccgttctccgtgaccggtacggccagtcaacggtacttaaggtacggacncgtacgtcctttaacgtaccggcccggttacggaccccaaagtaaaacccgaaaaaccgttcgggacccaaccggtccctacccggaacggtccctacccttagttaacgtttaggtcgggtacgccccggtacccgaaccgggtaccggggtacccctacggtacggtacccgtaccgtaccccaggtaaacccgtagttaccgtactgggttaccggagtacggtcggtcgtacggtacggtactacgttacgtacctcttccggtcgaagttccgaccgacgtaacgtaccggtaccgtaaccctaagttacgtttaacgttttcgaacgttggttaactttaacgttataccgtaacttacgtaacgttggtaccgtttccgtcgtcgtacgtcgtacgacggtaagacgtaggagaactcacgtcgtagtgacggctagcacgtnttcgtacttcctaancccgttctccgtatcg

SEQ ID NO: 96353 - DNA, 525 bp, Homo sapiens
  misc_feature: GYAE6OF01AXDDC.38.27.C05.1.454.CMB.1.raw
  modified_base (197)..(197): a, c, t, g, unknown or other
  misc_feature (197)..(197): n is a, c, g, or t
  modified_base (351)..(351): a, c, t, g, unknown or other
  misc_feature (351)..(351): n is a, c, g, or t
  modified_base (414)..(414): a, c, t, g, unknown or other
  misc_feature (414)..(414): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactataggagcagctacttagcctggtaccagcaaaaacctggaccacggctcccaggctcctcatttatggtgcgtccacacggccacgtgcactcccagacagatcagtggtcagtgcgtcngggacagtacttcactctcgtgatcgacagctgacccaacagtatttgctgtagtacttactntcaactactatggtcttcggcgttgtacgtcgcgtaacggaccaaggtggagtcgaatcgacgtgtcggtctagcaccgattctgttaccttctattccttcccgctaacg

SEQ ID NO: 96354 - DNA, 718 bp, Homo sapiens
  misc_feature: GYAE6OF01A47AG.38.27.C05.1.454.CMB.1.raw
  modified_base (197)..(197): a, c, t, g, unknown or other
  misc_feature (197)..(197): n is a, c, g, or t
  modified_base (241)..(241): a, c, t, g, unknown or other
  misc_feature (241)..(241): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctcaggcaccctgtctttgtctccgagggganagagccaccctctccgtgacgagggccagtcagactattaggancagctactagctggtacagacaaaaccgtggacacggactcccgaggccttcctactagtttagtcggtcgccgtaccaccgtaacgggcctacgtcggcctaacgtccaagacagtacttcgaggtcgacagtcgacgttcgacggaactaggtaccttacgacttcgtcgtcgatcgaacgtacgtacgtaccggaaccctaaagtacgttaagttttcgacttacggttaacgttacttttacgtacgttaacctaaaccgtacgtttaacgtcgggttttaccgtttcccgggtaagttcccgggttaacccgggttaccggtaacccgggtaaacgggtaaccgttaacgggttaacggaacgttaacgaaacgttaccgtaaacgttggtaccggtaccgtaggaccctaaccggtattaccggtacgtttccgttaccgtaacgtttccccgttacccgtagttaacccg

SEQ ID NO: 96355 - DNA, 784 bp, Homo sapiens
  misc_feature: GYAE6OF01CBGI3.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctccagatacgacggagaaagtgtgttgacgcagtctccaggcacctgtctttgtctccgaggggagagcgcccaccctctcctgcgacgggccagtcaagtacttaagtacggagcagctacttgccgtgtaccagaaccaaaaaccgtcggaccaaggcctaccgacggtcctccttactagtttacgtcggtacgtaccgtccgaaccggacggcccgaaccgttcggaccctacgtaccccgaagacctaaggttacttccgaaggttcggacgtaggtcgtcgtacggtacggactacggtaaccttcgtaaccgttcgttacggtacgtagttccgtaacacggtaccgtaccggaaccctaagtaacgtttaacgtttcgtacgttagttaacggttactttaacgtaccgttaactaaaccgtacggttacggtttcgggttccgtttaccgggtcggttaacggttacccgggttaccggtaaccgggtaaaccgggtaaccggtaaggggtttaacggaacgtttaaccgggaaattaccggggttaacgtacgggtacggtacctacggaacccttaacgtacgttaccgttaacggtttccttaacccgttaaccgttccccgttacccggtacccttaacggg

SEQ ID NO: 96356 - DNA, 703 bp, Homo sapiens
  misc_feature: GYAE6OF01BLD2P.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgaggggagagacgccaccctctcctgcgagggccagtcagactagttaggagcagtctactacgcctaggtaccagacaaaaaccgtcggaccgacggcctcccgacggtcctccttactatttagtcggttcgtccgtccgaccgacgggccacggtggccacgtcccaagacaggtacttcgaaggtcggaccgtaggtcggcgttacggtcgggtaacacgtaccgtttcaccgttccgtcggttgtaacgtaccggacgtacggaccgtaccggtaacccgaagtacggttacgttttcggtcgtttcggttacgttaactttacgtcgtacctaaactacgtttaggttcgggttccgttcggtcgtcggtaccggtccgggtaaccgtaacgggtaaccgtaagggtacgggtaacgtaaccgtaggtaccgtacggtcggtcggtcgtacggacctacgtcttcgtcgttaccttccgtacctttcccgttcccgccgtttaaccg

SEQ ID NO: 96357 - DNA, 718 bp, Homo sapiens
  misc_feature: GYAE6OF01CDRL4.38.27.C05.1.454.CMB.1.raw
  modified_base (636)..(636): a, c, t, g, unknown or other
  misc_feature (636)..(636): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggccacctgtctttgtcctcgaggggagagacgtcccacccttctcctgcgacgggccagtcagtactagttaggacgcagcttacgttacgcctaggtaaccacgaacctaaaaaccgtcgaccgacggccctacccgaggccttctactaagtttagtcggtacgtccgtaccacccggacggtccaacggtcggaccacgtacccagaactacgtacgttcagggttcgccgtagtcggtacgtcggtacggaactacgtacgttctacgtcgtcgtagtacgtcgacgacgtacgtacggaacccacgtaagttactttgtacttcgtagttattacgtacgtaacaacgttacgttaggtcgggtttaccgtaccggttcgtacgggttccggtaccgggaccggtaaacggggtacgtaaacgggtaggaaccgttacgaacggtacgtacggttacggnggtaccgtacggaccctaacgttcgttcccggttacgtttaccttacccgttacccgttccccgttcccgacccgtttacgg

SEQ ID NO: 96358 - DNA, 669 bp, Homo sapiens
  misc_feature: GYAE6OF01AXJMO.38.27.C05.1.454.CMB.1.raw
  modified_base (198)..(198): a, c, t, g, unknown or other
  misc_feature (198)..(198): n is a, c, g, or t
  modified_base (389)..(389): a, c, t, g, unknown or other
  misc_feature (389)..(389): n is a, c, g, or t
tcagtcgatcacgtcacgaccggtgctcgatttagacgcgatcgaagggtttgggggagctgctcagttaggacccagagggaaccatggaaccccagcgcagcttctccttcctcctgctactctggctcccagatacgaccggagaaagtgtgtgacgcagtctccaggcaccctgtctttgtctccgaggggganagacgcccaccctctcctgcagggccagtcagtactataggagcagcttactacgccgtggtaccaggaaccaaaaaccgtcggaccgacggccctacccgaggcctcccgtctactttagtcggttcgaccgtccgaaccgacggcctacgtcggactacctacccagacgtagtacttcgaggtcgganacggtcgccggtcggtagggaccaacggtcttacgaacttccgtacggtacgtacctacggactacggaacgtccggtaacccaactagttactttgtacttgtagttaccttacgtcgtacaactaacgtagttcggttactccgggtcgttacgaacggttcgaacccggtaagggtaacgtagggtagtacgtaacgtacggtagtaccgtggcggtaccgagtccgtaccgtacgttccgttcgttcccgttacacccgtttcctcccggtctacg

SEQ ID NO: 96359 - DNA, 639 bp, Homo sapiens
  misc_feature: GYAE6OF01CGMZW.38.27.C05.1.454.CMB.1.raw
  modified_base (328)..(328): a, c, t, g, unknown or other
  misc_feature (328)..(328): n is a, c, g, or t
  modified_base (454)..(454): a, c, t, g, unknown or other
  misc_feature (454)..(454): n is a, c, g, or t
  modified_base (592)..(592): a, c, t, g, unknown or other
  misc_feature (592)..(592): n is a, c, g, or t
  modified_base (607)..(607): a, c, t, g, unknown or other
  misc_feature (607)..(607): n is a, c, g, or t
  modified_base (632)..(632): a, c, t, g, unknown or other
  misc_feature (632)..(632): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccgaggccaccctgttctttgtcctccgagggggagagacgcccaccctctcctgcacgggccagtcaagacttattaggagcagctacttagcctaggtaccagaccgtaaaaaccgtggaccacggcctaccccgaaggtcctccctacgtatttacgngggttcgcccgtaccaccggtacgggccctaaccggtggaccctacgttaccccaaggtacaaggttacttcgaaggttcgacgtaggtcgcggtcgtagggactacgtacttcacttccgtgtanacgtacgacacgtactaccgaaccgtaatacgttatttcgcgttgttatgttactctacaactgtacttcggttcgtccggtgttcgtaccgtggaccgtaaggtacgaaggtgacgttacagtacgtacgtggtcgngtacgccgactactntcctccttacaccgttcctacccgnttaaccg

SEQ ID NO: 96360 - DNA, 759 bp, Homo sapiens
  misc_feature: GYAE6OF01C5ED3.38.27.C05.1.454.CMB.1.raw
  modified_base (160)..(160): a, c, t, g, unknown or other
  misc_feature (160)..(160): n is a, c, g, or t
  modified_base (422)..(422): a, c, t, g, unknown or other
  misc_feature (422)..(422): n is a, c, g, or t
tcagtcgatcacgtcacgaccggtgctcgatttagacgcgatcgaagggtttgggggagctgctcagttaggacccagagggaaccatggaaaccccagcgcagcttctccttcctcctgctactctggcctccagatacgaccggagaagtgtgtgacnctagtctccgaggcctaccctgtctttgtccgtcggaggggagagacgccctacccttctccgtcgacggacggtcctaagtacaagtaacgtaagttaggacgactacgtctaacgttacggaccgttacgaaccgaagaaaacctaaaccgtcggaccgacggtccctaccggacgtcctacccgtattaattacggcggtacgaccgtaccacggcggtcctacggtacgacgtacacccgtaagaactagtcgtacgngtcggagagttcggtccgtaggtacggctacgttacctcgtactcgtgtacgtacgtacgacgtacgtaaccgtaccggaacctagttacgtttagtacgttacgtagttacgtaacttcgtaccgtaacgtaacgtcgttacggtttcggttccggttacggtacggttaccgtaaccggggttcccggaaagggttaaccggggaaacgtttaacgggttaagtaccgtaaccggttaacgaaccgggttacgttcgggtaaccgcgttaacggccctttaaggtaccttcgttacgtttaacaccgtttccgttacccgacgttaccgtaacgg

SEQ ID NO: 96361 - DNA, 766 bp, Homo sapiens
  misc_feature: GYAE6OF01CB5YR.38.27.C05.1.454.CMB.1.raw
  modified_base (207)..(207): a, c, t, g, unknown or other
  misc_feature (207)..(207): n is a, c, g, or t
  modified_base (475)..(475): a, c, t, g, unknown or other
  misc_feature (475)..(475): n is a, c, g, or t
  modified_base (715)..(715): a, c, t, g, unknown or other
  misc_feature (715)..(715): n is a, c, g, or t
tcagtcgatcacgtcacgaccggtgctcgatttagacgcgatcgaagggtttgggggagctgctcagttaggacccagagggaaccatggaaaccccagcgcagcttctccttcctcctgctactctggctccagatacgaccggagaaagtgtgttgacgcagtctccgaggcaccctgttctttcgtcctccgaggggagagacncccgaccctctccctgccacgggcccagtccgaagtaaccttagttaggacgctaacggcttaaccgttacgcctacgggtacctaagacccgtaaaaaccgtcgggaaccgacggtacccttacccgaaccgggtccttacccttaccgttacgttttaacggttcgggtccggttccggttaacccgacccgttacgggtacccgaccgttccggaccgtaccgacccgtacgaccgtagtactacgtaggtcgacgtgtacggtntacggtcggacgtacgttacgtcctcgtaccttcgtacgtacgtaccgtacgtacggacgtaccggtaaccacgttaacgtttcgttaacgttcgttacgtagtttactaacgttacgttacccgtaatacgttacgttccggtttacgttaccgggcgttaccggacgtttacccgggaccgtacgggtaaccggtaagtacggaccgttagacccgagtacttacggcggtccgacgngtaccgtcgttacttccggttctaccgtaccttcccggtctccccggtacg

SEQ ID NO: 96362 - DNA, 1082 bp, Homo sapiens
  misc_feature: GYAE6OF01EEE43.38.27.C05.1.454.CMB.1.raw
  modified_base (59)..(59): a, c, t, g, unknown or other
  misc_feature (59)..(59): n is a, c, g, or t
  modified_base (107)..(107): a, c, t, g, unknown or other
  misc_feature (107)..(107): n is a, c, g, or t
  modified_base (246)..(246): a, c, t, g, unknown or other
  misc_feature (246)..(246): n is a, c, g, or t
tcagtcgatcacgtcacgaccggtgctcgatttagacgcgatcgaagggtttggggganctgctcagttacggaccaggaggaaccagtacggaaaccccagcgacngtactttctccttccgtcctacgcttactccgtcggtcctccagtaacgtacggaacggagtaaggttcgttgtcgacgtactcgtaccgacacgtcctccgttcgttacttccgtacgaccggtaagggcacgtaccncccgtaccttcgtaccgcggtacgtaccgggtacctaaggtactacgtaacgttacggtacgacggtactaccttaacgttacgtccgtcggaaccgtaacctaaacaaccgtaaccgtacggaaccgttaccgaccgttaccgtaccgtccttaacgtacgtttaagttcgtacggttaccgtaccgtaccgaccgtaaccggccgttcggtaccgtaccgtacccgtaacgtacgtaacgtacggttaaccgtacggccggtagtaaccggttccgtttacgggtaccggtacggtacccgtaacggtttcccgttaaaccgtttaacacgggtttacccggtaccggttaacggtaaccgtttaaccggaaccgggttacccgtaaaaccgggtaccccgttaaaaccggtttacgttacggtttttacgggttaccgttttacgggtaccgttttaacggtttacgttaaccgtttaaaccgttaaccgggttttaacccgggtttacgggtttttaacccggggtttttccgggtttaaaaccccccgggtttttaccggggtaaccccgggggtttttaaacccccggggttttaacccggggggtaaacccgggtttaaaacccccggggggttttaaacgggggttaaacccgggttaaggttaaacccggttaacgttaaccggggtttacccggtaaacggtttcccgggttaaccggtaaccgggtaccccggtttaagacccgtttaccgggtttttacccaaaccggtttcgtttaccccgttaaactccccgtttaccggttaacgtcccggtttaaacggg

SEQ ID NO: 96363 - DNA, 760 bp, Homo sapiens
  misc_feature: GYAE6OF01A5HTC.38.27.C05.1.454.CMB.1.raw
  modified_base (86)..(86): a, c, t, g, unknown or other
  misc_feature (86)..(86): n is a, c, g, or t
  modified_base (333)..(333): a, c, t, g, unknown or other
  misc_feature (333)..(333): n is a, c, g, or t
  modified_base (434)..(434): a, c, t, g, unknown or other
  misc_feature (434)..(434): n is a, c, g, or t
tcagtcgatcacgtcacgaccggtgctcgatttagacgcgatcgaagggtttgggggagcatcacccagcaaccacatctgtcctntagagactcccctgagagctccgttcctcaccagtggacgtggtacctgggaggacttcggttctttcgttgggtggctaggctagtacgaaagggacgccctacctcccgaggtagtaaagttcggtcctaggtcgttggggtttgggcgtaggaaggtaacggccgtgggtcctctagtcgtagttccgtccctcgccgagtccgtacgtatatacttcttacgtactttctactttacgttacncgttggtccgccgtacgtcggtcccgtaggacggtacggtccgtggacggtaggacgtgggtactcggaccactacccgaaccgtacgacgtacgacgaanacgtaagtcgtacataacgtaggttaacgtccggacggtacggaaccggtccgaaccgtacgtacccggtaacccgaacggtacccgtaacccgttcgaaccttaaccgtaaacgtacccgtaacccgttaacccgtacccggaccgtaacccttagggtaaccccttaaccgtaacctaagttacccgacgtaaccggaccgtaccgttacccgtacgttacgtacgttcggaccgtacgaccgtcgtaacgtacgttcgtacgtacggtagttaacggtcggttccgttaggttctacgttcgttgtttcggtacgtcgggtcg

SEQ ID NO: 96364 - DNA, 892 bp, Homo sapiens
  misc_feature: GYAE6OF01AICH9.38.27.C05.1.454.CMB.1.raw
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtacaaaagggcgcccacctcccgaggtagtaaagttcggtacctaggttcggttggggttttggcggtaggaacgggtaacggtccggtcggggtcctcgaggttcgttacggtttcccgtcccccgttgcccggtacggttcccgttaccgggaatttaacttactttccgtttaccgttacctttccttaactttactttaaccgtacggttgggggtcgcccggtacccgtcgggttccccgtagggtaaccggtaacgggggtcctagggtaggtcgggtaaggtgggtacgtacgtaccgtaccgttaacccccgaaaccccgtaacggaaccggtacggaacccgtaaaccgaaccggttaaagtcccgacggaacctaaacggtaacggttaaacggtttcggaacgggtaccgtacgggtaccccaacgtaacggtacccggaacccgggtacgtaaccgtacccgtacctaaccgttaacctaaacgtacccgtacgtacccacggttaaccgtaccgttaccgacgttaacccctaaccgtaaacgtccgtaaccggtaaccgtacccggttaccggttacccttacgtttaaccgttcggttacggtaccgggaggtaacggtacgaccgttaacggtacccgttaccgttaggttaggtacgtttaacggttcggttacgttagttcgttcgttacgtttggtttccgttcggggtacccgg

SEQ ID NO: 96365 - DNA, 708 bp, Homo sapiens
  misc_feature: GYAE6OF01B1M7L.38.27.C05.1.454.CMB.1.raw
  modified_base (180)..(180): a, c, t, g, unknown or other
  misc_feature (180)..(180): n is a, c, g, or t
  modified_base (251)..(251): a, c, t, g, unknown or other
  misc_feature (251)..(251): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatgactggacctggagatcgtcttcttggtgcagctagtcaaaggagcccacgtcccaggtnaaacgttcggtactagtcgttgggttggcgtgaggaagccgtgggcctcagtgtattcgtcccctgaccgngtccttaccggatagtatcttcgtacttctacttattactacgtggtcgaccgccgtaacggtcccctagggacgtaacgggcttgggagtggaagtgggtagtcgcacctacccaacccgaagtacctagggacccaacaacgtaaatccgagacctacgtaaggtacttaggacgggacacgggttaccacgtagtaccgaacccggtagaacccgtaacgtaccgaaccgtactaaaccgtaaccgaacccgttcccgtaacggtaccggtaaacgtcccaaccgttacccgtaaccctaaacgttccgaacgaccgtaacgacccggttaccgttaacttcgtactacggtcgagaagtagacgtacgggtaccttcggtacgttacggtacggtttacgttggttacccgttttagatttcggttacttttacgttcggttcggttaccggg

SEQ ID NO: 96366 - DNA, 172 bp, Homo sapiens; identical to SEQ ID NO: 96264
  misc_feature: GYAE6OF02F0F9F.38.27.C05.1.454.CMB.1.raw
  modified_base (172)..(172): a, c, t, g, unknown or other
  misc_feature (172)..(172): n is a, c, g, or t

SEQ ID NO: 96367 - DNA, 603 bp, Homo sapiens
  misc_feature: GYAE6OF02IZSHF.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagacaaaaacctggccaggctccaggcctcctctattatggtgcgtccaccgagggccacgtggcactcccgagacagacttcagtcggcagtgcgtcgtgggacagtacttcactctcgtgactcgacagacgtacggaacccaagagtatttgcttgtagtacttactgtacaacatagtgggtaccttccgggcgtggtaccggttcggaccgaaacgggaccgaagggttacggaacgttacaagttacccggaagttcggtacggtaccgttagaccgtaacctacgttccgttacggttacctttacgtaacgtttcccgttaccccggtaccttaacg

SEQ ID NO: 96368 - DNA, 505 bp, Homo sapiens
  misc_feature: GYAE6OF02IYF3M.38.27.C05.1.454.CMB.1.raw
  modified_base (239)..(239): a, c, t, g, unknown or other
  misc_feature (239)..(239): n is a, c, g, or t
  modified_base (392)..(392): a, c, t, g, unknown or other
  misc_feature (392)..(392): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagcccaccctctcctgcagggccagtcagactattaggancagctacttagcctggtaccagcaaaacctggccaggctcccaggctcctcatttatggtgcgtccaccagggccactggcatcccagaccagattcagtggcagtgcgtctgggacagacttcactctcgtgatcgacagactggacccaanagtattttgctgtgtattactgttcaacactatgggtctcggcgtgacgttcggcaagggccaaggtgaagtcaatcgatgtcggctgcacatctgtcttcatcttccgctac

SEQ ID NO: 96369 - DNA, 503 bp, Homo sapiens
  misc_feature: GYAE6OF02ICWGZ.38.27.C05.1.454.CMB.1.raw
  modified_base (431)..(431): a, c, t, g, unknown or other
  misc_feature (431)..(431): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccaggggagagagccaccctctcctgcagggccagtcagactattaggagcagctacttagcctggtaccagcaaaaacctggccaggctcccaggctcctcatttatggtgcgtccaccagggccactggcatcccagacagattcagtggcagtgcgtctgggacagacttcactctcgtgatcgacagactggacccaacagattttgctgtgtattactgtcaacactatggtcttcggngtgacgttcgccaagggccaaggtggaagtcaatcgactgtggctgcaccatctgtcttcatcttccgctac

SEQ ID NO: 96370 - DNA, 503 bp, Homo sapiens
  misc_feature: GYAE6OF02H5Q3B.38.27.C05.1.454.CMB.1.raw
  modified_base (434)..(434): a, c, t, g, unknown or other
  misc_feature (434)..(434): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggctcctcatttatggtgcgtccaccagggccactggcatccccagacagattcagtggcagtgcgtctgggacagacttcgactctcgtgatcgacagactggacccaacagattttgctgtgtattactgtcaacactatggtcttccgngtgcgttcgcaagggcaaggtgaagtcaatcgactgtggctgcaccatctgtcttcgatctcccgctac

SEQ ID NO: 96371 - DNA, 177 bp, Homo sapiens
  misc_feature: GYAE6OF02GIM3E.38.27.C05.1.454.CMB.1.raw
  modified_base (173)..(177): a, c, t, g, unknown or other
  misc_feature (173)..(177): n is a, c, g, or t
tcagtcgatcacgtcacgaccggtgctcgatttagacgcgatcgaagggtttgggggaaggaggaagactgacggtcccccaggagttcaggtgctgggcacagcggccctgggctgcctggtcaaggactacttccacgtgatcgactgagcgggctggcaaggcgcatagnnnnn

SEQ ID NO: 96372 - DNA, 528 bp, Homo sapiens
  misc_feature: GYAE6OF02H5R0I.38.27.C05.1.454.CMB.1.raw
  modified_base (349)..(349): a, c, t, g, unknown or other
  misc_feature (349)..(349): n is a, c, g, or t
  modified_base (390)..(390): a, c, t, g, unknown or other
  misc_feature (390)..(390): n is a, c, g, or t
  modified_base (524)..(524): a, c, t, g, unknown or other
  misc_feature (524)..(524): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctccaggctcctcatttatggtgcgtccaccagggccactggcatcccagacagattcagtggcagtgcgtcngggacagactcactctcgtgatcgacagactggaccccaanagaattttgcttgtgttattactgtactaactacttagtggtcttccgggcgttgaccgttcgaccgaagggacctaaggtggaaagtcgaagtcgaacgtgtggctgcacctatctgtctctactcttcccgntacg

SEQ ID NO: 96373 - DNA, 508 bp, Homo sapiens
  misc_feature: GYAE6OF02G441S.38.27.C05.1.454.CMB.1.raw
  modified_base (391)..(391): a, c, t, g, unknown or other
  misc_feature (391)..(391): n is a, c, g, or t
  modified_base (434)..(434): a, c, t, g, unknown or other
  misc_feature (434)..(434): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggctcctcatttatggtgcgtccaccagggccactggcatcccagacagattcagtggcagtgcgtctgggacagacttcactctcgtgatcgacagactggacccaanagattttgctgtgtattactgtcaacactatgggtcttccggngtgacgttcgccaagggaccaaggtggaagtcaagtcgactgtggctgcacatctgtcttcatccttccgctac

SEQ ID NO: 96374 - DNA, 514 bp, Homo sapiens
  misc_feature: GYAE6OF02FVVDF.38.27.C05.1.454.CMB.1.raw
  modified_base (300)..(300): a, c, t, g, unknown or other
  misc_feature (300)..(300): n is a, c, g, or t
  modified_base (391)..(391): a, c, t, g, unknown or other
  misc_feature (391)..(391): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggctcctcatttatggtncgtccaccagggccactggcatcccagacagattcagtggcagtgcgtctgggacagacttcactctcgtgatcgacagactggacccaanagtattttgcttgtgtattactgtcaactctatgggtcttccggcgtgacgttcggccaagggaccaaggtggaagtcaagtcgtacgtgtggctgcaccatctgtcttcatcctcccgctac

SEQ ID NO: 96375 - DNA, 515 bp, Homo sapiens
  misc_feature: GYAE6OF02GGMGB.38.27.C05.1.454.CMB.1.raw
  modified_base (197)..(197): a, c, t, g, unknown or other
  misc_feature (197)..(197): n is a, c, g, or t
  modified_base (391)..(391): a, c, t, g, unknown or other
  misc_feature (391)..(391): n is a, c, g, or t
  modified_base (417)..(417): a, c, t, g, unknown or other
  misc_feature (417)..(417): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagcaaaaacctggccaggctcccaggctcctcatttatggtgcgtccaccagggccactggcatcccagacagattcagtggcagtgcgtctgggacagacttcactctcgtgatcgacagactggacccaanagattttgctgtgtattactgtcaanactatgggtcttccggcgttgacgtttcggccaagggacccaagggtggaaagtcaatcgactgtggctgcaccatctgtcttcatccttcccgctac

SEQ ID NO: 96376 - DNA, 511 bp, Homo sapiens
  misc_feature: GYAE6OF02HWP0Y.38.27.C05.1.454.CMB.1.raw
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (325)..(325): a, c, t, g, unknown or other
  misc_feature (325)..(325): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
  modified_base (414)..(414): a, c, t, g, unknown or other
  misc_feature (414)..(414): n is a, c, g, or t
  modified_base (473)..(473): a, c, t, g, unknown or other
  misc_feature (473)..(473): n is a, c, g, or t
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
tcagtcgatcacgtcacgaccggtgctcgatttagacgcgatcgaagggtttgggggagctgctcagttaggacccagagggaaccatggaaacccagcgcagcttctcttcctcctgctactctggctcccagatacgaccggagaaagtgtgttgacgcagtctccaggcaccctgtcctttgtctccaggggagagagccaccctctcctgcagggccagtcagactattaggagcagctacttagcctggtaccagcaaaaacctggaccaggctccaggctcncatttangtncgtcaccaggccactgcatcccagacngattcagtggcagtgcgtcagggacagacttcactctcgtgatcgacanacnggacccaacagaattttgctgtgtattactgttcaanactatggtctcggctgacgttcgccgaaggccaagtggaatcgaatccgaatcgtaggntacgnacctaanctcgtcttcctaatcttccccgctac

SEQ ID NO: 96377 - DNA, 529 bp, Homo sapiens
  misc_feature: GYAE6OF02HE3AK.38.27.C05.1.454.CMB.1.raw
  modified_base (413)..(413): a, c, t, g, unknown or other
  misc_feature (413)..(413): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactatttacactgggtgcgccaggtccctggacaagggcctgagtggatgggatgcatcaacccagaactggcacacaaagtctgcacagaagtttcagggcagggtcacatgacccgagacacgtccatcaatacagcctaccnggaactcagctaccctaaatctgacgacacggccgtactattactgtcgcgagacggcagagttccacgttggtataagtgtcggttttcgagttgcttttgtactttgtacgggg

SEQ ID NO: 96378 - DNA, 521 bp, Homo sapiens
  misc_feature: GYAE6OF02GRL46.38.27.C05.1.454.CMB.1.raw
  modified_base (407)..(407): a, c, t, g, unknown or other
  misc_feature (407)..(407): n is a, c, g, or t
  modified_base (498)..(498): a, c, t, g, unknown or other
  misc_feature (498)..(498): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggctcctcatttatggtgcgtccaccagggccactggcactcccagacagattcagtggcagtgcgtctgggacagacttcactctcgtgatcgacagactggacccaacagtattttgcttgtnttattactgttacaactactatggtcttccgggcgttgaccgtttcggaccaagggaccaaggtggaaagtcaatcgactgtggctgcacntctgtcttcattcctccgctacg

SEQ ID NO: 96379 - DNA, 532 bp, Homo sapiens
  misc_feature: GYAE6OF02HOH9S.38.27.C05.1.454.CMB.1.raw
  modified_base (396)..(396): a, c, t, g, unknown or other
  misc_feature (396)..(396): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagacaaaaacctggccaggctcccaggctcctcatttatggtgcgtccaccgacgggccactggcatcccagacagattcagtggcagtgcgtctgggacagacttcactctcgtgactcgacagactcggacccaanagtattttgctgtgtattactgtacaacacttagtcggtcttccgggcgtaggtacgttcggaccgaacgggacctaagggtcggaaatcgaatcgactgtggctgcaccatcgtgtcttctactccttccgctac

SEQ ID NO: 96380 - DNA, 517 bp, Homo sapiens
  misc_feature: GYAE6OF02IUAJ7.38.27.C05.1.454.CMB.1.raw
  modified_base (197)..(197): a, c, t, g, unknown or other
  misc_feature (197)..(197): n is a, c, g, or t
  modified_base (392)..(392): a, c, t, g, unknown or other
  misc_feature (392)..(392): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagcaaaaacctggccaggctcccaggctcctcatttatggtgcgtccaccaggggccactggcatcccagacagattcagtggcagtgcgtctgggacagacttcactctcgtgatcgacagactggacccaanagtatttgctgtgtattactgtacaacacttatgggtctccggcgtgtacgttcggccaagggaccaagggtggaagtcgaagtgactgtggactgacaccatctgtcttcattccttccgctac

SEQ ID NO: 96381 - DNA, 510 bp, Homo sapiens
  misc_feature: GYAE6OF02G4CWA.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggctcctcatttatggtgcgtccaccagggccactggcatcccagacagattcagtggcagtgcgtctgggacagacttcactctcgtgatcgacagactggacccaacagattttgctgtgtattactgtcaacactatgggtcttccggcgtgacgttcggccaagggaccaagggtggaagtcgaatcgactgtggctgcacatctgtcttcatcttcccgctac

SEQ ID NO: 96382 - DNA, 525 bp, Homo sapiens
  misc_feature: GYAE6OF02GAPZI.38.27.C05.1.454.CMB.1.raw
  modified_base (238)..(238): a, c, t, g, unknown or other
  misc_feature (238)..(238): n is a, c, g, or t
  modified_base (441)..(441): a, c, t, g, unknown or other
  misc_feature (441)..(441): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggancagctacttagcctggtaccagacaaaaacctggccaggctcccaggctcctcatttatggtgcgtccaccagggccacgtggcatcccagacagattcagtggcagtgcgtctgggacagacttcactctcgtgatcgacagactcggacccaagagtagttttgcttgtgtaattactgtacaactactatgggtctcggngtgacgttcgacaagggacaaggtgaagtcaagtcgactggtacggctcgcaccattctgttcttctcttccttcccgactacg

SEQ ID NO: 96383 - DNA, 589 bp, Homo sapiens
  misc_feature: GYAE6OF02G8BVP.38.27.C05.1.454.CMB.1.raw
  modified_base (285)..(285): a, c, t, g, unknown or other
  misc_feature (285)..(285): n is a, c, g, or t
  modified_base (359)..(359): a, c, t, g, unknown or other
  misc_feature (359)..(359): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtcttggtttggcgtgaggaagcctggggcctcagtgattgtcccctgccaggcttccggatatatcttcgacttctactattacactgggtncgccaggtccctggacaagggcctgagtggagtgggatggcataccaaccccagaacgtggacacaacaagtcngacacagtaagttcgaggcaggtcaccgagtcgaccgagacacgtcatacaatacacacctactggaacctcacgacctacctaaatcagacacgaccggtccgtacttacttacgtgtcgacggtagacggacgaggttacgttaccgtacgtttacggtaagttaaggttcggttacggttttacgacgtttcggtttccgtttttaggttacgtttcggtacggggg

SEQ ID NO: 96384 - DNA, 499 bp, Homo sapiens
  misc_feature: GYAE6OF02GQQFM.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggctcctcatttatggtgcgtccaccagggccactggcatcccagacagattcagtggcagtgcgtctgggacagacttcactctcgtgatcgacagactcggacccaacagtatttgctgtgtattactgtcaacactatggtctcggctgacgttcgcaaggaccaaggtgaatcaatcgatgtggctgcacatctgtctcatcttcccgctacg

SEQ ID NO: 96385 - DNA, 510 bp, Homo sapiens
  misc_feature: GYAE6OF02FW2VX.38.27.C05.1.454.CMB.1.raw
  modified_base (297)..(297): a, c, t, g, unknown or other
  misc_feature (297)..(297): n is a, c, g, or t
  modified_base (394)..(394): a, c, t, g, unknown or other
  misc_feature (394)..(394): n is a, c, g, or t
  modified_base (491)..(491): a, c, t, g, unknown or other
  misc_feature (491)..(491): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagcccaccctctcctgcagggccagtcagactattaggagcagctacttagcctggtaccagcaaaaacctggccaggctcccaggctcctcatttanggtgcgtccaccagggccactggcatccccagacagattcagtggcagtgcgtctggggacagacttcactctcgtgatcgacagactggacccaanagattttgctgtgtattactgtcaacactatggtcttcggctgacgttcggcaagggaccaaggtgaagtcaagtcgaacgtgtggctgcaccatcngtcttcatccttccgctac

SEQ ID NO: 96386 - DNA, 631 bp, Homo sapiens
  misc_feature: GYAE6OF02JTAH2.38.27.C05.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccagggganagagccaccctctcctgcagggccagtcagactataggagcagctacttagcctggtaccagacaaaacctggccaggctcccaggctcctctatttatggtgccgtccaccgtagggcccacgtcggcactcccagacagacttcgagtgcagtgcgtgtgggacagtcttcgactctcgtagactcgacacgacgtacggaaccctaacgagtattttcgcgttaggttagttaacttacgtacggttacaaacctacgttagttcgggttacctttcccgggtacggttagtacccggtttaccggacccgaaaggggtacccgtaaggggttacggaaacggttacaacgttaccgaacgttggtacggcttacggacctacccgtaagtcgttacgttccttacgtaccttcccgttacccgcttaaccg

SEQ ID NO: 96387 - DNA, 549 bp, Homo sapiens
  misc_feature: GYAE6OF02IEAB3.38.27.C05.1.454.CMB.1.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (393)..(393): a, c, t, g, unknown or other
  misc_feature (393)..(393): n is a, c, g, or t
  modified_base (425)..(425): a, c, t, g, unknown or other
  misc_feature (425)..(425): n is a, c, g, or t
  modified_base (541)..(541): a, c, t, g, unknown or other
  misc_feature (541)..(541): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccagggganagagccaccctctcctgcagggcctagtcagacctattaggagcagcttactagcctggtaccagcaaaacctgccaggctccaggctcctcatttanggtncgtccaccaggccactcggcagtcccagacagattcagtgcagtgcgtcgtggactagacttcgatctcgtgactcgacagactggacccaacgngtaacttttgctgtgtacgttactgtactaanacctagttcgggtctccggcgttagaccgttcgggcctaagggaccaggtggaaatcgaattcgactggtacggctacgtcaccgtactcgtacgtccgttacacttcctccccgngttaaccg

SEQ ID NO: 96388 - DNA, 651 bp, Homo sapiens
  misc_feature: GYAE6OF02GQ8NE.38.27.C05.1.454.CMB.1.raw
  modified_base (199)..(199): a, c, t, g, unknown or other
  misc_feature (199)..(199): n is a, c, g, or t
  modified_base (395)..(395): a, c, t, g, unknown or other
  misc_feature (395)..(395): n is a, c, g, or t
tcagtcgatcacgtcacgaccggtgctcgatttagacgcgatcgaagggtttgggggagctgctcagttagggacccagaggggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagcaaaaacctggccaggctcccaggctcctcatttatggtgcgtccaccagggccactggcatcccagacagattcagtggcagtgcgtcgtgggacagacttcactctcgtgatcgacagactggaacccaanagtattttgcttgtgttattactgttacaactacttagtcgggttctttccgggcgttaggtaccggttttaccgggacccgtaaagggggtaaccctaaaggggttacgggtaaacggttaccgtaaacgttaccggtaaacgttcgggttacggggaccgtttacgggacccgtaaacccgttaacgtttcccgtttacggtttacccgttttaccgtaacttttccccgtttacccccggtcccttaacccgg

SEQ ID NO: 96389 - DNA, 550 bp, Homo sapiens
  misc_feature: GYAE6OF02G847L.38.27.C05.1.454.CMB.1.raw
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (391)..(391): a, c, t, g, unknown or other
  misc_feature (391)..(391): n is a, c, g, or t
  modified_base (440)..(440): a, c, t, g, unknown or other
  misc_feature (440)..(440): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggancagctacttagcctggtaccagcaaaaacctggccaggctccaggctcctcatttatggtgcgtccaccagggccactggcatcccagacagattcagtggcagtgcgtctgggacagacttcactctcgtgatcgacagactcggacccaanagtattttgcttgtgtaattactgtacaactactagtcggtcttccggngtcggtacgttcggaccgtaagggacctaagggtacggaagtacgaagtcggtaacgtggtacggctacgacctacctagtcgtcgtcttcgacttccgttcccgctacg

SEQ ID NO: 96390 - DNA, 540 bp, Homo sapiens
  misc_feature: GYAE6OF02IAIYJ.38.27.C05.1.454.CMB.1.raw
  modified_base (197)..(197): a, c, t, g, unknown or other
  misc_feature (197)..(197): n is a, c, g, or t
  modified_base (355)..(355): a, c, t, g, unknown or other
  misc_feature (355)..(355): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtacagacaaaaacctggaccaggctcccacggctcctcatttatcggtgcgtccaccgacgggccactggcatcccagacagattcagtggcagtgcgtcngggacagacttcactctcgtgactcgacagactacggacccaacagatttgctgtagtattactgtacaacactattgggtcttccggcgtgtaccgttcgaccgaacgggacctaagggtcggaaagtcaagtcgaactggtggcgtgccacctatctgtcttcctacttccttacccgctacg

SEQ ID NO: 96391 - DNA, 578 bp, Homo sapiens
  misc_feature: GYAE6OF02GHJ5K.38.27.C05.1.454.CMB.1.raw
  modified_base (196)..(196): a, c, t, g, unknown or other
  misc_feature (196)..(196): n is a, c, g, or t
  modified_base (394)..(394): a, c, t, g, unknown or other
  misc_feature (394)..(394): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctccagatacgaccggagaaagtgtgttgacgcagtctccaggcaccctgtctttgtctccagggganagagccaccctctcctgcagggccagtcagactataggagcagctacttagcctggtaccagcaaaaacctggccaggctcccaggctcctcatttatggtgcgtccaccgagggccactggcactcccagacagattcagtggcagtgtgtcgtgggacagtacttcactctcgtgatcgacagactcggacccaangtatttgcttgtgtattctagtacaactacgttagtgggttccttccgggtcgttggtaccgttccgggaccgtaacggggtaccgtaagggtagaaacgttaccgaagttacgaacgttggtacggtctagaccgaaccgtagttccgtcgttccttcctaacgttcccttcccgaccttacg

SEQ ID NO: 96392 - DNA, 175 bp, Homo sapiens
  misc_feature: GYAE6OF02F964A.38.27.C05.1.454.CMB.1.raw
  modified_base (172)..(175): a, c, t, g, unknown or other
  misc_feature (172)..(175): n is a, c, g, or t
tcagtcgatcacgtcacgaccggtgctcgatttagacgcgatcgaagggtttgggggaagaggaagactgacggtcccccaggagttcaggtgctgggcacagcggccctgggctgcctggtcaaggactacttccacgtgatcgactgagcgggctggcaaggcgcatagnnnn

SEQ ID NO: 96393 - DNA, 563 bp, Homo sapiens
  misc_feature: GYAE6OF02H9KTY.38.27.C05.1.454.CMB.1.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
  modified_base (350)..(350): a, c, t, g, unknown or other
  misc_feature (350)..(350): n is a, c, g, or t
  modified_base (557)..(557): a, c, t, g, unknown or other
  misc_feature (557)..(557): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctattagcctggtaccagcaaaaacctggccaggctcccaggctcctcatttatggtnccgtccaccagggccactggcactcccagacagattcagtggcagtgcgtntgggacagactcactctcgtgatcgacagactcgggaacccaacagtattttgctgttagtatttactcgtacaacacgtattgggtacttccgggcgttcggtacggtttccggaccgtaaggggaccctaaaggggtggaaagtaccaagttccgaactggtggctacggcacctatccgttgtccttactacttcttcccccgntaaccg

SEQ ID NO: 96394 - DNA, 506 bp, Homo sapiens
  misc_feature: GYAE6OF02G4Y0X.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggctcctcatttatggtgcgtccaccagggccactggcatcccagacagattcagtgcagtgcgtctgggacagacttcactctcgtgatcgacagactcggacccaacagtatttgctgtgtattactgtcaacactatggtcttcggcgtgacgttcggcaaggacgaaggtggaagtcaatcgactgtggctgcacctagtctgtcttcatcttccgctac

SEQ ID NO: 96395 - DNA, 542 bp, Homo sapiens
  misc_feature: GYAE6OF02FSZ94.38.27.C05.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagcaaaaacctggccaggctcccaggctcctcatttatggtgcgtccaccagggccactggcactcccagacagattcagtggcagtgcgtctgggacagacttcactctcgtgatcgacagactcggacccaacagtattttgcttgtgtattactgtacaactactagtgggttcttccggcgttgtaccggttccggaccgaagggtacctaagggtggaacgtcaagtcgaactggtacggtctgccacctattctgtcttctactccttcccgcctacg

SEQ ID NO: 96396 - DNA, 685 bp, Homo sapiens
  misc_feature: GYAE6OF02JY5DG.38.27.C05.1.454.CMB.1.raw
  modified_base (197)..(197): a, c, t, g, unknown or other
  misc_feature (197)..(197): n is a, c, g, or t
  modified_base (365)..(365): a, c, t, g, unknown or other
  misc_feature (365)..(365): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctaggtaccagacaaaaaccgtggaccaggcctcccaggcctccctcatttagtaggtcgcgtccgaccaggccacgtggcatcccagacagactcagtggacaggtcgacgtcngggacagtacttcgactcgtcgtgacgtacgacgtagaccgttacgggaccccaaacgtaggtaactttttggccttggttacgttaactttacggtgttacaaacctacgttagtcgggtttaccttcccgggtcgttacggtaacccggttcgggtacccgtaaacggggtaaccctaagggggttacggtaaaccgttacgtaaacgtacccggtaacgttcggttacgggactttacggacctaacccgtaagtttcccgttaagggttttccttaaccggtaaccttttcccggtttacccccgccgtttaaccg

SEQ ID NO: 96397 - DNA, 562 bp, Homo sapiens
  misc_feature: GYAE6OF02GIC21.38.27.C05.1.454.CMB.1.raw
  modified_base (534)..(534): a, c, t, g, unknown or other
  misc_feature (534)..(534): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagacaaaaacctggccaggctcccaggctcctctatttatggtgcgtccaccgagggccactggccactcccagacagattcagtggcagtgcgtgtggacagacttcacttctcgtgatccgaactacgacgtacggaacccaaacgtagtacttttgcttggtagttacttactcgtacaactacgttagtcgggttcctcggcgtcgtacggttcggacgtaagggaccgtaaggtgaacgtcgaagtacgacgtggtcgcgtcgactacctnttcgtgttcttcacttcctccgcttacg

SEQ ID NO: 96398 - DNA, 508 bp, Homo sapiens
  misc_feature: GYAE6OF02HKHLD.38.27.C05.1.454.CMB.1.raw
  modified_base (389)..(389): a, c, t, g, unknown or other
  misc_feature (389)..(389): n is a, c, g, or t
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctccaggctcctcatttatggtgcgtccaccagggccactggcatcccagacagattcagtgcagtgcgtctggacagacttcactctcgtgatcgacagactcggacccaanagtatttgcttgtagtattactgtacaacacttagtggtcttccggcgtgacgttcggcaagggccaaggtggaatcaagtcgactgtggctgcacatctgtctnacttctcccgntac

SEQ ID NO: 96399 - DNA, 518 bp, Homo sapiens
  misc_feature: GYAE6OF02HF30J.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctcccaggctcctcatttatggtgcgtccaccagggccactggcatcccagacagattcagtggcagtgcgtctgggacagacttcactctcgtgatcgacagactggacccaacagtattttgctgtgtattactgtcaacactagtgggtcttccggcgtgtaccgttcggacctaagggaccaagggtggaacgtcaagtcgactggtggctgcacatctgtcttcatccttccgctac

SEQ ID NO: 96400 - DNA, 522 bp, Homo sapiens
  misc_feature: GYAE6OF02JBB4Z.38.27.C05.1.454.CMB.1.raw
  modified_base (197)..(197): a, c, t, g, unknown or other
  misc_feature (197)..(197): n is a, c, g, or t
  modified_base (391)..(391): a, c, t, g, unknown or other
  misc_feature (391)..(391): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagcaaaaacctggccaggctcccaggctcctcatttatggtgcgtccaccagggccactggcatcccagacagattcagtggcagtgcgtctgggacagacttcactctcgtgatcgacagactggacccaanacgtatttgcttgtactattactgtcaacactatcggtcttcggcgttcgacggttcggaccaagggaccgaaggtggaacgtcaagtcgactgtcggctgctacatctagtcttcactcttcccgctacg

SEQ ID NO: 96401 - DNA, 736 bp, Homo sapiens
  misc_feature: GYAE6OF02J30TQ.38.27.C05.1.454.CMB.1.raw
  modified_base (650)..(650): a, c, t, g, unknown or other
  misc_feature (650)..(650): n is a, c, g, or t
tcagtcgatcacgtcacgaccggtgctcgatttagacgcgatcgaagggtttggggagcatcacccagcaaccacatctgtcctctagagaactcccctgagacgccttcccgttcctcaccatggactggacctggagtatcgtcttcgtggtggcagcagtacaaaggacgcccactccgaggtagaagttggtccaggttcgttgggttcgcgtggaggacgtccgtggggcctcgagtcgtacttccgtcccctgaccgtacggtccttccggaattacgttacttccgttacgtactttacgtacttacgtttaccgacggttcgggtcgacccgtcccggtacggttaccccgtaggtaccggtaacgggtccgtaggtagggtcgggtagtacgggtactaggaccctaacctaacccggaaacccgtaggtaaccggttacggaaccgtaaaccgtaacgtagttacccgtacggaacctaacggtacggttaacggttacggacgggtccgtaaccggtacaccgtacgtaccgaccgacgtaccaacgtccaagtacctaacgtccgaccgtacctacgtacgtacctacgtacctacgttaacctagccgtacgaccgtcgtaccgtctactacgtcgngacgtacgagcgacgtgtacgttacgtagtacgagtttacggcgtttacggttctacgtcgtttacgttcggtacgttacggacgg

SEQ ID NO: 96402 - DNA, 526 bp, Homo sapiens
  misc_feature: GYAE6OF02IZYJX.38.27.C05.1.454.CMB.1.raw
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
  modified_base (331)..(331): a, c, t, g, unknown or other
  misc_feature (331)..(331): n is a, c, g, or t
  modified_base (394)..(394): a, c, t, g, unknown or other
  misc_feature (394)..(394): n is a, c, g, or t
  modified_base (442)..(442): a, c, t, g, unknown or other
  misc_feature (442)..(442): n is a, c, g, or t
  modified_base (504)..(504): a, c, t, g, unknown or other
  misc_feature (504)..(504): n is a, c, g, or t
  modified_base (523)..(523): a, c, t, g, unknown or other
  misc_feature (523)..(523): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgatactctggctcccagatacgaccggagaaagtgtgttgacgcagtctccaggcaccctgtctttgtctccagggganagagcccaccctctcctgcagggccagtccagactattaggagcagctacttagcctggtaccagcaaaaacctggccaggctcccaggctcctcatttanggtgcgtccaccaggccactggcatcccagacngattcagtggcagtgcgtctgggacagacttcactctcgtgatcgacagacctcggacccaanaggtattttgctggtattattactgtcaactatagtcgggtctccggngtgtacgttcggaccaagggacctaaagggtggaaagtcaagtcgacgtgtggcttgcactntctgtcttcatccttcccntac

SEQ ID NO: 96403 - DNA, 570 bp, Homo sapiens
  misc_feature: GYAE6OF02HO4M6.38.27.C05.1.454.CMB.1.raw
  modified_base (197)..(197): a, c, t, g, unknown or other
  misc_feature (197)..(197): n is a, c, g, or t
  modified_base (453)..(453): a, c, t, g, unknown or other
  misc_feature (453)..(453): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagcaaaaacctggccaggctccaggctcctcatttatggtgcgtccaccagggccacgtggcatcccagacagattcagtgcagtgcgtctgggacaggtacttcactctgtgatcgacagactcggaacccaacgtagtacttttgctggttagttattacgtgtactaactacttagtcgggtctttccgggngttcggacgtttcggaccgaacgggaccaagggttggaaacgtacaagtcgaacgttggtacggacttcgactaccgtattctcggttccttccgatttcccttacccggcttaacg

SEQ ID NO: 96404 - DNA, 586 bp, Homo sapiens
  misc_feature: GYAE6OF02HFGS6.38.27.C05.1.454.CMB.1.raw
  modified_base (197)..(197): a, c, t, g, unknown or other
  misc_feature (197)..(197): n is a, c, g, or t
  modified_base (237)..(237): a, c, t, g, unknown or other
  misc_feature (237)..(237): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactataggancagctacttagcctggtaccagacaaaaaccgtggccaggctcccaggctcctctatttatggtgcgtccaccgacgggccacgtggaccactcccagacagattcgagtggcagtgcgtcgtgggacagacttcactctcgtgactacgacagactacggaccaacgtagtattttcgcttagttagttacttacgttgtacctaactacttagtcggttcctccgggcgtacggtaccggttcggaccgaaggggaccgtaagggtggaaacgtcgaacgtcgagttggacggtctggacctaccgtacttcgtcgttacttcgtactttcccgttaccctcctacg

SEQ ID NO: 96405 - DNA, 747 bp, Homo sapiens
  misc_feature: GYAE6OF02JSVP5.38.27.C05.1.454.CMB.1.raw
  modified_base (147)..(147): a, c, t, g, unknown or other
  misc_feature (147)..(147): n is a, c, g, or t
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
  modified_base (293)..(293): a, c, t, g, unknown or other
  misc_feature (293)..(293): n is a, c, g, or t
  modified_base (397)..(397): a, c, t, g, unknown or other
  misc_feature (397)..(397): n is a, c, g, or t
tcagtcgatcacgtcacgaccggtgctcgatttagacgcgatcgaagggtttgggggaggctgctcagttaggacccagagggaaccatggaaacccagcgcagcttctcttcctcctgctactctggctcccagatacgaccgganaaagtgtgttgacgcagtctcaggcaccctgtctttgctccagggganagagccaccctctcctgcagggcagtcagactataggancagctacttagcctggtaccagccaaaactcggaccaggcctaccgacggactcccgtntacctttagtcggttgacgtccaccgacgggccaacgtgggaccagtcccaagtaccaggtacttcgacggtcggtacacggtcgtaccgttcgtcgggaacgngtaacgtttccaacgttaccgttccggtagtacgtaccgggactaacgggaccttaccgggaaaccccaacgttaaggtacgttttacggacgtttacgttacgggttaaacttaccgttacggttaactaaaccgttacttaaacggttcgggttccgtttcccgggtaacggttggtaacccgggtttccggacccgtaaaacggggggtacccttaaacgggttcgggtaataaccgtaacgtacggtaccgtttagggtcggccggttaacgcgaacccgttaacgtttcggttaccggtttaccttaccgttaccgttaccccgtttacccgaccgtttaaccgg

SEQ ID NO: 96406 - DNA, 810 bp, Homo sapiens
  misc_feature: GYAE6OF02I5LAG.38.27.C05.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctccagatacgaccggagaaagtgtgttgacgcagtctccaggcaccctgtctttgtctccgagggganagacgccaccctctcctgcagggccagtcagactataggagcagctacttagcctggtaccagacaaaaccgtggccaggtcctcccgaggcctcctactactttagtcggtcgccgttccaaccgacgggccaacgtggcactccccgagaccagtacttccgaggttacggctaggtcgaccgttacgtacgggaacgtacggtacttcgtaaccgttccgtacggtacggtaaccgttaccggaacgtaacggtaaccgttaccgggaaacccctaaacgtacggttaacgtttttcggaccgtttaggttaacggttaacgtttaccgttacggttaacccgtaaaaccgttacgttaacggtttcgggggtttacccgtttacccggggtacggtttaccgggttaacccgggtttcccgggtaacccggtaaaacgggggttaacccgtaaaggggttaacgggtaaaccggtttaaccgtaaaccgttaccgggtaaccggtttgggttaccgggtaccgtttaccgggaccttaacccggtactttaccggttacgtttaccgttaccgttaaccgtttccccgtttaccccggacttaacccgg

SEQ ID NO: 96407 - DNA, 533 bp, Homo sapiens
  misc_feature: GYAE6OF02H352O.38.27.C05.1.454.CMB.1.raw
  modified_base (287)..(287): a, c, t, g, unknown or other
  misc_feature (287)..(287): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgngccaggtccctggacaagggcctgagtggatgggatgcatcaacccagaactggcgacacaaagtctgcacagaagtttcagggcagggtcaccatcgaccgagacacgtaccatcaaatacagcctacctggaacctcagctaccctaaaatctacgacgaacacgccgtctatactgtgcgagaggcagacgttcgacttaggtataagtgcggttttacgatgtcttttgtattcgtacgggg

SEQ ID NO: 96408 - DNA, 614 bp, Homo sapiens
  misc_feature: GYAE6OF02F9DU5.38.27.C05.1.454.CMB.1.raw
  modified_base (197)..(197): a, c, t, g, unknown or other
  misc_feature (197)..(197): n is a, c, g, or t
  modified_base (239)..(239): a, c, t, g, unknown or other
  misc_feature (239)..(239): n is a, c, g, or t
  modified_base (573)..(573): a, c, t, g, unknown or other
  misc_feature (573)..(573): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcaggggccagtcagactattaggancagctacttagccctggtaccagcaaaacctggccaggctcccaggctcctctattatggtgcgttccaccgacggccacgtggcactcccagacagtacttcagtcggacaggtgcgtcgtaggaacagtacttcactcgtcgtgacgtcgacgtacgacgtacggaaccctaacgacgtattttacgcttaggtagttaattacttagtacaactacgtagttcggtaccgttaccggcgttacgtacggtttccggaccgaaagggtaccgaagggtacggaacggtactaacgtaccgtacgttcggtaggtcgtacgaccgtaaccgtnttccgtacgttcttaccgtacgttccgttcccgaccttacg

SEQ ID NO: 96409 - DNA, 633 bp, Homo sapiens
  misc_feature: GYAE6OF02HU04S.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagacaaaaacctggaccaggctcccgaggcctcctctatttagtggtgccgtcccaccgacggggccacgtcggcactcccgagacgagacttcagtggctagtcgcgtcgtgggacagacttcactcgtcgtgatcgacgagactcggaacccaacgtagtattttgcgttagtgttacttacgtgtacaactacgttagttcgggttccttccgggtacgttacggtaccggttccggaccgtaaacgggaaccgtaagggttacggaaacgtacgtaacgttacggtaacgttcggtacgggtcttacggacctaaccgtacgttacgttacgtttccgttaccttacgtttccctttaccccgccttaacg

SEQ ID NO: 96410 - DNA, 647 bp, Homo sapiens
  misc_feature: GYAE6OF02GZ33X.38.27.C05.1.454.CMB.1.raw
  modified_base (286)..(286): a, c, t, g, unknown or other
  misc_feature (286)..(286): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtncgccaggtccctggacaagggcctgagtggatgggatggcatccaaccccagaactggcgacacaaagtctgcacagtaacgtttcaggggcagggtccaccgagtacggacccgtagaaccaccggtaccaactacaaataccgaacgtcccttaacccgtacggaaacttccgacgtacccttaacccgtaaaattcctacggaacccgtaaccgaccggtacccgttaccttaacgtttacgttcggtacgacgtaaggacgggactaggtacgttccgtaacgtttggttaacgttaacggttcggttacggttttacgacggtttcgttacgttttagtacgttttcggtacgggg

SEQ ID NO: 96411 - DNA, 612 bp, Homo sapiens
  misc_feature: GYAE6OF02HB1LT.38.27.C05.1.454.CMB.1.raw
  modified_base (285)..(285): a, c, t, g, unknown or other
  misc_feature (285)..(285): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagccgtggggcctcagtgattgtcccctgccaggcttccggatatatcttcgacttctactattacactgggtncgcaggtccctggacaagggcctgagtggatgggatgcatccaaccccagaactggacacacgaagtctagcacagtaagttcgagggcacgggtcacagtcgacccgagaccacgtccatacaatacacgcctaccgtaggaacctcacgtacctaccctaaatccgtacgaaccgaccgaccggtcccgtacttaacgttaccgtggtcgacggaagacggactacggtacgtttacccgaacgtttacggtaacgttaacggttcggttacggttttacggtacgtttcggttactttttacggtacgttttccggtacggggg

SEQ ID NO: 96412 - DNA, 587 bp, Homo sapiens
  misc_feature: GYAE6OF02HN9D6.38.27.C05.1.454.CMB.1.raw
  modified_base (260)..(260): a, c, t, g, unknown or other
  misc_feature (260)..(260): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccancaaaaacctggccaggctccaggcctcctcatttatggtgcgtccaccgaggccactggcatcccagacagattcagtgcagtgcgtcgtgggacagacttcgactcgtcgtagatacgacgacgactacgggaacccaaacgtagtaattttcggcttaggttgttattactgtactaacacttagtcgggttcttccgggcgttcggtacggttccggaccgtaacgggaacgtaagggtaggtaaagacgtaagtcgaacgttggtaggcttcgacctaaccgtactcgtcgttacttctaacgttcccgttacccgcctaacg

SEQ ID NO: 96413 - DNA, 536 bp, Homo sapiens
  misc_feature: GYAE6OF02IKY5I.38.27.C05.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
  modified_base (440)..(440): a, c, t, g, unknown or other
  misc_feature (440)..(440): n is a, c, g, or t
  modified_base (502)..(502): a, c, t, g, unknown or other
  misc_feature (502)..(502): n is a, c, g, or t
  modified_base (515)..(515): a, c, t, g, unknown or other
  misc_feature (515)..(515): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccagggganagagccaccctntcctgcagggccagtcagactattaggancagctattagcctggtaccagacaaaaacctggaccaggcctcccgaggcctcctctatttatggtcgcgtcccaccgagggccacgtggcactcccagacagtattcgagtggcagtgcgtcgtgggacagtacttcactcgtcgtagatcgacagactcggaacccaatagtactttgcttagtgtattactgtacaactntagtggtctcggcgtgtacgttcgaccgaaggccaaggtgaacgtcgaagtcgacttggcgntcgcactatcgtntctcgacttccgtccgctacg

SEQ ID NO: 96414 - DNA, 523 bp, Homo sapiens
  misc_feature: GYAE6OF02H3C9A.38.27.C05.1.454.CMB.1.raw
tcagtcgatcacgtcacgaccggtgctcgatttagacgcgatcgaagggtttgggggagctgctcagttaggacccagagggaaccatggaaaccccagtgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagacaaaaacctggccaggctcccaggctcctcatttatggtgcgttccaccagggccactggcatcccagacagattcagtggcagtgcgtctgggacagacttcactctctgatcgacagactggacccaaacagtattttgcttgtgtattactgtactaacactatcgggtctccggcgtgtcgttcggacaagggaccaaggtggaagtcaattcgacgttgtcggctgacaccatcgtgtcttcacttcttcccgctac

SEQ ID NO: 96415 - DNA, 684 bp, Homo sapiens
  misc_feature: GYAE6OF02IWUYB.38.27.C05.1.454.CMB.1.raw
  modified_base (198)..(198): a, c, t, g, unknown or other
  misc_feature (198)..(198): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgagggganagagccaccctctcctgcagggccagtcagactagttaggagcagctacttagccttggtaccagactaaaaaccgtcggaccaggcctcccgaggtcctcctctatttacgtggtcgcgtaccaccgagggccacgtggcactccagacagtatcgagtggctacgtgcgtcgtggacagtacttcgacttcgtcgtagactcggaacagacgtacggaacccaacgagtaagtttgcgttaggtacgtttaacgttacgttacgttactaaaccgtacgttacgttcgggttacctttccgggacgtttacgggtacccgggtttccgggaacccgtaaacgggggtaccgtaaaggggttacgggtaaacggtacgtaacggttacggtacgttacgggtacggtacgttacggaaccctaccgttaacgttccgttaggtttacccttacgtaaccgtttcccgttaccccggcttaaccgg

SEQ ID NO: 96416 - DNA, 582 bp, Homo sapiens
  misc_feature: GYAE6OF02ITL9Y.38.27.C05.1.454.CMB.1.raw
  modified_base (196)..(196): a, c, t, g, unknown or other
  misc_feature (196)..(196): n is a, c, g, or t
  modified_base (237)..(237): a, c, t, g, unknown or other
  misc_feature (237)..(237): n is a, c, g, or t
  modified_base (403)..(403): a, c, t, g, unknown or other
  misc_feature (403)..(403): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccagggganagagccaccctctcctgcagggccagtcagactagtaggancagctactagcctggaccagacaaaactggaccaggcctacccaggctcctctatttatggtgccgtccaccgagggtccacgtggcactcccaagacagattcgagtggcagtgcgtcgtagggacagtacttcactctcgtgatcgacagacgtcggaacccanagtatttcgctagtatattctagtacctaactacgttagtcgggttccttccgggtcttggtaccgtttacgggaccgtaaacgggaccgtaaaggggtgaaacgttagaacgttacgaacgtggtaggtctacgactacctagttcgttcgttacttcacgttccttacccgctaacg

SEQ ID NO: 96417 - DNA, 627 bp, Homo sapiens
  misc_feature: GYAE6OF02GHNZ8.38.27.C05.1.454.CMB.1.raw
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (300)..(300): a, c, t, g, unknown or other
  misc_feature (300)..(300): n is a, c, g, or t
  modified_base (397)..(397): a, c, t, g, unknown or other
  misc_feature (397)..(397): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggancagctacttagcctggtaccagacaaaaacctggccaggctccaggctcctctattatggtncgtccaccgagggcctactcggcactcccgaagacagattcagtggcagtgcgtctagggacagacttcactctcgtagtactcgaacaggtaaccncggaaacccaagtacgtagtttcacgttgttacgttaattacgtgttaccaatacgttagtcgggttccttccgggtcgtcggtaccggtttccgaacccggtaaacgggtaaccgtaaagggttacggaaacgttcgaaacgtacggtaacgttggtacggtccttacggacctaacgtacgttacgttacgttccttacctacgtttccctaccccggtacttaaccg

SEQ ID NO: 96418 - DNA, 557 bp, Homo sapiens
  misc_feature: GYAE6OF02JA7ZI.38.27.C05.1.454.CMB.1.raw
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (358)..(358): a, c, t, g, unknown or other
  misc_feature (358)..(358): n is a, c, g, or t
  modified_base (396)..(396): a, c, t, g, unknown or other
  misc_feature (396)..(396): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgccagggccagtcagctattaggancagctacttagcctggtaccagcaaaaacctggaccaggctcccaggctcctcatttanggtncgtccacaggtccactggcagtcccagaccagattcagtggcagtgcgtctgggacnggacttcgactctacgtgatcgaacgactggacccaangaatttgctgtgtattctgtacaactactatgggttaccttccggcgtcgtacgtttccgggacctaaaggggaccaagggtggaaacgtcaaagttccgaacgttggtacggctcggactaccgattcgtagtttcctacacgtccgttcccgctaaccg

SEQ ID NO: 96419 - DNA, 864 bp, Homo sapiens
  misc_feature: GYAE6OF02FOMF6.38.27.C05.1.454.CMB.1.raw
  modified_base (217)..(217): a, c, t, g, unknown or other
  misc_feature (217)..(217): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggccaccctgtctttgtctccaggggagagagcccaccctctcccgngacgggaccgacgtacgacgacgtacttaggtaggacacgacgtacttacgtccgtcggtacgaacgacgaaaaccctaacggtccgacggaccgtcccgtaccggaccgtccttcctacgtttaagtttcggttcgtccggtcccgtacccgaccgggaccgtaccgtcgacggactacccgacgaacgacgtacgttctacgtggtcgaacggtcggtcggtccggtcgggacgtaacgtacgttacttccgtaccgttcgtcggtaactccgtaaccgacgaccgttacggaaccccaaaccgtaagttacggttttacgttacgtcggtttaacgtttaacgtttaaccgtccggttaacgaaacccgtaacgttttaaggttcccggggttacccgggttttccccgggtaccggtttaccggggttacccgggtttaacccggggtaaccccgggaaacgggggtaaacccgggttaaaacgggggttaagggtaacgttaaacccggaacggttttaaaccggtacggttacggttcggggtaccgttacccggaacgtaaccccgtaacgtttcggtttacgtttaccctttaccgttaaccggttccccgtttacccccggtaccgaagtttacccgg

SEQ ID NO: 96420 - DNA, 610 bp, Homo sapiens
  misc_feature: GYAE6OF02GT0KS.38.27.C05.1.454.CMB.1.raw
  modified_base (198)..(198): a, c, t, g, unknown or other
  misc_feature (198)..(198): n is a, c, g, or t
  modified_base (433)..(433): a, c, t, g, unknown or other
  misc_feature (433)..(433): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgagggganagagccaccctctcctgcagggccagtcagactagttaggagcagtctacttagcctggtaccagaccaaaaacctcggaccaggcctacccgaggcctcctctatttatggtcgccgtccaccgacgggccacgtcggcactcccaagacagtacttacgacgtcggcctagtcggtcgtcgtacgggacagacttcaccgtcgtcgtgactcgacacgcgtacgacccaacgngtatttgctgtgtacttactgtaacactattacgtggttcctccggcgttgaccgttcggaccgtaagggaccgtaagggtcggtaacgtacgtaacgtacgtaacgtggtcgggactacggtacctaccgtacgttccgttgttacccttgaaccttcccgtttaccgaccttacg

SEQ ID NO: 96421 - DNA, 623 bp, Homo sapiens
  misc_feature: GYAE6OF02IVYIE.38.27.C05.1.454.CMB.1.raw
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctactagcctggtaccagacaaaaacctggaccaggcctcccaggcctcctacatttatggtgcgtccaccgagggccacgtcggcactccagacagtatcagtggcagtgacgtcgtaggacagactcactctcgtnatcganacgtacctggaacccaacgtagtactttgcgttagtagttacttactgttaccaacgtactagttcgggttcttacccgggtgtacggtaccgttccgggtaccgaacggggtaccgtaagggtcggtaaagtaccgtaagtacccggaacgttggtacgggtacttacggacctaaccgtacgttccggttacgttacccgtttacgtacctacccgtttaccccggaccttaaccg

SEQ ID NO: 96422 - DNA, 1004 bp, Homo sapiens
  misc_feature: GYAE6OF02HCVB0.38.27.C05.1.454.CMB.1.raw
  modified_base (199)..(199): a, c, t, g, unknown or other
  misc_feature (199)..(199): n is a, c, g, or t
tcagtcgatcacgtcacgaccggtgctcgatttagacgcgatcgaagggtttgggggagctgctcagttaggacccagagggaaccatgggaaaccccagcgcgacgcttctcttcctcctgctactctggctccagatacgaccggagaaagtgtagttgacgcagtctcaggcaccctgtctttgtctccagggganagacgccaccctcgtccgtgcagggccagtcagacttagttacggacgacacgacttaacgtttaaggcccgttagggttaacccaggtaccgaaaaaaacccgttcggggacccgaacgggtaccgttaacccccgaaacggggacccgttaccccttaccgtaacgtttttaacgttcgggttacggtacccggttacccgtaaaccccggtaacgggggtacccctaaaccggtttacggggacccgtaacggtttaccccccggaaaggtaacccgtaaacggtaaccgttttaaccggaacgggtttaccggggccgtaaacgggtttccggggtccggtttacgggttaaccgggggtaaccgtaaacgggttacccgttttaccgtaacctttcccgtttcccggttacggttaaccgttaccgggaaaccgtaacggtaaccgttaccgggaaaccccgtaaacggtacgtttaaacggttttttacggaccgttttacgggtttacggtttaacgtttacggtttaccgttacggttaacccgtaaaccgttaaccgttttaaacggttttaccggggttttacccgttttacccggggtttaccggtttaaccggggtttacccgggtttttacccggggaacccggttaaaacggggtaacccggtaaaaggggttacggtaaacgttaccgtaaacgttaccggtaaacgttcggggtacggtctacggacctaaccgtacgtttccgttacgtttccgttaccgttaccgtttacccgttccccgtaacccg

SEQ ID NO: 96423 - DNA, 598 bp, Homo sapiens
  misc_feature: GYAE6OF02JVDPQ.38.27.C05.1.454.CMB.1.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
  modified_base (383)..(383): a, c, t, g, unknown or other
  misc_feature (383)..(383): n is a, c, g, or t
  modified_base (432)..(432): a, c, t, g, unknown or other
  misc_feature (432)..(432): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgactccagggganagagccaccctctctgcaggccagtcagactattggancagctactagcctggtaccagcaaaacctggacaggctccaggcctctcattatggtcgcgtccaccgaggccaacgtcggtcactcccgagacagacttcgagtcgcagtcgactcgtacggactacgactttcactcgtcgtaagntacgacagacgtcgacccaagtgtacgtttacgcttagtgttacttacncgttacaactacttacgtggtccttccggtacgtggtaccgttcggaccgtacggtacgtaagggtggtaaacgtcgaacgttaccgagttcggtcggtactaccgcgtaaccctagttactacggttcctaccgtttaccgtaccgtttacccgtacccttacgg

SEQ ID NO: 96424 - DNA, 562 bp, Homo sapiens
  misc_feature: GYAE6OF02F58S1.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagacaaaaacctggccaggctcccaggctcctcatttatggtgcgtccaccgagggccactggcactcccagacagattcagtggcagtgcgtctgggacagacttcactcgtcgtgactcgacagactcggaacccaagagtatttgctgttgtattactgtcaactatagtcggttcttccggcgttgacggttcggaccgaagggtaccaagggttcgaagttacaagtccgaatggtacggtctacggacctaccgtatcgttacgttccttaccgtaacttcccgttcccgacttaccg

SEQ ID NO: 96425 - DNA, 543 bp, Homo sapiens
  misc_feature: GYAE6OF02G8ZI0.38.27.C05.1.454.CMB.1.raw
  modified_base (360)..(360): a, c, t, g, unknown or other
  misc_feature (360)..(360): n is a, c, g, or t
  modified_base (424)..(424): a, c, t, g, unknown or other
  misc_feature (424)..(424): n is a, c, g, or t
  modified_base (434)..(434): a, c, t, g, unknown or other
  misc_feature (434)..(434): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctacttatttacacttgggtgcgccaggtccctggacaagggcctggagtggatgggatggcatccaaccccagaactggacgacacaaagtcngcacagaagtttcgagggcagggtcaccatcgacccgagacacgtcatcaatacacgcctaccnggaactcacncctacctaaatctacgacacgaccggcctactatactgtgcgagagcacgtagtaccgacgttagtataaggtcgttacggtttcgattgtactttgtatttgtacggg

SEQ ID NO: 96426 - DNA, 552 bp, Homo sapiens
  misc_feature: GYAE6OF02HB2Q1.38.27.C05.1.454.CMB.1.raw
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggagcctggggcctcagtgattgtcccctgccaggcttccggatatatcttcgacttctactatttacactgggtgcgccaggtccctggacaagggcctgagtggatgggatgcatccaaccccagaactggcacaacaagtctgcacagtaagttcgagggactagggtccaccgagtcgaccgagacacgtccatcaatacacgacctaccgtcgaactcacgcctaccctaaatctacgacaccgacggaccctattacttacgtcgtgcgagagcgtagcgttacacgttcgtaataaggtcgttaggtttcgattcgttctttagtcttcggtcggg

SEQ ID NO: 96427 - DNA, 608 bp, Homo sapiens
  misc_feature: GYAE6OF02HN90I.38.27.C05.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccgagggganagagccaccctctcctgcagggccagtcagactattaggagcagctacttagcctggtaccagcaaaaacctggtcaggcctccaggcctcctcatttatggtcgcgtccaccgacgggccacgtcggacactcccagacagacttcagtggcagtcgcgtcgtgggacagacttcactcgtcgtgatcgacagacgtcggaacccaactagtatttgctgttgtacttacgtgtacaaactacgttagtcgggttcttaccgggtcgttacgtacggttccgaccgaacgggaccgtaagggtacggtaaacgtactaaagtccgtaacgttggttacggtctacggaccctaaccgttacgtaccgttagttcccgttcctacgtttccccgttccccgtacctaaccg

SEQ ID NO: 96428 - DNA, 627 bp, Homo sapiens
  misc_feature: GYAE6OF02F9G6L.38.27.C05.1.454.CMB.1.raw
  modified_base (197)..(197): a, c, t, g, unknown or other
  misc_feature (197)..(197): n is a, c, g, or t
  modified_base (408)..(408): a, c, t, g, unknown or other
  misc_feature (408)..(408): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagcaaaaacctggccaggctcccaggcctcctcatttatggtgcgtccaccgacgggccacgtggccactcccagacagacttcagtcggcagtgcgtcgtggacagtacttcactctcgtgtagtcgaacagtacctacggaacccaanacggtacttttcgacttgttagtattacgtgtacacgtacttagtcgggttccttccgggacgttacgtacggttccggtacccgtaaacgggtaaccgtaacgggtacggtaaacggtacgtaaccgtacggtacgttaggtacggtacgtaccggaccacccgtacttacgttaccgttacgttacccgtagttcccgttaccccgtaccgttaccg

SEQ ID NO: 96429 - DNA, 678 bp, Homo sapiens
  misc_feature: GYAE6OF02IDG22.38.27.C05.1.454.CMB.1.raw
  modified_base (238)..(238): a, c, t, g, unknown or other
  misc_feature (238)..(238): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagacgccaccctctcctgcagggccagtcagactatagganctagctacttagcctggtaaccagaccaaaaaccgtggaccaggcctcccgaggcctcctctatttagtggtcgccgtcccaccgtacgggccacgtcggacctactcccagacagtacttacgagtgctagtgcgtcgtggactagtacttcactctcgtgtactcgacagacgtcggaacccaacgtagtacgttttcgacgttgttacgttactttacgtcgttacgaaaccttacgttaggttccgggttaccttccgggtaccggttacggtacccgggtttccgggaaccgttaaacggggtacccgttaaggggtaacggtaaacggttaacgtaacgttaccggtaacgtttcgggtggtccgttacggaccctaaccgtctttaccgttacgtttccgttacctaccgtttcccttccccgtacttaccgg

SEQ ID NO: 96430 - DNA, 677 bp, Homo sapiens
  misc_feature: GYAE6OF02GWT7I.38.27.C05.1.454.CMB.1.raw
  modified_base (198)..(198): a, c, t, g, unknown or other
  misc_feature (198)..(198): n is a, c, g, or t
  modified_base (239)..(239): a, c, t, g, unknown or other
  misc_feature (239)..(239): n is a, c, g, or t
  modified_base (364)..(364): a, c, t, g, unknown or other
  misc_feature (364)..(364): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgagggganagagccaccctctcctgcagggccagtcagactagtaggancagctacttagcctaggtaccagacaaaacctggaccaggcctcccgaggcctcctctatttagtggtcgcgtccaccgacgggccacgtcggacactcccagacagatcagtgcagtgcgtcgngggacagtacttcgactcgtcgtagatcgacacgaccgtacggaaccctaaacgtagttacgtttaggcgttaggttagttaactttacgttagttaaccaaacgttacgttaggttcgggtttacccgtttccgggtaccggttacggtaacccggtttccgggaaccgtaaacggggtacccggttaaacgggttacgggaaacgttaccgtaacgttaccgtaacgttcgggtacggtacggtacgaccgtaaccgtagttccgtttcgttcctttaccgtaccgtttccctttaccccggacttaccgg

SEQ ID NO: 96431 - DNA, 681 bp, Homo sapiens
  misc_feature: GYAE6OF02G5YXZ.38.27.C05.1.454.CMB.1.raw
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttgcgtgaggaagcctggggcctcagtgattcgtcccctgccaggccttccggatatatcttcgacttctactatttacactggtgcgccaggtccctggacaaggggcctgaggtgggacgtgggatggcatccaaccccagactggcgacacaagtctagcacagtaagtttcgagggcagggtccaacgtatacggaacccgagaccgtaccgtaccaacgtaccaaagttacacggtccctaacccgtacgggtaacctaccgaacgtacccttaaccctaaaacttccgtacgtaaccgaaccgaccgggtaccccgttagttaaccgtttaccgtagttacggaccggtaaggaacgggtcgagttaaccggttccgtaaaccggtttaacggttaagttaacggttacggttaccgggtttttacgtaacgtttcgttaccgttttttacgtacggttttcggtaaccgggggg

SEQ ID NO: 96432 - DNA, 672 bp, Homo sapiens
  misc_feature: GYAE6OF02HGM9R.38.27.C05.1.454.CMB.1.raw
  modified_base (244)..(244): a, c, t, g, unknown or other
  misc_feature (244)..(244): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctccagatacgaccggagaaagtgtgttgacgcagtctccaggccaccctgttctttgtctccgaggggagagacgcccaccctctcctgcgagggccagtcagacttagtaggancagtccttacgttacgccgtaggtaccaagaaccaaaaaccgtggaccaggcctcccgaggcctcctactatttagtggtcgccgtccaccgtcggaccacgtcggcactcccagacagtactcgaggtcgcagtgcgtgcgggacagtactcactcgtgcgtatcgacgagtaccgtacggacccaaagtagttacgtttcgcttagggttattacttaactaacgttaccaaacgttacgttagttacgggttccgtacccgggttcgtacgggttacccggttccgggaaccggtaacgggtaacgtaaacgggggtcggtaaactaccgtaagtaccgtagtcggtcgggtcctacggtacctaaccgtacgtttcgtacgtttacccttacgtaccctttcccggttaccccacgttaaccgg

SEQ ID NO: 96433 - DNA, 691 bp, Homo sapiens
  misc_feature: GYAE6OF02GR68S.38.27.C05.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactagttaggagcagctacttagcctggtaccagacaaaacctggccaggctacccgaggctcctctatttagtggtcgcgtacccaccgacgggccacgtcggcactcccagacagtacttcgaggtggactaggtcgcgtcgtacgggacacgtacttcgacgttcgtcggtagtacgtacgaacgtaagtaccgtacgggaaccccaacgtaaggttattttcggacgttaggttagttaactttacgtcgttaacctaacttaccgttagttacgggtccctttacgggtcgttacggtaaccgggtttccgggaacccgtaaaggggtacctaaagggggttacggtaacgtacgtaacgtacgtacgttcggtaacgggtcgtacggtaccctaccgttacgttacccgttcgtttcccgttacgtaccgttttccccttccccggtaccttaaccgg

SEQ ID NO: 96434 - DNA, 634 bp, Homo sapiens
  misc_feature: GYAE6OF02FUJHT.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggaaagagccaccctctcctgcagggccagtcagactattaggagcagctacttagcctggtaccagcaaaaacctggccaggctcccaggctcctcatttatggtgcgtccaccagggccactggcatcccagacagattcagtggcagtgcgtctgggacagtacttcgactctcgtgatcgacagactggaacccaacagtaattttcgcttagttagttacttactgttactaaacgtacttagtcgggttacttccggtcgttaggtaccgtttccgggacccgtaaaggggtaacccctaaggggtacggtaaacggtcgtaaacgtccgaaacgtttcggtacgggccgttacggcccgtaacccgtaacgtttccggttacgttaccttttaccgtactttacccgtttccccggtaccctacgtttacccgg

SEQ ID NO: 96435 - DNA, 618 bp, Homo sapiens
  misc_feature: GYAE6OF02JD2BP.38.27.C05.1.454.CMB.1.raw
  modified_base (197)..(197): a, c, t, g, unknown or other
  misc_feature (197)..(197): n is a, c, g, or t
  modified_base (357)..(357): a, c, t, g, unknown or other
  misc_feature (357)..(357): n is a, c, g, or t
  modified_base (436)..(436): a, c, t, g, unknown or other
  misc_feature (436)..(436): n is a, c, g, or t
tcagtcgatcacgtcacgaccggtgctcgatttagacgcgatcgaagggtttggggagctgctcagttaggacccagagggaaccatggaaaccccagcgcagcttctcttcctcctgctactctggctcccagatacgaccggagaaagtgtgttgacgcagtctccaggcaccctgtctttgtctccgagggganagagcctaccctctcctgcagggccagtcagctataggagcagctacttagcctggtaccagactaaaacctggccgagctcccaggtcctcctctatttatggtcgcgtaccaaccgacgggcctacgtcggcactcccaagacagtattcgagtcggnagtgcgtgtacgggacaggtacttacacgtctacgtagacgtcgacgagacctacggaacccaacgtagtattttacgnttcgttagtacttacgtcgttacaactacgttagtccggttccttccgggtacgttacgtaccggttccggaccgtaaacggggaacctaagggttagtaaacgtacgaactacggtaactgggtagccgttacgacctaccgtcttacttcgttcgttaccatttccctacccgtctaacg

SEQ ID NO: 96436 - DNA, 609 bp, Homo sapiens
  misc_feature: GYAE6OF02JDY6M.38.27.C05.1.454.CMB.1.raw
  modified_base (400)..(400): a, c, t, g, unknown or other
  misc_feature (400)..(400): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctgactcccagatacgaccggagaaagtgtgttgacgcagtctccaggcaccctgtctttgtctccaggggagagagcccaccctctcctgcagggccagtcagactattaggagcagctacttagcctggtaccagcaaaacctggccaggctcccaggctcctcatttatggtgcgtccaccgagggccacgtggcactcccagacagattcagtggcagtgcgtcgtgggacagtacttcactctcgtgactcgacagactacggacccaacngtattttgcttgtagtattactgtacaactcttagtgggttaccttccgggacgttcgtaccggtttcggacccgtaagggtaacccgtaagggttacggaaagttccgaaagttccgtaacgttggtacggtcgtacggaccgtaaccgttacgttaccgttcggtttaccctttacgtacctttcccgtttaccccgccgttaaccg

SEQ ID NO: 96437 - DNA, 675 bp, Homo sapiens
  misc_feature: GYAE6OF02F8B3A.38.27.C05.1.454.CMB.1.raw
  modified_base (198)..(198): a, c, t, g, unknown or other
  misc_feature (198)..(198): n is a, c, g, or t
  modified_base (239)..(239): a, c, t, g, unknown or other
  misc_feature (239)..(239): n is a, c, g, or t
  modified_base (307)..(307): a, c, t, g, unknown or other
  misc_feature (307)..(307): n is a, c, g, or t
  modified_base (380)..(380): a, c, t, g, unknown or other
  misc_feature (380)..(380): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggccaccctgtctttgtctccagggganagagccaccctctcctgcagggccagtcagactattaggancagctacttagcctggtaccagcaaaacctgcaggctccaggctcctcatttatggtgcgtccaccgngggccactgggcactcccagacagacttcgagtcggcagtcgcgtctgggaactgacttcaccgtctcggttnacgtaccgacgagtaccgtacggaacccaaacgtacgtacgttttcgaccgttggttagttactttacgttaggttacctaaaaccgttacttacgttacggggtttcctttaacccgggtgttacggtaaccgggttttcccgggacccgtaaagggggtaacccgtaaaggggttcggtaaaccggttacctaaggttaccggtaacgtttcgggtacgggtactacggtaccgaaccttacgttcggttacgttcctttaccgtcgtttcccctttacccggccgttaaccg

SEQ ID NO: 96438 - DNA, 736 bp, Homo sapiens
  misc_feature: GYAE6OF02H4AG1.38.27.C05.1.454.CMB.1.raw
  modified_base (431)..(431): a, c, t, g, unknown or other
  misc_feature (431)..(431): n is a, c, g, or t
  modified_base (727)..(727): a, c, t, g, unknown or other
  misc_feature (727)..(727): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctccagatacgaccggagaagtgtgttgacgcagtctccaggcaccctgtctttgtcctccgaggggagagacgccaccctctcctgcgagggccagtcagtactagttaggagacagcttacttacgccttacgggtaaccgaacaaaaccgtcggaccgacggtcctaccgacggtacctccctactagtttacgtgggtacgtccgttaccccgaacgacggtacccgaacgtcgggacctaacctacccgaacgtacgaacgtacttacgacggtcggacgtaggtcggtccgttaggngggaacctacggtaccgtttcgaccttccgtagtcggtacctaccggacacggtacgtaccggaccctaaaccgtagtttacgtttagacgttagtacgttaacttacgtagtaacctaacgttacttaggttccggttcgtccggtacggttacggttaccgggttacggaccgtaaacgggtaaccgtaaggggttacgaaacgtaccgaaagttaccggaacgttggtccggtacgtcgaccgtaaccgtcgtttacgtacgttcttacgtccttacccggttccctacccgnttaacccgg

SEQ ID NO: 96439 - DNA, 645 bp, Homo sapiens
  misc_feature: GYAE6OF02I20A8.38.27.C05.1.454.CMB.1.raw
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
tcagtcgatcacgtcacgaccggtgctcgatttagacgcgatcgaagggtttgggggagcgtgctcagttaggacccagagggaaccatggaaacccagcgcagcttctcttcctcctgctactctggctcccagatacgaccggagaaagtgtgttgacgcagtctccaggcacctgtctttcgctccgagggganagacgccacctctccgtgcgacgggccagtcagtactagttaggagcagctacttagcctaggaccagacaaaactgcaggcctccagcctctntattatggtcgcgtccacgacggccacgtggaccactcccgagactagtcttcgacgtgcgagtcggcgtcgtaggactacgtacttcacgtctcgtagtacgtcgaacgacgtaacgtaccggaacccaagtacggttattttcgacgtttagtacgtttaacttcgtacgttactaaccgtacgtttaggttccggttaccgttcggacgtttacggtaccggtttaccggaacgtaacgggtaccgtaagggtacggtaacgtacgaacgttaccgacgttacggtcggtacgtaccgacgtaaccgtactcgttaccgtcttacctcgtttaccctcccggacttaccgg

SEQ ID NO: 96440 - DNA, 708 bp, Homo sapiens
  misc_feature: GYAE6OF02I6GS6.38.27.C05.1.454.CMB.1.raw
  modified_base (242)..(242): a, c, t, g, unknown or other
  misc_feature (242)..(242): n is a, c, g, or t
  modified_base (306)..(306): a, c, t, g, unknown or other
  misc_feature (306)..(306): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtcctccgaggggagagagccaccctctcctgcgagggccagtcagtactattaggancagctacttagcctggtaccagacaaaacgtcggacacggctaccgagtctcctctaacgtttntggtcgtcgtaccgaccgacggacacgtgccactccagacagtatcgagtcggcagtcggacgtcggtacggactacgtacttcgtacgtcgttacggagtaacgtacggacgtaacggtaacgtacccggaaaccgtaacgtaacggtttacgtttcggtaacgttcgggttactttaaacttacgtttacggtaactaaaccgttacgttaaacggttacggggtttccgttccgggtagggtttccgtaacgggtttaccgggaaacgtaaacggggtaacccgttaaaggggttacggtaaacgtacgtaaacgtaccgtacggttcggtacggtcgtaacgccgtaacgtcgttacgtacggtttcctaacgttccgttaacccgttcgaccttacg

SEQ ID NO: 96441 - DNA, 697 bp, Homo sapiens
  misc_feature: GYAE6OF02F04OP.38.27.C05.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagacaaaaacctggaccacggctacccgaggcctcctctatttatggtgaccgtccgaccgacggggccctacgtgggccaacgtccccgaagaccaaggtatttccgaaggtggacgaggttacggcggttcgtgggaacctaggaactttcaacttcgtcgttgactcgaacgagacgtacggaccccaaagtacgtattttcgacgttggttacgtaactttaccgtagttaccgaaactacgttagttcggggtttaccttcccgggtcgttacgaccggtttccgggaccgtaaaccggggtaccgtaaaggggttacggtaaacgtaccgtaaagtaccggtaacgttcggtacgggtacgtacgtaccgtaacctaacgttccgttacgtttcccgtttacgacctttcccgttaccccgtacgttaacccg

SEQ ID NO: 96442 - DNA, 632 bp, Homo sapiens
  misc_feature: GYAE6OF02IYXHM.38.27.C05.1.454.CMB.1.raw
  modified_base (196)..(196): a, c, t, g, unknown or other
  misc_feature (196)..(196): n is a, c, g, or t
  modified_base (382)..(382): a, c, t, g, unknown or other
  misc_feature (382)..(382): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccagggganagagccaccctctcctgcagggccagtcagactataggagcagctacttagcctggtaccagcaaaaacctggaccaggctcccaggctcctcatttactggtcgcgtaccaccgagggccacgtggcactcccagacagacttcgagtggcagtgcgttcgtcggacagtactcacgtcctcggngtactcgacagtacgtcggacccaanagtntttgctgtcgtattacgtgtactaactacttagtcgggttcttaccgggtcgtcggtaccgtttccggaaccggtaacgggtaccgaagggttacgggaaacgttaccgtaaagttaccggaacgttcggttacggtacgttcggtacctaaaccggtacgtttaccgttcggtttaccctttacgtacccgtttacccgttaccccggtccttaacccg

SEQ ID NO: 96443 - DNA, 633 bp, Homo sapiens
  misc_feature: GYAE6OF02JBFM6.38.27.C05.1.454.CMB.1.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
  modified_base (381)..(381): a, c, t, g, unknown or other
  misc_feature (381)..(381): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcagggccagtcagactattaggagcagctacttagcctggtaccagcaaaaacctggccaggctcccaggctcctnattatggtgcgtccaccgaggccactggacactcccagacagattcgagtgcagtgcgtctggacagtacttcgactcgtcgtgactcganacgacgtacgggacccaaacgagtaacttttggacttgttagtatttacctggttactaaaccgtattacgttagggttcccgttccgggtacgttcggtaccggtttcccgggaacgtaaaccggggtaaccgaagggttacgggaaacgttcgtaaacgttccggtaacgttgggtacggcgtttacgacccgtaaccaacgtttccgttcgttccttacgtacctttcccgttaccccgctttaacccg

SEQ ID NO: 96444 - DNA, 565 bp, Homo sapiens
  misc_feature: GYAE6OF02F8ZF9.38.27.C05.1.454.CMB.1.raw
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (391)..(391): a, c, t, g, unknown or other
  misc_feature (391)..(391): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagacaaaacctggcaggctcccaggctcctcatttatggtgcgtccaccaggccacgtggcactcccagacagattcagtggcagtgcgtcngggacngtactcactctcgtgatcgacagacacggaccaangtatttcgcttgtatactactgttcaacgtctagtcgggttccttcgggtcgtcgtaccgttcggaccgtaacgggaccgtaagggtacggagttaccgaagtccgtagtggtaggccgtcgtacgaaccgtattcgttacgttccttacgtacgtttccttccccggactacg

SEQ ID NO: 96445 - DNA, 717 bp, Homo sapiens
  misc_feature: GYAE6OF02FU6L1.38.27.C05.1.454.CMB.1.raw
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
  modified_base (374)..(374): a, c, t, g, unknown or other
  misc_feature (374)..(374): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggccaccctgtctttgtctccgagggganagagccaccctctcctgcagggccagtcagactagtaggngcagctacttagcctggtaccagcaaaaacctggccaggcctccaggctcctcatttactggtgtccgtaccaccgacgggcccacgtcggccactcccagaccagacttcgagtcggcagtcgcgtcgtggacnggtacttcacttccgtcgtcgtactccgaacacgtacgtacggaacccaaacgagttacgttttgaccgttaggttacgttacgtttacgttacgttaaccgaaaccttacgttacgttacggggtttccctttaccgggtccggttacggttaccgggttacccgggtacccgtaaacgggggtaacccggttaaaggggtacggtaaaccggttaacgtaaacgtttccggtaaacggtttcgggtacgggttaccgtacgaccccgttaacccgttacgttaccgttcgtttacccgtttaccgtacccgtttacccgtttccccgaaccgtttaacccg

SEQ ID NO: 96446 - DNA, 518 bp, Homo sapiens
  misc_feature: GYAE6OF02FTT7Y.38.27.C05.1.454.CMB.1.raw
  modified_base (197)..(197): a, c, t, g, unknown or other
  misc_feature (197)..(197): n is a, c, g, or t
  modified_base (239)..(239): a, c, t, g, unknown or other
  misc_feature (239)..(239): n is a, c, g, or t
  modified_base (354)..(354): a, c, t, g, unknown or other
  misc_feature (354)..(354): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
  modified_base (489)..(489): a, c, t, g, unknown or other
  misc_feature (489)..(489): n is a, c, g, or t
  modified_base (497)..(497): a, c, t, g, unknown or other
  misc_feature (497)..(497): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagcccaccctctcctgcagggccagtcagactattaggancagctacttagcctggtaccagacaaaaacctggaccaggctcccaggctcctcatttatggtgcgtccgactagggccactggcatcccgagacagattcagtggcagtgcgtntgggacagacttcgactcgtcgtgatcgacagacgtagacccaacagtactttgntgtgtaattcgtnacaatctagtggtctcggcgtagacgtcgaccgtaagggacaacgggtgaagtcaagtcgatgcgtntcgctacntctcgtctcatctccgctacg

SEQ ID NO: 96447 - DNA, 761 bp, Homo sapiens
  misc_feature: GYAE6OF02JR7AP.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctccagataccgacggagaagtgtgtgacgcagtctccaggcaccctgtctttgtactccgagggagagacgcccaccctctccgtgaccgacgggccaagtcaggtacctaagttaggacgcaagtccttacgttacgccgttaggtaccaagacctaaaaaccgtggacccaaggtccgtaccgacggccttacctacgtactttagtcggtcgtaccgtaccgtaccgacggtacccacgtcggaccttacgcccgaacgacgtagtacttacgcggttcgacgacgttggccgttacgacggtactacgttaccgtcgtaccttacgtacgtacggtactaccgactacggtacgtaccggaacccgtaactagtttacttacgtcgttacgtacgttaaccgtagttcgtaacgtaaccgtacgtttaacggtcggttccgtaccgggttacgttaccggttaccggttacccggaaccgggtaaacggtaacccggttaaacggggtaacgtaacgttaaaccggtacgtaacccggtaggttaccggtaggcccgttacggaacctcccggaattccggttacgttaccgtaacgtccggtttaaccccgtccggtacgttacccg

SEQ ID NO: 96448 - DNA, 595 bp, Homo sapiens
  misc_feature: GYAE6OF02G53YM.38.27.C05.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagcccaccctctcctgcagggccagtcagactattaggagcagctacttagcctggtaccagacaaaaacctggccaggctcccaggcctcctcatttatggtgcgtccaccgagggccacgtggcactcccagacagcttcagtggcagtgcgtcgtgggacagacttcactctcgtgatcgacagactacggaccaacgagtatttgctgtgttatacgtgtaacaactactagttcgggtccttccggcgttcggtacgttccggaccgaacgggtaccgtaaagggtcggaaacgttacgaaacgttaccgaacgttgggtacggtacctcggacctaaccgtacgttccgttacgtttccttacgtaccttacccgttcccgaccttaacg

SEQ ID NO: 96449 - DNA, 667 bp, Homo sapiens
  misc_feature: GYAE6OF02I6CJW.38.27.C05.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (308)..(308): a, c, t, g, unknown or other
  misc_feature (308)..(308): n is a, c, g, or t
  modified_base (485)..(485): a, c, t, g, unknown or other
  misc_feature (485)..(485): n is a, c, g, or t
tcagtcgatcacgtcacgaccggtgctcgatttagacgcgatcgaagggtttgggggagctgctcagtttaggacccagagggaaccatggaaaccccagcgcagcttctcttcctcctgccttactctggctcccagatacgacggagaaagtgtgttgacgcagtctccaggccaccctgtctttgtcctccgaggganagacgccaccctntcctgcgaggccagtcagactattaggagcagcttactagctgtacagacaaaactgccagcctccagctcatattangngcgcacgaggaccncgtgacactcccagacagtactacgagttggctaaggtcgtcggttacgtcggaacagttaccgttacaccgttagtccgtagtactacccggtaagacggtaccgtaaccgggaacccaaacgaacgtttaacggttttgtacgttacggttactttaacttaacgtaccgttaanaaaccttacgttagttaccggttccgttaccgggtgttacggttaccggtttaacgggaacccggtaacgggaccgtaaagggttacggaaacttacgtaacgtacgtacgttggaaccggtcaggtacctaccgcttacgttacgttccttacgttacctcccggttaccgaccgttaacg

SEQ ID NO: 96450 - DNA, 628 bp, Homo sapiens
  misc_feature: GYAE6OF02GRLHT.38.27.C05.1.454.CMB.1.raw
  modified_base (323)..(323): a, c, t, g, unknown or other
  misc_feature (323)..(323): n is a, c, g, or t
  modified_base (422)..(422): a, c, t, g, unknown or other
  misc_feature (422)..(422): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctgggggcctcgagtgattgtcccctgccaggcttccggatatatcttcgacttctacttatttacacgttgggtgcgccaggtccctggacaagggcctggagtggntgggatgcatcaaccccagaactggacacaacaaagtcagcacagaagttcgagggacagggtcacatacgaccgagacacgtccatacgaactacacncctacctggaacctcgacgacctacctaaatcctacgacgaaccgtacggtccctacttaacgttactcggtacggaccgtaaggaccgggtaccacggttacgtttacccgaacgttttaacgggttaacttaacggtttcggttacggttttaccggtagtttcggttttacgtttacggtttacgttttccggtaaccggggg

SEQ ID NO: 96451 - DNA, 750 bp, Homo sapiens
  misc_feature: GYAE6OF02I8E4R.38.27.C05.1.454.CMB.1.raw
  modified_base (242)..(242): a, c, t, g, unknown or other
  misc_feature (242)..(242): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgaggggagagacgccacccttctcctgcagggccagtcagactagttaggancagctaacttacgcctggtaaccagaccaaaaacctggaccacggcctacccgaggcctcctactatttagtggtacgccgtccgaccgacgggccacgtcggaccacgtacccagaacagtacttacgagtcggactaggtcgcgtcgtaggaccgaacgtacttctaccgtcgttacgtcgacgtaccgaacgtacggtaccgtaccggaaacccctaacgtaaggtttacttttaacggcgtttacgttagttacgtttaacctcgttactaaaccgttacgtttagggttaccgggttaccgttcccgggttacggttacggtaacccggttccgggtaaacccggtaacgggtaacccggtaaggggttacggtaaaccggttaacgtaacggttaccgtaacggttcggtacgggtcggttacgacccggttaaccgtacgtttaccgttaccggttacctttaccgttaacccgttccccgttaccccgtacttaacccgg

SEQ ID NO: 96452 - DNA, 686 bp, Homo sapiens
  misc_feature: GYAE6OF02GVBQ7.38.27.C05.1.454.CMB.1.raw
  modified_base (151)..(151): a, c, t, g, unknown or other
  misc_feature (151)..(151): n is a, c, g, or t
  modified_base (293)..(293): a, c, t, g, unknown or other
  misc_feature (293)..(293): n is a, c, g, or t
  modified_base (357)..(357): a, c, t, g, unknown or other
  misc_feature (357)..(357): n is a, c, g, or t
tcagtcgatcacgtcacgaccggtgctcgatttagacgcgatcgaagggtttgggggaggcgatcacccagcaaccacatctgtcctctagagaatcccctgagagctccgttcctcaccatggactggacctggagatcgtcttcttggnggcagcagtcaaaggagcccactcccaggtgaaattggtaccagtctgggtttgcgtgaggaagccgttggggcctcgagtgattgtcccctgccaggtccttccggatattatcgttcgacttctactatttacactggtncgcctaggtccctaggacaagggccttgagttcggagtggaactggcagtcaaccccagtaacngggtacacacaaaagttccagaccgtacaaggtaaagttttccgaaggggccgtaaggggttcaacccgtaagtcgaaccccggtagaaccgacgtccgaacttccaaaggttaaccacggtaccctaaccgtaacgggtaaccttacgaacggtaccttaaccccgtaaaaagttacctaagggaacccgtaaccggaccgggtaccccgttacgttaaactttaccgtagtacgtacggagtaacgggcgtaagcgttaccgtaacgttgtaacgttaaagcggtttcggttactagtagttccttttagttagtttcgttacgggg

SEQ ID NO: 96453 - DNA, 556 bp, Homo sapiens
  misc_feature: GYAE6OF02G3JPO.38.27.C05.1.454.CMB.1.raw
  modified_base (237)..(237): a, c, t, g, unknown or other
  misc_feature (237)..(237): n is a, c, g, or t
  modified_base (297)..(297): a, c, t, g, unknown or other
  misc_feature (297)..(297): n is a, c, g, or t
  modified_base (402)..(402): a, c, t, g, unknown or other
  misc_feature (402)..(402): n is a, c, g, or t
  modified_base (414)..(414): a, c, t, g, unknown or other
  misc_feature (414)..(414): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctcaggggagagagccaccctctcctgcagggccagtcagactattaggancagctacttagcctggtaccagacaaaaacctggccaggcctcccaggctcctcatttanggtgcgtccaccagggccacgtggccactcccagacagacttcaggtcggcagtgcgtcgtagggacagacttcactctgtgactcgacagacctggacccaagntatttgcttgtnttattactgtcaactctagtcgggttcctaccgggtcgtgtacggtccgtaccgaagggtccgtaagggtacggatacgtaatacgtactggtcggctgacctacacgttcgttagttccttacaccttccttcccgctacg

SEQ ID NO: 96454 - DNA, 780 bp, Homo sapiens
  misc_feature: GYAE6OF02HQKTT.38.27.C05.1.454.CMB.1.raw
  modified_base (199)..(199): a, c, t, g, unknown or other
  misc_feature (199)..(199): n is a, c, g, or t
  modified_base (351)..(351): a, c, t, g, unknown or other
  misc_feature (351)..(351): n is a, c, g, or t
  modified_base (746)..(746): a, c, t, g, unknown or other
  misc_feature (746)..(746): n is a, c, g, or t
tcagtcgatcacgtcacgaccggtgctcgatttagacgcgatcgaagggtttgggggaggctgctcagttaggacccagagggaaccatggaaacccagcgacagcttctccttcctcctgctactctggctccagatacgaccggagaaagtgtgttgacgcagtctcaggcacccgtgtctttgctaccgagggganagagtccacccttcgtcctagcaacgggtcctaaggcaagacttattagggacgcaagtccttattacggcctagggttaacccagacctaaaaaaaccgtcggtaccaaggaccttcccgaacggccttccctcgtaatttacttcgggcnccggttaccaaccgaagggcctaacgtggaccaacttccccgaagaccgttaagactttacaggtgacaacggtcgtacggtccgtggggacaacgtaccgttaacacctctcgtagacttcggataacgaccgtagaacccgaaagtaagtattttaggccttaggtatttacgtttaaacctggttaaacccgtaaccaagtttaccggttaagggtccgtttttaacccgggagtttcccgggttaaaccgtttccgggaaccgtaaaaacgggggttacccgttaaagggtacgggtaaaggtaacccttaaagggcccgttaaaccgttagggtttccggggaccttacgggacttaaaccggaacttttcggtcgttttacccgtttanaaccggtttccctttaccccgcccggttttaaac

SEQ ID NO: 96455 - DNA, 645 bp, Homo sapiens
  misc_feature: GYAE6OF02H28YE.38.27.C05.1.454.CMB.1.raw
  modified_base (147)..(147): a, c, t, g, unknown or other
  misc_feature (147)..(147): n is a, c, g, or t
  modified_base (195)..(195): a, c, t, g, unknown or other
  misc_feature (195)..(195): n is a, c, g, or t
  modified_base (235)..(235): a, c, t, g, unknown or other
  misc_feature (235)..(235): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccgganaaagtgtgttgacgcagtctccaggcaccctgtctttgctccaggggnagagccaccctctcctgcagggccagtcagactataggancagctatgcctggtaccagcaaaacctgccaggctccaggctctcatttatggtgcgtccaccgtacgggccacgtcggcacgtcccagacagtacttcaggtggcagtcgcgtcgtgggacaggctcactctcgtagactcgaacagtacgtcggaacccaagtagtacgttttgaccttgttacggttaactttactacggtactaaacgtacgttacgttacgggttccgttccgggacggtttacggtaccggtttccgggaacccgtaaacggggtacccgtaaagggtcggtaaacgtacgtaacgtacggtaacgttgggtacgggtaccttcggaccgtaaccgtacgttccgttacggttccttaccctacgtttacccgtttccccggtaccttaaccgg

SEQ ID NO: 96456 - DNA, 679 bp, Homo sapiens
  misc_feature: GYAE6OF02I1M22.38.27.C05.1.454.CMB.1.raw
  modified_base (198)..(198): a, c, t, g, unknown or other
  misc_feature (198)..(198): n is a, c, g, or t
  modified_base (242)..(242): a, c, t, g, unknown or other
  misc_feature (242)..(242): n is a, c, g, or t
  modified_base (265)..(265): a, c, t, g, unknown or other
  misc_feature (265)..(265): n is a, c, g, or t
  modified_base (337)..(337): a, c, t, g, unknown or other
  misc_feature (337)..(337): n is a, c, g, or t
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
tcagtcgatcacgtcacgaccggtgctcgatttagacgcgatcgaagggtttgggggagctgctcagttaggacccagagggaaccatggaaacccagcgcagcttctcttcctcctgctactctggctcccagatacgaccggagaaagtgtcgttgacgcagtctccaggcaccctgtctttgtctccgagggganagacgccacctctcctgcgacgggccagtcagactattacggancagtctaacttgcctggtaccanacaaaacgtgaccaggcctaccgaggtcctctacgtattcgaggtcgcgtaccgacgtcggaccacgtcggnaccgtccgagacagtcttacacgtcgctagtcggcgttacgngggtactacgacgttacncgttcgtccggttgacgtcgaacgacgtaccgtacggaccctaaagtacgttaacgtttcggtaccttaggttacggttaacttacgttacgtaaccggttaaactaccgtttaggtaccggttccgttaccgttcggttacgttacccggttcggaccgtaaacgggtaaccgtagggttacggaacgttacgaagttaccgtagtacggtcggtacgttacgacctacgaccgttacgtcggttccttaacgtccgttaaccttcccggactttaaccgg

SEQ ID NO: 96457 - DNA, 642 bp, Homo sapiens
  misc_feature: GYAE6OF02GDAFX.38.27.C05.1.454.CMB.1.raw
  modified_base (198)..(198): a, c, t, g, unknown or other
  misc_feature (198)..(198): n is a, c, g, or t
  modified_base (406)..(406): a, c, t, g, unknown or other
  misc_feature (406)..(406): n is a, c, g, or t
  modified_base (439)..(439): a, c, t, g, unknown or other
  misc_feature (439)..(439): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgagggganagagccaccctctcctgcagggccaggtcagtactagttaggagcagctacttagcctggtaccagacaaaaaccgtggccaggctcccaggctcctctatttagtggtgcgtccgacgtacgggccacgtggcacgtcccagaccagtacttccgagtggcaaggtcgtccgtcgtgggactagtacttcactctcgtgacttcganacgtacgtacggaaccctaacgattagtttcgngttacggttacgttattaccgtgttacctaactacgttagtcgggttccttccgggcgttacggtaccggtttccggaccgtaacgggtaccgtaaagggttaccggtaacgtaacgaacgttacggacgttcggtcggtacgtcggtaccgaaccttgttccgttacgttccttacgtacctttcccgtccccgacttaccg

SEQ ID NO: 96458 - DNA, 641 bp, Homo sapiens
  misc_feature: GYAE6OF02I3BSP.38.27.C05.1.454.CMB.1.raw
  modified_base (195)..(195): a, c, t, g, unknown or other
  misc_feature (195)..(195): n is a, c, g, or t
  modified_base (390)..(390): a, c, t, g, unknown or other
  misc_feature (390)..(390): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctccagatacgaccggagaaagtgtgttgacgcagtctccaggcacctgtctttgtctccagggganagagccacctcgtcctgcagggccagtcaggactagttagagcagctacttagcctggtaccagacaaaaacctggaccaggcctccaggcctcctctattatggtgcgtccaccgaggccactcggcactcccagcacgatcgagtcgcagtcgcgtcgtaggacagacttcgacctcgtcgtgactcgaacgngacgtcggacccaaacgtacgtatttgtccttgtacgttattactcggttaactaactaacttcggttacgggttccgttaccgggtcggttacggttacccgggttaccgggtaacccgggtaacggaaccgggtaagggttacgggaacgtaacgtaacggttacggttaacgtcggtacgggtctacggacctaccgtacgtacgttacgttacttaccgtaccgttcccttcccgtaccgttaaccg

SEQ ID NO: 96459 - DNA, 781 bp, Homo sapiens
  misc_feature: GYAE6OF02JSGEA.38.27.C05.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtactccagggganagagccaccctntcctgacgacgggccagtcaagtactaagttacggagccaaggtccttaacgttagcccttagggtaacccaggtaccaaaaaccgtgaccgacggacctccccgacggtactccctctaatttacgtacggtcgccgttacccgaaccgtacggggtaccccaacggttacggaccgtaaccgtaccccgaaggaacccgtaggtaaacgtttcccgaaggttcggacgacggttacggccggtttacgtacgggactaacggacctttacgtaaccgttccgtaccgtaggtaccttaccgactaacggaccgttaccggaaccctaaacggtagtaacgttttcgacgttacggttattaacgtttccgtagtaccctaacgtacttaaggttcgggttcctcccggtaggttaccgtaccggtttcccggacggtaaacggggtaccgttaaacgggtcggtaaaccgtacgtaaaccggtcgttaacgtggttccggacgttagtcccgaaaccgttgttaccgttgtaacccgtttagaccgtttcccgttacccggcttaacgg

SEQ ID NO: 96460 - DNA, 678 bp, Homo sapiens
  misc_feature: GYAE6OF02HS5AL.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccgagggagagagccaccctctcctgcgagggccagtcagactattaggagcagctacttagcctggtaccagaccaaaacgtggaccacgctaccgagcctcctctattagtggtcgcgtaccgaccgacgggccctacgtggaccactacccgacgacgagtacttacgaggtacggtctaggttcggtccgttacgggtacggggacaagtacccttcgtaccttacgtcggtagtacgtacgacgtaacgaccgtacggaaacccctaaggtacgtacgttttagacgttaggttcgttaacttacgtacgttaactaaccttacggttagtcggggtttacctcccgggtcgttacggtaccggtttaccggacgtaaacgggaccgtaagggtacggtaacgtacgtaacgtggacgttggtacgcgtaacggcaaccgttatccgttcgtaccgttccctacgttcccgttcccgacttaccg

SEQ ID NO: 96461 - DNA, 696 bp, Homo sapiens
  misc_feature: GYAE6OF02I691Z.38.27.C05.1.454.CMB.1.raw
  modified_base (348)..(348): a, c, t, g, unknown or other
  misc_feature (348)..(348): n is a, c, g, or t
  modified_base (408)..(408): a, c, t, g, unknown or other
  misc_feature (408)..(408): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtcttgctccaggggagagagccaccctctcctgcagggccagtcagactagtaggagcagctacttagcctggtaccagacaaaactgccacggcctccaggctcctctatttagtggtcgcgtcccaccgaggccacgtggcactcccagacagattcaggtcggacnggtcgcgtcgtgggacagtactcactcgtcgtgactcgactacgacgtacggaacccaanaggttattttgacgttagttagttacttacgttggtaacctaactacgttacgttaccggggttccgttaccgggtacggttacggtaccggtttaccgggacccggttaaacggggaacccgttaaagggggttcggaaacgttaccggaaacgttccgggtaaaccggttgggtaccggggtaacgttaccggtaacccgtaacccggttaacgttcccgttttacgggtttaccctttaaccggttaccccgtttacccggtttacccccggaccctttaaccgg

SEQ ID NO: 96462 - DNA, 704 bp, Homo sapiens
  misc_feature: GYAE6OF02IFCHA.38.27.C05.1.454.CMB.1.raw
  modified_base (110)..(110): a, c, t, g, unknown or other
  misc_feature (110)..(110): n is a, c, g, or t
  modified_base (171)..(171): a, c, t, g, unknown or other
  misc_feature (171)..(171): n is a, c, g, or t
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (398)..(398): a, c, t, g, unknown or other
  misc_feature (398)..(398): n is a, c, g, or t
  modified_base (665)..(665): a, c, t, g, unknown or other
  misc_feature (665)..(665): n is a, c, g, or t
  modified_base (670)..(670): a, c, t, g, unknown or other
  misc_feature (670)..(670): n is a, c, g, or t
tcagtcgatcacgtcacgaccggtgctcgatttagacgcgatcgaagggtttgggggagcgtgctcagttaggacccagagggaaccatggaaaccccagcgcagcttcnccttcctcctgcctactctggcctcccagatacgaccggagaaagtgtgttgacgcagtcnccaggcaccctgtctttgctccgagggganagtacgccacccgtctccncgccgagggccctaggtcacgtactagtttacgggacacgacgtcttaaacgttcggccttcgggtaaacctaacgtaccaaaaaaccgtcggacccgaaggcccgtcccgacgaccttccgtacctacgtttaatcgggtcgtaccgtccctaccggtacggtccaccgtccgtacnccgtacccgacgtaaccgacgtaacgtcctacggttacggcgtaacggtcgtaccgtccgttagggaaccgacgtctttacccgacgttccgtcgtcgtaacgttccgaacgccgtacgcggaaccccgaagttacgtacgtttagacgtttcgtaagttcgttaacgtcgtaactacgaaccttagtcgtctacggtcgtacgtcggttcgaccggtagaaccgtaaggtcggaagttccgtaagcgacgtacgtggtacctacgngaccncgtacgtcgtacgtctacctcgtcccgtacgtac

SEQ ID NO: 96463 - DNA, 612 bp, Homo sapiens
  misc_feature: GYAE6OF02J07BJ.38.27.C05.1.454.CMB.1.raw
  modified_base (198)..(198): a, c, t, g, unknown or other
  misc_feature (198)..(198): n is a, c, g, or t
  modified_base (293)..(293): a, c, t, g, unknown or other
  misc_feature (293)..(293): n is a, c, g, or t
  modified_base (433)..(433): a, c, t, g, unknown or other
  misc_feature (433)..(433): n is a, c, g, or t
tcagtcgatcacgtcacgaccggtgctcgatttagacgcgatcgaagggtttggggggagctgctcagttaggacccagagggaaccatggaaaccccagcgcagcttctcttcctcctgctactctggctcccagatacgaccggagaaagtgtgttgacgcagtctccaggcaccctgtctttgtctcgagggganagacgccacctctcctgcgacgggccagtcagactagtaggagcagtctactagcctggtaccagacaaaactgacacggctccgagtcctcctntatttacgtcggtcgcgtccgacgacggacctacgtcggacactaccacgacagacttacgagtcggcagcgtcgtcgtaggactagtacttacactcgtacgtgactacgacacgtacacggacctaatagttattcgngttgttagttactacgtatacctacgttactacgttcgggttctccgggtagttcggtacgttcggtacgaacggtacgtaaggtacgtaacgtacgtacgtacggtagtaggtcggtacgtacgacctacgtacgttcgttaccgttacttacgtaccttccgttaaccctcgtaccg

SEQ ID NO: 96464 - DNA, 643 bp, Homo sapiens
  misc_feature: GYAE6OF02IXTEJ.38.27.C05.1.454.CMB.1.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (351)..(351): a, c, t, g, unknown or other
  misc_feature (351)..(351): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctntcctgcagggccagtcagactataggancagctacttagcctggtaaccagacaaaaacctggaccaggcctcccaggctcctcatttatggtgcgtccaccgagggccacgtggcactccagacagatcagtggcagtcgntcgtgggactagacttcactctcgtgactcgacagacctcggaacccaacgagtagttttcgacttggttagttaacttacgttacgtacctaaacgtacttacgtacggggttcctttaccggggcgttacggtaccggtttccgaccggtaaaacggggaccgttaaacgggtacggtaaacggtacgtaaacgttaccggtaacgttgggtaccggtctacggaaccgtaaccttaacgttcgttacggttccttttaccaacgtttcccctttccccggacttaaccg

SEQ ID NO: 96465 - DNA, 749 bp, Homo sapiens
  misc_feature: GYAE6OF02GQOD2.38.27.C05.1.454.CMB.1.raw
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcgttggtggcagcagtacaaaggagcccactcccaggtagaaattggtccagtcgttgggttggcgtgaggaagcgtgggcctcgagtgagttcgtccctgccgaggtccttccggattagtattccgttacgtaccttcttaacttatttacacgttgggtcgcgtccgacggttccctagggaccgaagggcctggaggtgggtagtgggatcggactacgtacccaaaccccgagaaccgtaggccgaacgaacgtaaacgtctacggaccaaacgtaaggttaaacggtttccgaaggggtccgtaacggggtacccaccgaacgtacggaacccggtaagaacccgtaccgtcctaaacgtaaccgtaaacgaaccgacgtacccttaaaccggcggtaaaccgtccaacgtaccttaacccttaaaacgtcgtaaccggtaaccgaaccggtaccggtaccgttaccgtttaacgttcgtacggttacgacgtaacggcgaaccgtagtaccgttaccggtaacgtttaggtaacttaacggttcgttaacggtttacgtacgtttaggtttcgttttagttaccgtttaggtaccggg

SEQ ID NO: 96466 - DNA, 751 bp, Homo sapiens
  misc_feature: GYAE6OF02JO86V.38.27.C05.1.454.CMB.1.raw
  modified_base (743)..(743): a, c, t, g, unknown or other
  misc_feature (743)..(743): n is a, c, g, or t
tcagtcgatcacgtcacgaccggtgctcgatttagacgcgatcgaagggtttgggggagctgctcagttaggacccagagggaaccatggaaaccccagcgcagcttctcttcctctgctactctggctccagatacgaccggagaagtgtgttagacgcagtctccaggcaccctgtctttgctccgaggggagagacgccacccttctcctgacgacgggcccaggtcaacgtacttaagttagggacgcgaagtcttacttaacgccgttacggaaccaacggacaaaaaccgttcggaccgaaggcccttacccgaacgggcctccctacctaagttttacgtcggttacgcccgttacccgaacccgcgggacccgtaaccgttcgggaccctacggtcccctaaggtaacacggtaactttccggaacggtcggacctaaggtcggccgtcgggttaacggacgtacgaccgttcaccgttcgtacgtcggtatccggaactacggaccgttacggaacccctaaagaacgtttactgtactttacggacgtttaacttacttacggtacttaaactaacgttcgtcgggttacccttcgggtaccgttggtacccgttcgaaccggtaacggaaccgttaagggcgtaaagtacgtaaccggtagtaacgtgggttcgaacggttcaccgtaaccgtgttcccgttagtcccttaaggtccccttcgttaccccgnttaaccgg

SEQ ID NO: 96467 - DNA, 625 bp, Homo sapiens
  misc_feature: GYAE6OF02FZ2N3.38.27.C05.1.454.CMB.1.raw
  modified_base (288)..(288): a, c, t, g, unknown or other
  misc_feature (288)..(288): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatactcttcgacttctacttatttacactgggtncgcaggtccctggacaagggcctgagtggatgggatgcatcaacccagaactgcgacacaaagtctgcaacgagaagtttcgagggctagggtccaaccgtagtcgacccgtagaccgtaccgtaccaatcaaagtacacgtaccctaccgtaggaacctcgacgtcctaaccctaaatccgtagaaccgtacgaaccgggtccgttacttaacgttacgttagtacgacgtaaggacgacgtacgtacgttacccgtcggttacggttaagttaacggtggttaccggttttacggagtttcggttacctttttggttactttcccggtacggggg

SEQ ID NO: 96468 - DNA, 533 bp, Homo sapiens
  misc_feature: GYAE6OF02FON0Q.38.27.C05.1.454.CMB.1.raw
tcagtcgatcacgtcacgaccggtgctcgatttagacgcgatcgaagggtttggggggagctgctcagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactattaggagcagctacttagcctggtaccagcaaaaacctggccaggctccccaggcctcctcatttatggtgcgtccaccagggccactggcatcccagacagattcagtggcagtgcgtctgggacagacttcactctcgtgatcgacagactggacccaacagtattttgctgttgtattactgttacaactactatgggtcttccgggcgttgacgttcggccaagggacctaagggtgaagtcaagtcgtaacgtgtaggtctgcctaacatctcgtcttcagttccttcccgctacg

SEQ ID NO: 96469 - DNA, 820 bp, Homo sapiens
  misc_feature: GYAE6OF02HBFCQ.38.27.C05.1.454.CMB.1.raw
  modified_base (199)..(199): a, c, t, g, unknown or other
  misc_feature (199)..(199): n is a, c, g, or t
  modified_base (243)..(243): a, c, t, g, unknown or other
  misc_feature (243)..(243): n is a, c, g, or t
tcagtcgatcacgtcacgaccggtgctcgatttagacgcgatcgaagggtttgggggaggctgctcagttaggacccagagggaaccatggaaaccccagcgcagcttctcttcctcctgctactctggctcccagatacgaccggagaaagtgtgttgacgcagtctccgaggcaccctgtctttgctccgagggganagagccctaccctctcctgcacgggccagtcagactagtaggancagctacttgcctggtaccagacaaaaccgtgaccaggcctaccaggcctcctactatttatggtcgtccgtaccaccgacgggccctaacgtcggacctacgtccccgaagactagtacttaccgagtcggacgtagtacggtcggtcgtacggggaacacgttaccttaccgtaaccttcgttacgtacgacgtacgtacgtaagtaccgtaccgggtaaccccaaaggtaacgttacgttttacgacgtttacggttaacgtttaacgtttacgtacggttaaccctaaaccgttaacggttaaccggtttacggggttacccctttaccggggttaaccggttacgggtttaaccccggggttaacccgggtaacccgggtaaaacgggggtaacccgttaaaaggggggttaaaccggtaaacggttaaacccgtaaacgggttaacccggtaaggtttacgggtaccgggtaaccttacccgggtacctaaacccgttaccgtttaggttaccccgtttaaccgttacccgttacccgtttaccccgtttaccccgaccttttaacccggg

SEQ ID NO: 96470 - DNA, 541 bp, Homo sapiens
  misc_feature: GYAE6OF02F4Y5X.38.27.C05.1.454.CMB.1.raw
  modified_base (196)..(196): a, c, t, g, unknown or other
  misc_feature (196)..(196): n is a, c, g, or t
  modified_base (291)..(291): a, c, t, g, unknown or other
  misc_feature (291)..(291): n is a, c, g, or t
  modified_base (391)..(391): a, c, t, g, unknown or other
  misc_feature (391)..(391): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgctccagggganagagccaccctctcctgcagggccagtccagactagttaggagcagctacttagcctggtaccagcaaaacctgccagctccagctcctcattanggtgcgtccacgaggcacgtggacatcccgagaccagattcagtcggcagtgcgtcgtgggacacgacttcactctgtgatcgacagtactcgacccaanagtactttgctgtagtatactgtacactatcgtgtcctcggcgttgacggttcggactaacgggaccaaggtacgaagttcaagtacgacgtggtaggctacgccaactacgtcgttcgttacttacgactttcccttacccgactaccg

SEQ ID NO: 96471 - DNA, 945 bp, Homo sapiens
  misc_feature: GYAE6OF02GAKWX.38.27.C05.1.454.CMB.1.raw
tcagtcgatcacgtcacgaccggtgctcgatttagacgcgatcgaagggtttgggggagcatcacccagcaaccacatctagtcctctagagaatcccctgagagctccgttcctcaccatggactggacctggagatcgtcttcttggtggcagcagtacgaaagggacgcccacctcccgaggtagtaaacgttcggtacctagtcgttggggtttggcgtaggaggaagccgtcggggcctcgtagtgtattcgtcccctgccgaggtccttaccggatactactcttcgtactttctactacttttacacgttcggggtcgccgcctacgggttcccctagggtaaccgaaacggggcccttaggtacggtaggggtaacggttacgggggaattcggaccgtacgtaaccccgaaaaccccccgaaggtaaaccggttcgggacccgtaaaccgaaacccgtaaaacggttcccttaacggaacccgtaaccgtaaaggtttaaacgggtttaccggaacggggggttaaccgtacgggggttaacccaaccgtaaccgggtaccggtaaacccccgggaagtaaaccccggtacccggttaaccccaaacgttaacccgaaaaaccgttaacccggtaaaccgtaacccgtttaacccggtaaccggtaaaccctttaccggaacccgttaaccctttaaaccccttaaaacggttacccgttaacccgggaaacccggtaaaccggttaacccccggtacgtttaaccctttaacgtttacggttacgttcgaaccgggtaagggtacccggaacgtaacggtttaccggttaaccgtacgggtttaaggttaaacggttaggtttaccggttccgggtttttagaccggtttaacggttttcgttttaacgggtttaggtttcccgggtaaccgggg

SEQ ID NO: 96472 - DNA, 673 bp, Homo sapiens
  misc_feature: GYAE6OF02H3O5C.38.27.C05.1.454.CMB.1.raw
  modified_base (146)..(146): a, c, t, g, unknown or other
  misc_feature (146)..(146): n is a, c, g, or t
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (650)..(650): a, c, t, g, unknown or other
  misc_feature (650)..(650): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctccagatacgaccgganaaagtgtgttgacgcagtctccaggcacctgtctttgctccaggggnagacgccacctncctgcagggccagtcagactagtaggagcagcttagtgacgtggtacagacaaaaacctggaccaggctacccaggcctccgtanattttanggtgccgtaccacgacgggccaacgtggacactacccagacgagtattcaggtgacgtagtcgtacgtgtacggactaagtacgttacacgttcgtcgtagacgtcgaacgacgtaacgaccggttaaacccaacgtacggtattttccgacgttagtaggttaacctttaagttacgtaacctaaacgtaaccgttaggtttacgggttaccgttccgggtacgggtttaccggtacgggtttaccggaaccggtaaaccgggaacgttaaacgggtagggtaaacctaacgaacgttaccgggtattcgggtacggtcgtacggtacaaccttacgtcttgttaccttacnccgtttcctacccgtactaacgg

SEQ ID NO: 96473 - DNA, 680 bp, Homo sapiens
  misc_feature: GYAE6OF02H5X82.38.27.C05.1.454.CMB.1.raw
  modified_base (267)..(267): a, c, t, g, unknown or other
  misc_feature (267)..(267): n is a, c, g, or t
  modified_base (318)..(318): a, c, t, g, unknown or other
  misc_feature (318)..(318): n is a, c, g, or t
  modified_base (456)..(456): a, c, t, g, unknown or other
  misc_feature (456)..(456): n is a, c, g, or t
tcagtcgatcacgtcacgaccggtgctcgatttagacgcgatcgaagggtttggggagcatcacccagcaaccacatctgtcctctagagaatccctgagagctccgttcctcaccagtggactggacctggaggatcgttcttcgttggtggcagcagtacgaaaggacgtccactcccgaggtagtaaagttcggtaccgagtcgttgggtttcggacgtaggaaggacgccgtgggcctcgagtgtacgttcgtccctgaccgngtcgttccggatacgtatccgttcgacttactacttattacgacgtggtcncgtacgtcgtacccgtggtaacgaacgggtcctaggtgtaacggtgtaggtacgtcgtacgtactcccggaaacccgtaagaacgtgggaccaacgacgtaacgtacgtcgacgtacgaaggttacgttacgacgganacggtacacgtacgacgacgacgacacgtacaatacgaatccgactaccctaggtaccgaactacgtactaccttaacgtaactacctacggaccgtaccgaaccgtcgttacgtaacgtcgttgacgtacgacgacgactacgttacgttactcggttaagtacgtacgttaccggttcgttacgtacggttcgtttacggtactttccggttacgaccgggg

SEQ ID NO: 96474 - DNA, 787 bp, Homo sapiens
  misc_feature: GYAE6OF02FX3BX.38.27.C05.1.454.CMB.1.raw
  modified_base (779)..(779): a, c, t, g, unknown or other
  misc_feature (779)..(779): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggcctccagatacgaccggaagaaagtgttgttgacgcagtcctccgaggccacccttgttctttcgtcctccgaggggagagacgcccacccgttctccgtgacgtacgggcctagtcagtacttagttaggacgacacgtacttaacgttacgccgttggtaaccagaacctaaaaaccggtcggaccgaacggtcctacccgaacggtcccttacctacttaactttagttcgggtcgtaccggtaccccaaccggtacgggaccctaacgttcgggaccaccgtaccccgaagtaacctaagttacttacgaaggttcggaccgtaggtcgtcgttacggtacgggtaactacgttaccttcgaaccgttcgtaccggtgaacgttccgaacgtacgtaccggttaccggaaaccctaagtaacgttcgttttacggcgttagttacgtaactttacgtacggttaaccaacgttacgttacggtccggttaccgttcccgggtacgttacggtaccggttaccggaaccggtaacgggtaccgtaagggtacgtaacgtacgtaacggttacgtacgtggtacggtctacggtaccctaacgttcgttaccgttcggttccttaccggtacccgttcccgttaccccngttaaccg

SEQ ID NO: 96475 - DNA, 591 bp, Homo sapiens
  misc_feature: GYAE6OF02F3MR8.38.27.C05.1.454.CMB.1.raw
  modified_base (197)..(197): a, c, t, g, unknown or other
  misc_feature (197)..(197): n is a, c, g, or t
  modified_base (371)..(371): a, c, t, g, unknown or other
  misc_feature (371)..(371): n is a, c, g, or t
  modified_base (408)..(408): a, c, t, g, unknown or other
  misc_feature (408)..(408): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctcgagggganagagccaccctctcctgcgagggccagtcaagacttagttaggagcagctaacttagccgtaggtaccagaccaaaaaccgtggccaaggcctccgaggcctccgtctagtttagtggtcgtcgtccgaccgtagggccacgtggcactcccaagacagtattcaggtcgacgngtgcgtcgtggacagacttcgactcgtcgtgatcganacgtacgacgaaccaagagttattgctgtacttacttctgtacgaactacgtagtgggttcctccgggtcttggaccgttcggacgtacgggactaagggtgaaacgtcaagtaccgtacgtggtcgtcgacgtaccaccagtttccgtgttccttacactttcccgttacccgccgttaacg

SEQ ID NO: 96476 - DNA, 551 bp, Homo sapiens
  misc_feature: GYAE6OF02GS9QZ.38.27.C05.1.454.CMB.1.raw
  modified_base (197)..(197): a, c, t, g, unknown or other
  misc_feature (197)..(197): n is a, c, g, or t
  modified_base (426)..(426): a, c, t, g, unknown or other
  misc_feature (426)..(426): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagcccaccctctcctgcgagggccagtcaagactaataggagcagctacttagcctgtaccagacaaaaaacctggccaggcctcccaggcctcctctatttatggtgtccgtccaccgacggccactggacactcccagacagactcagtgcaggtgcgtgtacgggacagtacttcacttcgtcgtgatcgacagtactcggaacccaagtagtatttgtctgtntaatactgtactaactactagtcggttctccggacgtgaccggttcgacgaaggaccaaggtcgaagtcaagtcgagtgtaggtcacgcaccgtatcgtgttccttcactttcctccctataccg

SEQ ID NO: 96477 - DNA, 884 bp, Homo sapiens
  misc_feature: GYAE6OF02FTLQ6.38.27.C05.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctcaggccacctgtctttgtctccgagggganagagccaccctctcctgcgaggccagtcagtactagttaggagcagtctactacgccgtaggtaccagacaaaaccgtcggaccacggtcctacccgacgggccttaccctccgtaagtttttaacgtcgggtcggcccggtacccgtaacccgacgggggtcccaccgttacgggccaaccgttaccccgacggaacacggtactttaccggaaggttcggggacctaacggttcggaccggttaccgggttacggggaacccgtacggttaaccctttccgaacccgtttaccgtcggtacggttaaccgtaccgggtaacaacggttaccggttaacccggaaccccgtaacgttaacgggtacgtttttacggtacgtttacggttaacgtttacgtttaaccgttcggtttaaaccctaacgggttaaccttttacggggttaccgggtttccttacccggggttgttacccggggttaaccgttcccggggtaacccggtaaccgggggttaacggtaaacggggttacgtaaacgggttaacgtaaacgtttacccggtaacgtttcgggtaccgggttatacccccgggtacctaaccccggttacgttaacccgttttccggtttacccgtttaccgttaccgttttaccccccgttacccggtacccgttaacccgg

SEQ ID NO: 96478 - DNA, 673 bp, Homo sapiens
  misc_feature: GYAE6OF02FXJ1I.38.27.C05.1.454.CMB.1.raw
  modified_base (148)..(148): a, c, t, g, unknown or other
  misc_feature (148)..(148): n is a, c, g, or t
  modified_base (197)..(197): a, c, t, g, unknown or other
  misc_feature (197)..(197): n is a, c, g, or t
  modified_base (368)..(368): a, c, t, g, unknown or other
  misc_feature (368)..(368): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagactacgaccgganaaagtgtgttgacgcagtctcaggcacctgtctttgtcctcgagggganagacgccaccctctacctgccagggccagtcaggacttaagttaggacgctacggcttacgttacgccgtaggtacccaagacaaaaccgtcggaccaggcctccgaggtccgtcctactagtttactggcgtcgtccaccgacgggccacgtcggacctacgtccagacncgtacttcgagtcgcacgtgcggtctggacacgtactcactctcgtgacgtcgacgagtactacgacccaagtagtactttgacgttgttacgtaatcggttatacgtaactacgtaggttcggttcgtaccgggtcgttacggtaccgggttacccgaccggtaaccgggtaacgtaacgggttaacggtacggtaagtaacccgttacggtaacttcggtaccggtacggtacgaacccgtaactaccgtttacggtacttaccgtttaccgtccctttacccgttacccggtaccttaacgg

SEQ ID NO: 96479 - DNA, 878 bp, Homo sapiens
  misc_feature: GYAE6OF02GMIDD.38.27.C05.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtcgttgacgcagtctccaggcaccctgtcttgtctcgagggganagagcccaccctctcctgcgacgggtccagtcagtaccttagtagggacacacgtccttacttgccgttacggtaaccacgaacctaaaaaccgtcggaccgtaacggtcctacccgaacggtcctaccctatatttacgtcggtcgtccgtacccaccggtaccggacccgaccggttcggacctaaccgttcccgaacgaacgacgttaacgttccgtaaggtcggacgtacggtagtccggtttacggtacgggtaacctacggttacgtttacccgtacgttacccggttccgtacggtaacgttcccgggtaacgtaccgggtaccgttacccgggaaaaccccttaacggtacgtttaacgggttttaccgaccgttttaggttaccgttttaaccgttaaccgttcggtttaacccctaaaccgttaaccggttacggtttaccgggttacccggtttcccgggttaccggtttcccgggtttaaccgggtaccccggttaaacgggggaaacccggttaacgggttaaccggggttaacggtaaacggtttaaccgtacggttaaccgtaccggtttaggtcggttaccgtaaccggtaccctaaccggttacgttaccggttcggtttaccttaaccggttccctttacccgttacccgattttaacccggg

SEQ ID NO: 96480 - DNA, 730 bp, Homo sapiens
  misc_feature: GYAE6OF02JV3ZE.38.27.C05.1.454.CMB.1.raw
  modified_base (197)..(197): a, c, t, g, unknown or other
  misc_feature (197)..(197): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctccagatacgaccggagaaagtgtgttgacgcagtctccaggcaccctgtctttgtctccgagggganagagccaccctctcctgcagggccagtcaagtactagttaggagcacgtcttactacgccgtggtaaccagacctaaaaaccgtcggaccgacggacctacccgacggcctacctcgtaatttagtggtcgccgtaccgaccgtacgggcctacgtcggacctacgtacccgagacacgtacttcgacggtcgaccgtaggtcgtcggtacggtacgggaactacggtaccttactacgtcgttacggtcgtaacgttcgaacgtacggtacccgtaacgggtaacccctaaacggtacggttaccgttttacgtcgttaggttacgtttaaacgttcgttagtaacgtaaccttacgttaacgggttcggttccgttacgggtacctacgggttacggttccggtaacggtaacgggtacggtaacgggtcggtaaacgtacgtaacgtaccggtacgtacggttggaccgtgaaccgtccgtaacgttccgttacggttaccttacgtccgtttcctccggtaccctacgg

SEQ ID NO: 96481 - DNA, 492 bp, Homo sapiens
  misc_feature: GYAE6OF02G9BMX.38.27.C05.1.454.CMB.1.raw
  modified_base (197)..(197): a, c, t, g, unknown or other
  misc_feature (197)..(197): n is a, c, g, or t
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (425)..(425): a, c, t, g, unknown or other
  misc_feature (425)..(425): n is a, c, g, or t
  modified_base (467)..(492): a, c, t, g, unknown or other
  misc_feature (467)..(492): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagngcccaccctctcctgcaggccagtcagactattaggancagctacttagcctaggtaccagacaaaaaccgtggaccacgacctcccgaggcctcctactatttatcgggtgccgtaccaccgaggcccacgtcggaccacgtcccgagacatacttcaggtcgnagtgcgtcgnggactacgacttcactcgtcgtagtatcgactacgtactcggaacccaanacgtatttcgcttgtacgtattacgtagtactaactacgttnnnnnnnnnnnnnnnnnnnnnnnnnn

SEQ ID NO: 96482 - DNA, 719 bp, Homo sapiens
  misc_feature: GYAE6OF02GM7V1.38.27.C05.1.454.CMB.1.raw
  modified_base (196)..(196): a, c, t, g, unknown or other
  misc_feature (196)..(196): n is a, c, g, or t
tcagtcgatcacgtcacgaccggtgctcgatttagacgcgatcgaagggtttgggggagctgctaagttaggacccagagggaaccatggaaaccccagcgcagcttctcttcctcctgctactctggctcccagatacgaccggagaaagtgtgttgacgcagtctccaggcacctgtctttgtctccagggganagagccaccctctcctgccagggccagtcagactataggagcagcttactagcctggtaccagcaaaacctggccaggctccaggctcctcattatggtgcgtcaccagggccacgtggcacgtcccagaaccagtacgtttacgagttcggcgtacgtggtaccggtcgttacgggacgaggtacttacgaaccttcgtacgtcggtaacgtccggtaccgaaggtacccgttacgggtaaaccccctaaacgtaacggtaactttttggtaccgttaggtttaacggttaacttttaacgttacggtaaccttaaacgtaaccgttaacggtttaccggggttaacccgttaccgggtaccggttacgggttaccccgttacgggtaacccggtaacggtaacccggtaagggtacgggtaactcggtaaattacggaccgttagtcgggacgtacggtaccaaccgtacgttaccgttgttacccttacgtaccttccggtaccccggtatccgttaccg

SEQ ID NO: 96483 - DNA, 634 bp, Homo sapiens
  misc_feature: GYAE6OF02GTGJK.38.27.C05.1.454.CMB.1.raw
  modified_base (261)..(261): a, c, t, g, unknown or other
  misc_feature (261)..(261): n is a, c, g, or t
tcagtcgatcacgtcacgaccggtgctcgatttagacgcgatcgaagggtttgggggagctgctcagttaggacccagagggaacccatggaaaccccagcgcagcttctcttcctcctgctactctggctcccagatacgaccggagaaagtgtgttgacgcagtctccaggcaccctgtctttgtctccaggggagagagcccaccctctcctgcgagggccagtcagactattaggagcagctacttagcctgtaccngacaaaacctggccaggctcccaggtctcctcattagtggtgcgtccacgacgggccacgtcgcactcccagaccagattcgagtcgctagtgcgtcgcggacaggactcactcgtcgtgatacgtacacgaccgtcggacccaacgtagtatttcgcttgttacgtacttacgtgttacgtaactacgttagtcgggtaccttccggtcgttaggacccggtttacgggacccgtaacggggaccgtaagggtacggtaacggttacaaacggttaccggtaacgttggtacggtccgttcggtacccgaactacgtttccgtcggtttacctttacccgtaaccgttccgtttacccccggccgttaaccg

SEQ ID NO: 96484 - DNA, 841 bp, Homo sapiens
  misc_feature: GYAE6OF02IUSJM.38.27.C05.1.454.CMB.1.raw
  modified_base (197)..(197): a, c, t, g, unknown or other
  misc_feature (197)..(197): n is a, c, g, or t
  modified_base (242)..(242): a, c, t, g, unknown or other
  misc_feature (242)..(242): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgacggagaaagtgtgtgacgcagtctcaggcaccctgtctttgtacctccgagggganagacgccaccctctccgtgcgacgggccagtcagactagtaggancagctacttacgctaggacagacaaaactgacaggctaccaggctccnctattagtggtnccgtaccacgtacgggcctacgtcggacactacccgaagtacgacgtacttaccgaaggtcggaacgacggtcgtaccggttacggtcggggtaacctaacggttacccttacgaacccgtttcgtaccggttacggaacgtttaccgggaaactaccggtaaaccggtaccgggtaaaccctaaacgtcggttaacgtttttaccggacgtttacgggttaacgtttaaacgtttaaccggttacggtaaaccttaaaccgtttaccgttaacgggtttaccgggtttaccggttcccgggtttacgggttaaaccgggttaaacccggggtttttacccggggaaacccggggtaaaccggggttaaaccccggtttaagggggttaacgggtaaaccggttaccgtaaacgttaaccgggttaacgggtttcgggtaaacggtccggttaacggtacccgttaaacgtaccggtttaccttaccggtttaccgtttaccgtaacccgtttcccggtttacccggtacccttaacgg

SEQ ID NO: 96485 - DNA, 792 bp, Homo sapiens
  misc_feature: GYAE6OF02IL5MM.38.27.C05.1.454.CMB.1.raw
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggcgacccactcccaggtgaaattggtccagtctgggttggcgtgaggaagccgtggggcctcagtgacttcgtcccctgccaggtccttccggatatactcttcgacttctactattacactgggtgcgccgtaggtccctggacaagggcctggtacggtaggacgttggggaatcggctaacgtacccgaaaccccaaaggtaaccgtcgggtaccgaaaccaaccgtaaaagtccgtacggaccaacgaaggttaaacggttttaccggacggggtacggtaacgggtaccccgaacccgtacggttaaccgggaaaccccgtaacgggtaacccgtaaaccggtacccctaaagtaccctaaaacgtaaccgtaacccggtaccccttaaccgtaaccggtaaaccttaccgtaccgttacccgtaaaccccttaaagtcccgtaacgaacccggtacgtaacccgggtccgttactaacgtttaaccgtcggtaacgtaccgtaaggaacggtccgtaagtaccggttacctaacgggttaacgttaacgtaaccggttacgttaacccgggtttcgaacgtttccgggttactttacggttaccgttaccggtaacccgggg

SEQ ID NO: 96486 - DNA, 885 bp, Homo sapiens
  misc_feature: GYAE6OF02I1AI2.38.27.C05.1.454.CMB.1.raw
  modified_base (200)..(200): a, c, t, g, unknown or other
  misc_feature (200)..(200): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggcctcccagatacgaccggagaaagtgtgttgacgcagtctccgaggcaccctgtctttgtctccgagggganagacgcccacccttctccgtgcgacgggccaggtcagactagttaggagcagctacgttagcctggtaccagacaaaaccgtgaccaggcctccgaaggtctccgtctactttatggtcgcgtaccaccgtacgggcctacgtggccacgtcccgaagacctaggtacttacgacgttcgggactaacggtcgccggttacgtacgggaactacggtaacttcctaaccgttccggtacggttacggtaaccgttaccgggtaaaccggtaacgtaacccggtaaccggggtaaaaccccctaaacggttaaacggtttaccgtttttaccggaaccgttttacggggttacgtttaaccgtttaaccgttttacccggttaacttaaaaaccccgttaacgtttacgggtttacccgggggtttaacccctttaccggggggtaacccgtttacgggttaaaccccgggttcccgggtaaaccccgggtaaaaggggtaaacccccggttaaagggggttaacgggtaaaccggttaaaccgttaacggttaacccgtaacgggtttcgtacccggggtaacgtttaaccggacccgtaaaccggttaaccgttcggttaccggtttaccggtttaccgtaaacccggtttttcccccgtacccgggttaacctttaacccggg

SEQ ID NO: 96487 - DNA, 766 bp, Homo sapiens
  misc_feature: GYAE6OF02GBEI3.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactcgtggctcccagatacgaccggagaaagtgtgttgacgcagtctccaggcaccctgttctttgtctccgaggggagagagcccaccctctcctgcgacgggccagtcagactagttaggagtcagtcttacttcgccgttaggtaccagaaccgtaaaaaccgtcggaccgacggaccgttaccccgaacggtcccttaccgtaccttaagttttacgtcgggtacgtaccgtacccgaaccggacgggtaccctaacgtcggactaacctcccgaacgaactaacgtacgttaccgaggtcggacgtaacgtcggtcggtcggtacggaacgtaggtacccttacgtaccgttcgtcggtaacgttacgtaccgtaacgacgtaccggtaccgaaccccgtaagtaccgttagttttacggacttagttacgttaacttacgtacgtaacctacgtaacgttaggttcggttcccgttaggtaccggttaggtaaccggttccggaaccgggaacgggtaaccggtaagggtaacgtaacggttaaccttaggtaaccgtatacggggtcgtacgccgtaaccgacgttacgttccgttacgttaccgttagttacccgtcccgtttacccgagttaccgg

SEQ ID NO: 96488 - DNA, 746 bp, Homo sapiens
  misc_feature: GYAE6OF02GJNLL.38.27.C05.1.454.CMB.1.raw
  modified_base (168)..(168): a, c, t, g, unknown or other
  misc_feature (168)..(168): n is a, c, g, or t
  modified_base (182)..(182): a, c, t, g, unknown or other
  misc_feature (182)..(182): n is a, c, g, or t
  modified_base (284)..(284): a, c, t, g, unknown or other
  misc_feature (284)..(284): n is a, c, g, or t
  modified_base (346)..(346): a, c, t, g, unknown or other
  misc_feature (346)..(346): n is a, c, g, or t
tcagtcgatcacgtcacgaccggtgctcgatttagacgcgatcgaagggtttgggggagcatcacccagcaaccacatctgtcctctagagaatccccgtgagagcctccgttcctcaccatggactggacctgggagatcgtcttcgttggtgcagcagtcaaaggncccactcccaggtnaaagttggccagtcgtgggttgcgtgaggagcgtgggcctcagtgattcggccctgccagtcttcggatatatctacgacttctactatttacacgtggtancgcctaacgggtccctagggaaccagggcctggagtggagtgggatgcacgtccaaccccgngtaacgtcggacgaacaacgtaaagtcgtcgacgtaaccaaggttaacgttacgaacggggctaacggggttaccaaccgtacgtacgacccggaactacgaaccgtaccaagtaaccttaactaaaccgtaccgtaaccccgttaacgtacggtaaaacctctaaaccggtacctaacccgtaaaacttccggtaaccggaaacgtaacccggtaccggtacccttaacggttaaccttacggtaaccgtcgaaccgggtaacggtaacggtcgtaacggtacccgtttacccgttaaggtttacggtaaaccgttaaccgggttccggttttaacggttttaacggacttttaccgggttaaccgttttacggttacggttttaccggggaacccggg

SEQ ID NO: 96489 - DNA, 839 bp, Homo sapiens
  misc_feature: GYAE6OF02JUYYH.38.27.C05.1.454.CMB.1.raw
  modified_base (149)..(149): a, c, t, g, unknown or other
  misc_feature (149)..(149): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactcgtggcctccagactacgaccgganaagtgtgttagacgcagtcctaccgaggcctaccctgttctttcgtcctaccggaggggagacgaccgccctacccttcgtccgtcggaccgacgggcccacggtaccaacgtaaccttagtaggaacgcaacgtaccttaccgttacggtccgtacggtaacccaagaaccgtaaaaccgtcggaccgtaccggccgtaccccgacggtacctacccttacgttaacgttttcgtcgggtacgtcccgtacccgaaccggtaccggtaccaccggttcggacctaaccgtccccgaagtaaccgtaacgttacctaccgtagggtacgtaccgtacggtcgtaccggttcggtaacgggtaacgtacgttaccgttacgtacgttccgtaacggtacgtacgtaaccggtacgtaaccgggtactaacccggaaccgtaagttaacgttacgtttaggtcttacggttacttacgttaacgtacgttaactaaccgttacgttacggtccgggttacgtaccgggtcgttacggtaccggtacggaaccggtaacggtaacggttaagggtacgtaacgtaacgtaagtacggttaccgtgggttaccgtaaccgtcggtaaaccgtccgtttacgtacccgtttattaccgtttaacctccggtttacccgttacctaccgttaacgg

SEQ ID NO: 96490 - DNA, 813 bp, Homo sapiens
  misc_feature: GYAE6OF02IIUTL.38.27.C05.1.454.CMB.1.raw
  modified_base (134)..(134): a, c, t, g, unknown or other
  misc_feature (134)..(134): n is a, c, g, or t
  modified_base (512)..(512): a, c, t, g, unknown or other
  misc_feature (512)..(512): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctccanatacgaccggagaaagtgtgttgacgcagtctccgaggccaccttgtctttgtcctccgagggagagacgcctaccctcctcgtgacgacggccagtacgacgtactagttaggagaccgagtccttacgtacgaccgttcggtaaccaacgtaaacctaaaaaccgccggaccgacgggtaccctaccccggtacggaccttcccgtaacgttaacgttttacgtcgggttcggtcccgtacccgaccggtaccggtccgtaaccggttccggaacctaccgccccgaagaccgtaagtacttaccgaggtcgacgtagtccgtcgacggtacggaactacgtcttaccgtacgtcgttcgagttaactaccggaanaccgttacggtaccgaaaccgtaacgtaaggtttctttaggtcgttagttaacgttaacgttcaaggttaccctaagttaccgttacggttacgggtttcccgttaccgggttataccgggttaccggttacccgggaaccggtaaaccgggttaaccgtaacggtaacgggttaaactcgggttaaacccgcgggtttaccgttacgggtccgtaaccggtcccgttacgaaacccgtttagttccggtttacgttacctttacccgttaacgttttccccctacccgttaacgtaccgg

SEQ ID NO: 96491 - DNA, 680 bp, Homo sapiens
  misc_feature: GYAE6OF02FOGW7.38.27.C05.1.454.CMB.1.raw
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
  modified_base (337)..(337): a, c, t, g, unknown or other
  misc_feature (337)..(337): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctcccagatacgaccggagaaagtgtgttgacgcagtctccaggcaccctgtctttgtctccagggganagagccaccctctcctgcaggccagtcagactatagagcanctactgctgtaccanacaaaacctgaccagctccaggtcctctctatttagtgtgtctccgacgacgggcctacgtcggacactccgagacagtatcgngtcgcgtagtcgcgcgtcgggactacgtacgttcacctacgttacggtcgtacgtacgacgtagtaaccgtacggaaaccccgtaacgtacgtacgtttttcggctttacggttacgtttacttaccgtttagtacttaaccgtaacgtttacgttacgggttccgtttaccgggtcgttacgggttacccggtttccgggaaccgttaacggggaccggttaacggggtaacggttaacgtaacgttaacgtaccgttaacgttcgggttacggccgttaccgacgtaacctcgttaccgttagttccttaccgttcctttcccgttacccgtacgttaccc

SEQ ID NO: 96492 - DNA, 601 bp, Homo sapiens
  misc_feature: GYAE6OF02G8F8W.38.27.C05.1.454.CMB.1.raw
  modified_base (286)..(286): a, c, t, g, unknown or other
  misc_feature (286)..(286): n is a, c, g, or t
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcagtcaaaggacgcccactcccaggtagaaattggtccagtcgtgggtttgcgtgaggagctgggcctcagtgattcgtccctgccgtaggccttccggatactatctcgacttctactatttacatggtncgcaggtccctggacaaggcctgagtggatgggatgcatccaacccagaactcggacaacaacgaaagtctagcaacgagtaagtttcgagggcgaggtaccactagtacgacccgagaccacgtcaactacaatacacgtacctaacgtacgaactcgactacctaacctaaatctacgacacgaccggtcgtactactactgtcgtacgaagtacgagtaccgtacgttactacggttacggtaaagttacggtacggtttacggtttacgtacgttaggtttaccttttaggttagtttaccggtaacgggg

SEQ ID NO: 96493 - DNA, 664 bp, Homo sapiens
  misc_feature: GYAE6OF02ILDSU.38.27.C05.1.454.CMB.1.raw
  modified_base (253)..(253): a, c, t, g, unknown or other
  misc_feature (253)..(253): n is a, c, g, or t
  modified_base (517)..(517): a, c, t, g, unknown or other
  misc_feature (517)..(517): n is a, c, g, or t
  modified_base (658)..(658): a, c, t, g, unknown or other
  misc_feature (658)..(658): n is a, c, g, or t
tcagtcgatcacgtcacgaccggtgctcgatttagacgcgatcgaagggtttgggggagctgctcagttaggacccagagggaaccatgggaaaccccagcgcagcttctcttcctcctgctactctgctcccagactacgaccggagaaagtgtgttgacgcagtctccaggccaccctgtctttcgtctccgaggggagacgacgcccacccttctcctggcgcgggaccagtacagtactagttaggacncacgccttacgttacggccgtaggtaccaagacctaaaaaccgtcggaccaggcctacccgaggtcctaccctactactttagtcggtcgtaccgtccaaccggacgggtccacggtcgactacctacccgagactagtacttcgagtcggctagtcggacgtagtcggaactacgtacttacgactcgtcgtagtactacggacacggtacgtaccggaaccctaacgtagttactttcggacgtttgttagttacttacgtntaaccgtaattcgttacggttcggttccttccgggcttacgtaccggtcgacgtaacggtacgtagtacgacgttaacacgttacgtacgtggtacgcgttacactaacgttgtcgttactttcacttaccgtcttcccgnttacgg

SEQ ID NO: 96494 - DNA, 869 bp, Homo sapiens
  misc_feature: GYAE6OF02HS9O2.38.27.C05.1.454.CMB.1.raw
tcagtcgatcacgtcacgaccggtgctcgatttagacgcgatcgaagggtttgggggagcatcacccagcaaccacatctgtcctctagagaatcccctgagagctccgttcctcaccatggactggacctggaggatcgtcttcttggtggcagcacgtacgaaaggacgccctacgtcccaggttagaaattcggtcccaaggttcgttggggttttcggacggttggaagggaaggtcccgtgggggtccctcgtaggttacgtacgtttcggtccccctggacccgtaaggtcccgtttacccgggtaattaacgtactttccgtttacgtacccttttacctttaaccgtttaacttttaccgaaccggtttggggttaccgccgtacccgtaacggggttcccccttaggggaacccgaacgggggtcccttagggtaaccgggttaggggtaaggttgggggtaactcgggtacctaaccgtaacccgtaaaccccccggtaaggaaacccgtcgggggaaccctaacgaaacgtaaacggttctaacggacctaacggtaacgggttaacttttacgggaaggggtccgaacgggttacaccgtagtccggaaccgaacgacctaccgtacacgtacaaactcgacctacctacgacgaactcgaacctccttaaccaacgtcaaccggacgtacccgaaccgttacccgtaattaccggttactcgggtacacggaggacgtactaccgttaaccgtttacccgtaaggttaggttaacgttaacggtttccggtttacggttttaacggacgttttacgttacggttttttagttaccggttttacgggtaacccgggg

SEQ ID NO: 96495 - DNA, 858 bp, Homo sapiens
  misc_feature: GYAE6OF02IBHKQ.38.27.C05.1.454.CMB.1.raw
tcagtcgatcacgtcacgaccggtgctcgatttagacgcgatcgaagggtttgggggagctgctcagttaggacccagagggaaccatggaaaccccagcgcagcttctcttcctcctgctactctggcctccagatacgaccggagaagtgtgttgacgcagtctcaggcacctgtcttgctcgaggggagagcgcctacccgtctcgtagcgaggtccagtcaagtacttagttacggacagacgtaccttacttacggaccgttggtaacctaacgaacctaaaaccgtggaacccgacgtccgtaccgaacgccttacctaccttaagttttaggttacggtccgtacccgtacccgtaaccggtacgggtccaccggttcggaccttaccggaacccctagaaaccgtacgttaccgttacgacggtcggtactaacgggttcgtaccggtacgggttacgggaaccttacggttaacttaccgttaccgttacgttcggttaacggtactaaccggtaacgttaccggaaccgtaccggtaaaccctaaaccggttgttaacgttttacgacggtttaacgttacgtttaaccgttacgttaccggtaacccttaaacgttaccggttggtttaaccgggtcccggttaacgtcccgggtttaacggttacccgggttaacgggaaccgttaaccggggtaacggttaacgggtacggttaacgaaccggttaagttcccggaaacggtttcggtaacggaccgttaacccggacgtttaacctacggtttacccgttaggtttccctttaaaccggttcccctttacccggttaccccgaccctttaacgg

SEQ ID NO: 96496 - DNA, 905 bp, Homo sapiens
  misc_feature: GYAE6OF02GCENV.38.27.C05.1.454.CMB.1.raw
  modified_base (164)..(164): a, c, t, g, unknown or other
  misc_feature (164)..(164): n is a, c, g, or t
  modified_base (175)..(175): a, c, t, g, unknown or other
  misc_feature (175)..(175): n is a, c, g, or t
  modified_base (192)..(192): a, c, t, g, unknown or other
  misc_feature (192)..(192): n is a, c, g, or t
tcagtcgatcacgtcacgaccggtgctcgatttagacgcgatcgaagggtttgggggagctgctcagttaggacccagagggaaccatggaaaccccagcgcagcttctcttcctcctgctactctggctccagatacgacggagaagtgtgttgacgcagtcncaggcaccgtntctttgctcgagggganagcgccacctctctgcgacggcctagtcgacgactagttacggagtacgagtaccttacgttacgccgttaggtaaccagaaccgtaaaaaccgtcggaccgaacggtcctacccgacggtccttacctacgtagttttagtcgggtacgtacccgtacccgtaaccggtaccgggtacccgtacggtaccggtaacctaccgttaccccgaacggtaaccgtaggttaacttacgtacgggttcggaccgtaaggtccggttacgtccgggtacggtacgaacggttaccgttaaccgtacgttacgttacggtcggttacgtaccgggttaccgtaacggtaacccggttaacccggaaacccgtaaccgggttaaacggtttaacgttttacggtaccggtttaggttaacgtttaaccgtttacgttaaccggttaacctaaaccggtttacgttacgggttttaccgggtcccggtttcgggttaccgttaacgggtttaccccgggttacggtaaaccccggggttaaacggggtaacccgggttaaacggggtttacgaaaccggttaaccggtaacggttcccgttaacgggtaccggttaccgtaaccgggttacgttaaaccccgcggtttaacccgttacggttaccggttcgtttaaccccgttaacccggtttacccttaccccgggtaataaccccggg

SEQ ID NO: 96497 - DNA, 234 bp, Homo sapiens
  misc_feature: GYAE6OF01BNJEB.43.38.D05.1.454.CMB.1.raw
  modified_base (230)..(234): a, c, t, g, unknown or other
  misc_feature (230)..(234): n is a, c, g, or t
tcagtgtgagtagtcacgaccggtgctcgatttagtatctgatagttgggtttgggtgccgaagttgctggaggtcacggtcaccgtctcttcagcctccaccaagggcccatcggtcttcccctggcgccctgctccaggagcacctccgagagcacagcggccctgggctgcctggtcaaggactacttccactactcgacactgagcgggctggcaaggcgcatagnnnnn

SEQ ID NO: 96498 - DNA, 611 bp, Homo sapiens
  misc_feature: GYAE6OF01D32MJ.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcgtggtttcgtgtagcgtatttagaaggtgtcagtgtgaggtgcagctggtggagtcgtgggggagacttggtccaggccgggggggtccctgagctctcctgtgcagcctctggattcaccttttcctggttggcacatgagcgtgggtccgccgaggctccgagggaaggggctgggagtgggtgccgagcgaatagacaaagataggaaaactaaaattatgtaggactcgtgtggaggggcctagttcactatcctacagagaacaacgaccaaagttattactaatttcgtttactaactaaagttcgaaacaacggtacctaaagacgaccgacggacgaacggtcttagtttacttacgtagtaaccgtaaatacttccgtaccgtacgggaaacccgggggggcctaacggggaacccgttcggtacccgacccgttctccgttcgaccg

SEQ ID NO: 96499 - DNA, 596 bp, Homo sapiens
  misc_feature: GYAE6OF01D0TOZ.43.38.D05.1.454.CMB.1.raw
  modified_base (373)..(373): a, c, t, g, unknown or other
  misc_feature (373)..(373): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcgtggtttcgtgtaggctatttagaaggtgtcagtgtgaggtgcagctggtggagtctgggggagacttggtccaggccgggggggtccctgagactctcctgtgcagcctctggattcacctttcctggttggcacatgagctgggtccgcaggctccgaggggaggggctgggagtgggtgccaggcagtagacaaaaggataggaaaacaaaaattntggttaggactcgtgtaggaggggcctaagttcactaatctaccgagaagacaaacgccaaagtattctatttgtttactaactaaatagaacagacctaagacgccgaaggaccacggtctgtttacttctagtaaccgtaaactacgtcctacgtacggaaccgggggggtaccaacggggtaaccccgtgggtaccctaacccgtcgtcgttccgtaccg

SEQ ID NO: 96500 - DNA, 224 bp, Homo sapiens
  misc_feature: GYAE6OF01EYVOL.43.38.D05.1.454.CMB.1.raw
  modified_base (221)..(224): a, c, t, g, unknown or other
  misc_feature (221)..(224): n is a, c, g, or t
tcagtgtgagtagtcacgaccggtgctcgatttagtatctgatagttgggtttgggggccagggaaccctggtcaccgtctcttcagcctccaccaagggcccatcggtcttcccctggcgccctgctccaggagcacctccgagagcacagcggccctgggctgcctggtcaaggactacttccactactcacactgagcgggctggcaaggcgcatagnnnn

SEQ ID NO: 96501 - DNA, 539 bp, Homo sapiens
  misc_feature: GYAE6OF01AE81Y.43.38.D05.1.454.CMB.1.raw
  modified_base (496)..(496): a, c, t, g, unknown or other
  misc_feature (496)..(496): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagacttggtccagccgggggggtccctgagactctcctgtgcagcctctggattcacctttcctggttggcacatgagctgggtccgccaggctccgagggaagggctgggagtgggtggccagcatagacaaagataggaaaacaaaattatagtggactctgtgaggggccgattcactatctccagagacaacgccaagtattcattgtttctacaaatgaacagcctaagacgccgaggacacggctgtttattctgtaccgaaacactcctntacggacggggggccacgggaccctggcaccgtctctcgaccg

SEQ ID NO: 96502 - DNA, 634 bp, Homo sapiens
  misc_feature: GYAE6OF01DQVLD.43.38.D05.1.454.CMB.1.raw
tcagtgtgagtagtcacgaccggtgctcgatttagtatctgatagttgggtttggggaggtcttagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagacgttggtccgaggccgggggggtccctgagactctcctgtgcagcctctggattcacctttcctggttggcacatgagctgggtccgccgaggctccgaggggaaggggctgggagtgggtggccagcagtagaacaaagataggaaaactaaaaatttgaggtaggaactcgtggtaggacggggcctagttacacttactctaccaaggacgaacgaaccgaccaaagttattactagtttcgtttactaactaatagaacacgtaacctaagacgaccgaggacctacggtcttagtttatttcgtagtaacgaaacctagttacccgtcgtacgggaaccgggggggacccacgggggtaaccccgtcgggtacccgtacccggtccttcccttcgcggtacccccg

SEQ ID NO: 96503 - DNA, 771 bp, Homo sapiens
  misc_feature: GYAE6OF01CU51Z.43.38.D05.1.454.CMB.1.raw
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (281)..(281): a, c, t, g, unknown or other
  misc_feature (281)..(281): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattgggggctgagcggtcgtttcgtcgtaaggcctatttaagtaaggtgtccagtgtgaggtncagtntggtggaggtgtggggaggacttggtccgtacggtccgggggtccccgtcggaggacgtccgtcctgtgcgngcctcgtggtacgttacaccgtttcccttcggttggcgaccaagttgtacgcgttcgggtccggtccgacggtccgtccgacggggtaaagggggtcggtaggtacggtcgggtacggtaccgacgtacgacgtaacgtaaacgaaaagtaaacgtaaacggtaaaaacgtaaaaagttaagtaggtacgtacgtacgttacggtacggtacgggtaccgtacgttacgtaaccgttacgttaccgtaccgtaacgtaacgtaacgtaacgtaacgtaacgttacgttacgttacgtttacgtttaacttaacgtaaacgtaacgtaacgtaacgtaacgtaacgtacggaacgtaacggtaacgtaacgttacgttagtttaacgtttacgttacgtaaacgtaaccgtacgtaccgtacggtaccgggtaaccggggtaccggtaaccggtacccgtaccggtaccgtaccgtccgtacgtcgtaccg

SEQ ID NO: 96504 - DNA, 625 bp, Homo sapiens
  misc_feature: GYAE6OF01DI10C.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagacgttgggtccgaggccgggggggtccctggagactctcctgtgcagcctctggattcacctttcctggttggcacatggagcgtgggtcccgccaggctccgaggggaacgggctgggagtgggtggccagcatacgaacaaaagataggaaaaacaaaaagttataggtaggacttcgtaggtggaacgggggtcctaattccaacttatcctaccgaagacgaaccaacgaccaaagttacttactaatttcgtttaactaactaaactagaaaccagtacctaaagacgacccggaaggaccgacggtcttagtttacttcgtagtaacaaactacgtcctcgtacgggaaccggggggaccacgggaacccgtcggtaccaccgtctcgtcgtacccg

SEQ ID NO: 96505 - DNA, 613 bp, Homo sapiens
  misc_feature: GYAE6OF01A4LH6.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagacttggtccaggccgggggggtccctgagactctcctgtgcagcctctggattcacctttcctggttggcacatgagctgggtccgccgaggctccgagggagggctggagtgggtggccagcagtagacaaagataggaaaacaaaaattagtagtaggactcgtaggtggaggggccgtagttcaactactcctaccgaagacgaacaacgaccaaagttacttactatttcgtttactaactaaatcgaaacagacctaaagacggaccgtaggaccacggtcttagtttaacttctagtacgaaactacgtcctacgtcgggaaaccgggggggtccaccggggtaaccccgtcgggtaccaacccgttccttacgttcgtaacccgg

SEQ ID NO: 96506 - DNA, 560 bp, Homo sapiens
  misc_feature: GYAE6OF01EO4EN.43.38.D05.1.454.CMB.1.raw
  modified_base (380)..(380): a, c, t, g, unknown or other
  misc_feature (380)..(380): n is a, c, g, or t
  modified_base (421)..(421): a, c, t, g, unknown or other
  misc_feature (421)..(421): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagacttgggtccaggccgggggggtccctgagactctcctgtgcagcctctggattccaccttttcctggttggcacatgagctggggtcccgcaggctccgaggggaagggctgggagtgggtggccagcatagacaaagataggaaaactaaaaattntagtaggaactcgtggtgaggggccattcactatctcaganacaacgccaagtattcatttgtttactaacaaatcgaacagcctaagacgccgaaggacacggcttgtttattctagtaacgaaactagtcctacgtacggaacggggggccagggaccctggacaccgtctcgtcacg

SEQ ID NO: 96507 - DNA, 589 bp, Homo sapiens
  misc_feature: GYAE6OF01CK8E9.43.38.D05.1.454.CMB.1.raw
  modified_base (308)..(308): a, c, t, g, unknown or other
  misc_feature (308)..(308): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagacttggtccaggccgggggggtccctgagactctcctgtgcagcctctggattcacctttcctggttggcacatgagctgggtccnccaggctccgaggggagggctggaggtgggtgccagcatagacaaagntaggaaacaaaattnagtaggactcgtgtggacgggcctattcactatctacagagacaacgacaagtatctattgttactaacaaatgaacagacctaagacgaccggaggaccgtacggtcttagtttacttctagtaacgaaactactctagtaccgtacgggaaccgggggggtacccgtaacggggtaaccccgttcgggtacccgtacccggtcgttccgttacccg

SEQ ID NO: 96508 - DNA, 572 bp, Homo sapiens
  misc_feature: GYAE6OF01D4I7R.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtggggggagacttggtccaggccgggggggtccctggagactctcctgtgcagcctctggattcaccttttcctggttggcacatgagctgggtccgccaggctccgagggagggctggagtgggtggccagcatagacaaagataggaaaacaaaaattatgtggactcgtgtggaggggccattcactatctcagagacaacgccaagtattcattgtttactacaaatgaacagacctaagacgccgagacacggcttgtttatttctagtacgaaactctcctcgtacggaaccggggggggccaacggggaaccccgttgggtacccacccggttcctcgttcgtaacccgg

SEQ ID NO: 96509 - DNA, 754 bp, Homo sapiens
  misc_feature: GYAE6OF01D5L65.43.38.D05.1.454.CMB.1.raw
  modified_base (334)..(334): a, c, t, g, unknown or other
  misc_feature (334)..(334): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggtttccttgttgctattttagaggtgtccagtgtgaggtgcagcgtggtggagtcgtgggggagacgtttgggtccgacgggccgggggggtccctggagtacctctccgtgtcgccacgccctcgtggtactttcctaccttttccgtgggttcggcacatgagtcgtcgggtccnccgtacggcctccggaggggaagggcgtgggaggtggggtcgccgagcgataaggaacaaaaggagtaaggaaaaaactaaaaagtttgtaggtacgtaacttcgtaggtacgggacggggtaccgttaattccgaacttaacgtcctaccgaaggaacgaaccgaaccgacctaaagttacttactaagttttcgtttaaccaaacgtaaatacgaaacacggtaacctaaaggaccgaccggtaacggaaccttacgggtaccgttttagttttaaccgtttcgtaacggtaaacccgtaaaaccttccgttacccgttaaccgggtaccgggggaaaacccggggggggtcccaaaccggggttaccccctacggggttacccaacccgggtttcttaccccggttcgtaaccccgg

SEQ ID NO: 96510 - DNA, 544 bp, Homo sapiens
  misc_feature: GYAE6OF01B3X1W.43.38.D05.1.454.CMB.1.raw
  modified_base (370)..(370): a, c, t, g, unknown or other
  misc_feature (370)..(370): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttcctgttgctattttagaaggtgtccagtgtgaggtgcagctggtggagtctgggggagacttggtccaggcccgggggggtccctggagactctcctgtgcagcctctggattcacctttcctggttggcacatgagctgggtccgccaggctccgagggaagggctggagtgggtgccagcatagacaaagataggaaacaaaattngtggactcgtgtgaggggccattcactatctcagagacacgaccaagtatctattgtttctacaatgaacagacctaagacgaccgaggacacggtctgttacttctagtacgaaactactcctacgtcggaacgggggggccacgggaccctggtacaccgtctcgtcgaccg

SEQ ID NO: 96511 - DNA, 811 bp, Homo sapiens
  misc_feature: GYAE6OF01DCEJP.43.38.D05.1.454.CMB.1.raw
  modified_base (183)..(183): a, c, t, g, unknown or other
  misc_feature (183)..(183): n is a, c, g, or t
  modified_base (186)..(186): a, c, t, g, unknown or other
  misc_feature (186)..(186): n is a, c, g, or t
  modified_base (199)..(199): a, c, t, g, unknown or other
  misc_feature (199)..(199): n is a, c, g, or t
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (308)..(308): a, c, t, g, unknown or other
  misc_feature (308)..(308): n is a, c, g, or t
tcagtgtgagtagtcacgaccggtgctcgatttagtatctgatagttgggtttggggaggtctcagagaggagccttagccctggactccaaggccctttccacttggtgatcagcactgagcacagaggactcaccatggaagttggggctgagcgtggtttcgtgtagctattagaaggtntcngtgtgagtgcagntggtggagtcgtggggganacgtttggaccgngggccggggggtcctggagtacctctcctgtgcaggcctcgtaggtctttccgtccttttccgtggttgcacatggngtcgttggtccgccaggccgtaccggaagggggacgggtcgtgggacggtggggtcgaccgaggactagtaacgaaacgaaaagtacgtaaacggaaaaaacttaaaaaagtttggaaggttcccggtaacttcggtaacgggtttggggaaccggggtaccttaatccgtaaaccgttacttcccgttaccgaaagtacggtaaaccccaacgggtacctttaaaggttccctttacttaaaggtttttccgttttaaacttaaaccgaaaattaccccgggaaaattccgggggaaacccctttaaaagggccgggttaaaccccgggagggtaaaccttacccggggtttattttaggttttaaccgttaccgttaacgtaaacccgtaaaacttccggttacccggttaaaccggggtaccgggggtaaccccgggggacccggttaaacggtacccggttccggtacccgtacccgtttccttaaccggccgtacccg

SEQ ID NO: 96512 - DNA, 803 bp, Homo sapiens
  misc_feature: GYAE6OF01C40EF.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggagacgttggtccgaggccgggggggtccctggagactctccgtgtgcagcctcgtggacttcaccttttccgtggttcggcacatgagtcgtgggtcccgccaggcctccgaggggaacgggcgtgggaggtgggtggaccaggcagtaagaacaaaaggataacggaaaaactaaaaagttagtaggttaggaacttcgtaggtacgggacgggggtcccgtaagttccaacttacttaccgtaccgaaggtaacgaaccgtaaccggaacccgtaaagttaacgtttaccgttaacgttttacgttttaaccctaaacgtaaaacgttagaaaaccgtaacggtaaacccgtaaacggtaccggaacccgggtaaaccgggtaacccgtaacgggttacccgtttagggtttttaaccttttaccgttaacggttaaaacccgtaaaaccttaccgttaccccgtacggttaacccgggggaaacccgggggggggtaccccctaaacgggggttaaccccccgttacggggttaaccccgtaaccccggtttccgtttcccgttacccggtaaccccgg

SEQ ID NO: 96513 - DNA, 780 bp, Homo sapiens
  misc_feature: GYAE6OF01CCW4H.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattgggctgagcgtggttttcctgttgctatttagagtgtcagtgtgaggtgcagctggtggagtcgtggggagtacgttggtccgaggcccgggggggtccctggacgaccttctcctgtcgcgagtccctcgtggtacttcctaacccgtttttcccgtgggtttcggcctaacctaagttggaacggtcgttacggggttccccgacccgaacgggtcccgtacccggaaggggggaaacgggtccgtaggggtagggtggggtacggcccgaaggcctaaaggtaagaaaccaaaaggtaacgtaaacggaaaaactaaaaagttagtaggacggtacctacgtggtacgggaacggggtcctaacgttaccgaactacgttccgtaccgaacgtaacgaaccgaaaccgtaaccgtaacgttaactttacgtaacttttacggtttaaccttaaacgtaaagtaacgtaaaccgaacggtaaccctaaacggacgaaccgggaacggaacctaccgggtatttacgtttacttacgttaacgtaacgtaaactccgttaccgtacggtaccgggaaacccggggggcaaccgggtaacccgtcggtacccgaccgttcctccgtcgtaaccccg

SEQ ID NO: 96514 - DNA, 801 bp, Homo sapiens
  misc_feature: GYAE6OF01DHZ7Q.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagtcttgggttttccttgttgcttattttagaaggtgtccagtgtgaggtgcagcgtgggtggagtcggtggggggagtacgttgggtcccgagggtcccggggggggttcccctggacgtaccgtcctccgtgtgcacgtccctctggactttcctacctttcctggttggctacatggacgtcgtcgggtcccgccgaggccgtaccggaaggggaacgggcgtgggagggtggggtcggccaggacaagtaacggaaacgaaaaggagtaacggaaaaaactaaaaattagtaggtacgggacttacgttaggtacgggaacggggtaccctaagtttaccgaacttaacgtccgtaacccgaaggaaccgaaaccgaaaccggtaccctaaaaggtttacttacgttaagttttacgtttaacctaaactaaagttacgaaacctaacggaccgttaaaaggacggtacccggaaagggtaacccgtacgggttactttacggttttaactttaccgttaaggtaaaacccgtaaaacttccgttaccccgtacggtaacccgggggaacccggggggtacctaaaccggggtaaccccgttcgggtaaccctaacccggttcccgttccgttacggtaaccccgg

SEQ ID NO: 96515 - DNA, 813 bp, Homo sapiens
  misc_feature: GYAE6OF01C4E60.43.38.D05.1.454.CMB.1.raw
  modified_base (295)..(295): a, c, t, g, unknown or other
  misc_feature (295)..(295): n is a, c, g, or t
  modified_base (319)..(319): a, c, t, g, unknown or other
  misc_feature (319)..(319): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggagacgttggtccgagggcccgggggggtccctggacgactcgtcctgtgcagcctcgtggacttcacctttccnggttgcacatgagccgtgggtccnccgaggcctaccggaggggaagggcgtgggaggtgggtggccgagcaagtacgaaacaaaagtagtaaggaaaaactaaaaaaagtttcgtaggttacggacttacgtaggtaggaacgggggtccgtaatttccgaacgttaacttaccgtacccgaaggaacgaaccgtaaaccgaccgttaaaacgttactttacctaacgttttacgtttaacctaaacgtaaagtaacggtaaaccgtaacgtaacccgttaaaaggaccggttacccgggaaccgggtaaaccgtaccgggttaccgtttaggttttttaacgttttaccgttaacggttaaacccgtaaaaaccgttccgttaaccccgttaccccgggttaacgggggtaaacccccgggggggggggacccctaaaccggggggtaacccccgtttaccggggttaacccgttaacccccgggtttaccttacccgtttcccggtaaacccccgg

SEQ ID NO: 96516 - DNA, 996 bp, Homo sapiens
  misc_feature: GYAE6OF01D57DB.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcttgggttttccttgttgctattttagaagtgtccagtgtgaggtgcagctggtggagtcgtgggggagtacgttggtccgacgggcccggggggtcccctggacgtacctcgtccgtgtcgcagccctcgtggactttccacccttttcctggtttcggcctaactagtggacgtccgtacggggttcccgccgtaagggtcccgttaccccggaagggggggtaaaacggggggtcccgtttaggggggtaaacggttcgggggggttaccgggtacccccgaacgggtacccgtaaaagttaaacgggaaaacccgtaaaaaagggtaacgttaaaacggggaaaaaaaaccctaaaaaaaaggttttacggttaacgggttaacggggtaaaccgtttccgttaaggggttacgggtaaaccggggggtacccttaagttttacccgtaaaccgtttaaccgttaacccgttacccgtaaacgggtaaaccgaaaccgtaaaacccggtaccccgtaaaaacgtttacgtttaacccgttaacgtttttaggtttttaacccgttaaaccgttaaaaacgttaacggtaaaaccgtaacggtaaaccccggttaaaagggaaccgggtaaccccgggtaaacgggtaacccggtaaaccgggttaccgtttacggtttttaaccgtttttaccgttaacggttaaaacccgtaaaacgttaaccgttacccgttacccggttaaccggggtaaccccggggggggtacccgaaccggggtaaacccccgttcgggttaacccgtacccgtttacccggtacccgttaccgtaaccccgg

SEQ ID NO: 96517 - DNA, 594 bp, Homo sapiens
  misc_feature: GYAE6OF01CCBGY.43.38.D05.1.454.CMB.1.raw
  modified_base (374)..(374): a, c, t, g, unknown or other
  misc_feature (374)..(374): n is a, c, g, or t
  modified_base (455)..(455): a, c, t, g, unknown or other
  misc_feature (455)..(455): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagacttggtccaggccgggggggtccctgagactctcctgtgcagcctctggattcacctttcctggttggcacatgagctgggtccgccaggcctccgagggaaggggctgggagtgggtgccagcatagacaaagataggaaaacaaaattngtaggacttcgtagtggaggggccgtattcatatctaccaagacgacaacgcctaaagtattcatttgttactaacaaatnaacagcctaaagacgaccgaaggaccacggtcgttgttttaactttctagtaaccgtaaactcgttaccgtacgtaccgggaacgggggggccctaaggggaccccgttaggtacccaccggttctccgttcgtacccg

SEQ ID NO: 96518 - DNA, 641 bp, Homo sapiens
  misc_feature: GYAE6OF01DV4T3.43.38.D05.1.454.CMB.1.raw
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
  modified_base (504)..(504): a, c, t, g, unknown or other
  misc_feature (504)..(504): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaagttggggctgagtcgttgggttttccttgttgcttattttagaggtgtccagtgtgaggtgcgagcgtggtggagtcggtggggagtacgttggtccgacgggtcccggggggtcctaggacgtcctcgttccgtggtcgcacgtcctcgtggtacttccgttaccgttttccgtggttcggctacgtagtggtacgtcggtcgggtacccgccgacggccgtaccgaggggaggcgtggngtgggcgcagnaagagaacaaagagtaaggaaaataaaagtgtagtaggtactgtggcggaggctatctactactctacgagaacgaacaacgtactaactattactattacttaactaanaataagacacgtacgtaacgacgacgtacgacgacgtacgttagtttacttacgtaacgtacaaactccgtccgtacgacgggtccgggggaccgacgggtaacccgtcggtaccgtaccgtcgtccgtcgtacccg

SEQ ID NO: 96519 - DNA, 953 bp, Homo sapiens
  misc_feature: GYAE6OF01AM73D.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaagttggggctgagcttgggttttccttgttgcttattttagaaggtgtccagtgtgaggtgcagcgtgggtggagtcggtgggggagtacgttcgggtccgacggggtcccgggggggttccctggacgtaccgtccgttccgtggtcgccgacggtccccttcgttgggtaactttcccgttaacccgtttttcccgttggggttttcggacctaaccgtagttcgggaacgtccggttcgggggttcccccgacccggtagggtccccgttacccgggaaaggggggtaacgggggtccgttaggggacgggttgggggtcggacccgaaggaccgtaagtaaacggaaccgaaaaaggtagtaaacgggaaaaaaactaaaaagtttagtaggttacgggtaaccttcggttaggtagggacggggtaccgtagtttaccgaacttacgtaccgtaccgaagtaaccgaaaccgtaacccgtaaccgttaaaacggttacttttaccgttaacgtttttacgttttaaccctaaacgttaaaacgttaccggtaaaaccgtaaccggtaacccgtaaaacgggaccggtaacccgggtaaacgggaacccgttaccgggttaacgttttacgtttttaacgtttaccggttaacgttaaaacccgtaaaaccgttcgttaaccggtaacgtttaccccgggtaaccggggggaaaccccggggggggtacccgtaaacccggggttaaaccccgttacgggttaaaccccgttaccccggttaacccggtttcccgtttaacccccggg

SEQ ID NO: 96520 - DNA, 1001 bp, Homo sapiens
  misc_feature: GYAE6OF01DV3IN.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcttgggttttccttgttgcttattttagaaggtgtcagtgtgaggtgcagctgggtggagtcgtggggggagtacgtttgggtcccgagggcccggggggggttcccctggacggaccttcctccgtgtcgcacgcccttcgtggtactttcctacccgtttttcccgtgggtttggcctacagtggacggtccgtcgggggtcccgcccgagggccctacccgggaaggggggaaacggggggcgttggggacgggttgggggtcgggccccgtaaggccaaagtaacggaaaccgaaaaaaggtaagttaaacggggaaaaaaacctaaaaaaaagtttaggttacggttaacggggtaacctttacgttaggggttacggggaacgggggggtaccccgttaacgttttaccgtaaacccgttaaccgtttacccgttaaccccggtaaacgggaaaccggtaaaacccggtaaaaacccggtaaacccccgttaaaacggttttaacgttttaaccctttaacgttttttaaccggtttttaacctttaaaaccgttaaaaacgtttaacggtaaaaccgtaaccggtaaacccggttaaaacggaaccggaaccccggggtaacgggtaaacccggtaacccggggttaccgttttacggtttttttaacgtttttaccgttaacggtttaaaacccggtaaaaccttaaccgttaccccggtttacccggttaacccgggggtaaacccggggggggggtaaccccgtaaaccgggggtaaacccccggttcggggttaacccccgttacccggttacccgtttcccgttaccggtaccccg

SEQ ID NO: 96521 - DNA, 866 bp, Homo sapiens
  misc_feature: GYAE6OF01C71RT.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattgggggctgagcttgggttttccttgttgcttattttagaaggtgtccagtgtgaggtgcagcgtggtggagtcgtgggggagacgttgggtccgacgggcccggggggggtccctggacgacctcctcctgtgcagccctctggatttccaccttttccgtggtttcggcacactggacgtcgtcggggtcccgccgagggcctaccggaaggggggaacggggtccgtaggggtacggtgggggtcgggaccctaggccaagtaacgaaacgaaaaggaagtaagggaaaaaacctaaaaaaatttgtaggtaggacctttcgtaggtagggacgggggtaccctaagttacctaaccttacttacctaccgaacggtaacgaaccaaaccggtaaccctaaggttactttacgtaacgtttttacgtttaccttaaactaaaacgtacgtaaaacgtaacggtaacccgttaaacggaacggtacccgggaacgggtaaacccggtaaccgggttaccctttttaagggttttaactttttaccggttaaccggttaaacccgtaaaaccgtacccgtttacccggttacccggtaacccggggggtaaaaccccgggggggggggaccccgtaaaccggggggtaaaccccccggtttcggggtttaaacccccggttaccccggtttccccgttccggttttacccgaacccccgggg

SEQ ID NO: 96522 - DNA, 625 bp, Homo sapiens
  misc_feature: GYAE6OF01EAG95.43.38.D05.1.454.CMB.1.raw
  modified_base (314)..(314): a, c, t, g, unknown or other
  misc_feature (314)..(314): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtggggggagacttgggtcccaggccgggggggtccctggagactctcctgtgcagcctctggattcacctttcctggttggcacatgagctggggtccnccgaggctccgagggagggctggagtgggtgccagcatagacaaagataggaaaacaaaagttatgtaggactctggtaggaggggcctaattcacgtatcctccagacgacaacgccaagtattctattgtttactaactaaatagaaacacgaccctaaagacgaccggaaggaaccacggtacttaggtttactttcgttacgtaacgaaactactccgttaccgtaccgggtaaccggggggggaccctaacgggggtaaacccccgtcgggtacccgaacccgttcccgttccttccgtaacccgg

SEQ ID NO: 96523 - DNA, 595 bp, Homo sapiens
  misc_feature: GYAE6OF01A87OQ.43.38.D05.1.454.CMB.1.raw
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagacttggtccgaggccgggggggtccctggagactctcctgtgcagcctctggacttcacctttcctggttggcacatgagcgtgggtcccgccgaggcctccgaggggaaggggctgggagtgggtggccagcatagacaaagntaggaaaacaaaattntgtagactcgtgtaggacggggcctattcactatctcagacgacaacgccaagtattctattgttactaacaaatcgaacagacctaagacgccgaggacacgtcttagtttacttctacgtaacgtaaactactcccgtcgaccgggaaccgggggggcccaacggggaaccccgttcgggaccctaccggttccttccgttccgtacccgg

SEQ ID NO: 96524 - DNA, 696 bp, Homo sapiens
  misc_feature: GYAE6OF01CNJZ7.43.38.D05.1.454.CMB.1.raw
  modified_base (224)..(224): a, c, t, g, unknown or other
  misc_feature (224)..(224): n is a, c, g, or t
  modified_base (279)..(279): a, c, t, g, unknown or other
  misc_feature (279)..(279): n is a, c, g, or t
  modified_base (423)..(423): a, c, t, g, unknown or other
  misc_feature (423)..(423): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtggggganacgttggtccgagggccgggggggtccctggagactctccgtgtcgcagcccttntggattcctacctttccgtggttcggcacgattggagtcgtcgggtcccgccgaggtcctccggaaggggaagggccgtagggaggtgggtcggccgaggacaagtaacgaacgaaaaggagtaaggaaaaactaaaaaagttntaggtaggacctagtaggtacggacggggacctaagttaccaacgttactacctaccgaagtacgaaccgaacgacctaagttacttactaagtttacgtttactaactaaagtagaaactacgtaacctaagaccgtaccggaggtacctacggtcttagtttacttacgtagtaaaccgtaaataccgttaccgtaccgtaccgggaaccgggggggtacccaacggggtaacccgtacggtaccgtacccgttcctccgttccgtacccg

SEQ ID NO: 96525 - DNA, 642 bp, Homo sapiens
  misc_feature: GYAE6OF01EVDJ7.43.38.D05.1.454.CMB.1.raw
  modified_base (394)..(394): a, c, t, g, unknown or other
  misc_feature (394)..(394): n is a, c, g, or t
  modified_base (463)..(463): a, c, t, g, unknown or other
  misc_feature (463)..(463): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggagtacgttggtccgagggcccgggggggtccctggacgactctcctgtgcagccctctggtattcctacccttttcctgggttgcacatgagcgtgggtcccgccgaggcctccgaggggaggggctgggaggtgggtgccagcatagaacaaagataaggaaaataaaattntaggtagactcgttggtaggaggggcctagttacacttatcctacaaggacgaacaacgactaaagttnttacgtatttcgtttactaataaatagaacagacctaaggacgaccgaggacctacggtccttagtttacgttacgtagtaaccgaaaactcgttacccgtacggtaccggggaaccgggggggaccctaacggggtaacccctcgggtacctacccggttcttcccgttcgtaccccg

SEQ ID NO: 96526 - DNA, 857 bp, Homo sapiens
  misc_feature: GYAE6OF01AXEDT.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaagttggggctgagtcgttgggttttccttgttgcttattttagaagtgtccagtgtgaggtgcagcgtggtggagtcgtgggggatacgttggtccgagggtcccggggggtccctggacgtacctccgtccgtgtcgcacgtcctcgtggtacttcctaccgtttccgtggttcgcacgtagtcggacgtccgtcggggtcccgaccgacgggccctaccggggaagggggtaacggggtcgtaggggacggttcgggggtacggaccgaggtaccaaacggtaaacggaaaccgtaaaagggtaaacgtaaacggtaaaaaaacgttaaaaaagttaggttaacggttaacggtaaccgtttcggtaagggttaccgggaacgggggttaccgttaacgtttaccgtaacgttaaccgttaccgtaaccgaagtaaacgaaacccgtaaccgtaaccgttaaacgttaacgtttactttaacgtttaccgtttaactaaaccggtaaacgttaacgaaacgtaacggaacccgttaaaggacccggtaaccgggaaacggtaaccgttaacggttacgtttacggtttaacgttacgtaacggtaaaccgtaaacctaccggttacccgtacggtaacccgggggaccgggggtaaccctaaccggggtaacccgttacggtacccgtacccggttcctccgttcccgaacccg

SEQ ID NO: 96527 - DNA, 911 bp, Homo sapiens
  misc_feature: GYAE6OF01DUQ57.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagacgttggtccgagggtcccgggggggtccctggacggtacctccgtccgtgtgcacgcctcgtggtactttcctacccttttccgtgggtttcggcctacagtggacgtcgttcggggtcccgccgacgggtccgtaccgggaagggggaacgggggtccgttaggggacgggttcggggggtccgggacccgaaggaccgtaacgtaaaacggaaaccgaaaaaggtaagtaaaacggggaaaaaaacttaaaaaaaaggtttcggtaggttaacggggtaacctttaccggttagggttacgggggtaaaccgggggtacccgttaacgtttacccgtaaccgtttaaccgttaccccgttaaccgaaacggtaaaccggtaaacccgtaaaccggtaacccgtaaacggtttacgttttaaccttaacgtttttacgttttaacccgttaaactaaaagttacggtaaacctaaccgtaaccgtaaacggaccggaacccgggtaaacgggaacccgtaacgggttactttacggtttttaacgtttccggttaacgtaaaccgtaaacgtacccgttacccggttacccggttaaccgggggaacccggggggggaccctaacccgggggtaaccccggttacggttaccccgtacccggtttcccttcccgttcgtaaccccgg

SEQ ID NO: 96528 - DNA, 696 bp, Homo sapiens
  misc_feature: GYAE6OF01C095S.43.38.D05.1.454.CMB.1.raw
  modified_base (281)..(281): a, c, t, g, unknown or other
  misc_feature (281)..(281): n is a, c, g, or t
  modified_base (404)..(404): a, c, t, g, unknown or other
  misc_feature (404)..(404): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcttgggttttccttgttgcttattttagaaggtgtccagtgtgaggtgcagctggtggaggtcgtggggggagtacgttgggtcccgaggcccgggggggtcctggagacctctcctgtcgcagcctntggatttccaccttttccgtggttggcacatgagcgtcgggtccgccaggctccgaggggaggggctgggaggtgggtgccgagcaagtacgaacaaaagagtaggaaaaactaaaaaagttntggtaggacttcgtaggtggaaggggcccgtaattacaacctataccgttaccgaagacgtaaccaaacgtaccgtaagttatttacgtatttagtttactaactaaagtacgaaacaacgtaacctaaaggtacgacccggtaaggaccgtaacggtcttacggttttaactttacttacgtaaaccgtaaaacctcgtacccgtccgttaccgggaaacccggggggggtaccctaaacggggtaacccccgtgggttaccccgacgtttcccttcgttccctaacccgg

SEQ ID NO: 96529 - DNA, 636 bp, Homo sapiens
  misc_feature: GYAE6OF01DY2LF.43.38.D05.1.454.CMB.1.raw
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (389)..(389): a, c, t, g, unknown or other
  misc_feature (389)..(389): n is a, c, g, or t
  modified_base (405)..(405): a, c, t, g, unknown or other
  misc_feature (405)..(405): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcggtggtttcgtgtagctatttagaaggtgtcagtgtgaggtgcagctgggtggacgtcgtggggggatcgttgggtccaggcccgggggggtccctggacgctctcctgtgcngcctctggattccnctttcgtggtgcatatgagtgtcggcccgccgaggcctcggaggggtagggctgggagtgggtcgaccgagcaagtaacggacaaaagataggaaaataaaaggtttngttacggacttgtggngacggggctataccatactctacgagacaacgaaccgacgaacgttacttgtactttacgttactaactaatacgaacgatacctaaaggcgaaccggacgtaacgaccgtacgttacgtttacgttacgtcgtaaaccgtaaactacgtcccgtacgtaccggggaaccggggggtacccgaaccgggtaccggtaccgttacgtaccggttcctaccgtccgtaacccg

SEQ ID NO: 96530 - DNA, 932 bp, Homo sapiens
  misc_feature: GYAE6OF01A06FB.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaagttggggctgagcgttgggttttccttgttgcttattttaggaaggtgtccagtgtgaggtgcagcgtggtggagtcggtgggggatacgttcgggtccgacggggtcccgggggggtccctggacgtacctcgtccgtggtcgcctagccctcgtggtaactttcctacccttttcccgtggtttcggctaacgtagtggacggtcgtcggggtcccgccgaacgggtcccgtaccgggaagggggtaacgggggtcgtaggggagggtttcgggggcggacccgaggtaccgaagtaacgaaacgaaaaggtaacgaaacggaaaaactaaaaaagtttcgtaggtaacgtacgttacgttaggggtaggtaacgggggtcctaagttctaaccgttaacttcccgtaacgtaaacggaaccgtaaaccgaaccggtaacccgtaaaggtttaactttaccgttaacgttttacggttttaaccctaaaacgttaaaagttaaccggtaaaaccgtaacggtaaaccccgttaaaaagggccggtaaccccgggaaagggtaaaccccggtaccggtttaacggttaccgttttttaacggtttacccgttaaagggttaaacccctaaaaaccggttacgtttaacccccggtttaccggggaaacccgggggggtaaaccccgggggggggtaaccctaaaccccggggggttaaaccccgggtttcggttaaccccccgggtaacccgttttacccgttccccgttaacccggtaaccccccggg

SEQ ID NO: 96531 - DNA, 762 bp, Homo sapiens
  misc_feature: GYAE6OF01D8II4.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagagactcaccatggaattggggctgagtcgttgggttttccttgttgtcttattttagagtgtccagtgtgagtgcagctgggtggagtcggtgggggagtacgttggtccgagggcccggggggtccctgacgactcctcctgtgcacgcctctggtacttcctaccttttccgtggttcggactacagtgacgtcggtcggtcccgcgacgccgtccggaggggacgggtcgtgggagtgggtacgcgagcaagtaagaacgaaagagtaacggaaaactaaaattgtaggtacgtacgtcggtaggtacggacgggtacctataccgtaacttacgtccgtaacgaacggaaacgaaacccgtaaccgaacttaaagttactttacgtaacgtttttacgtttaaccaaaccgtaaattacgaaaccgtaaggtacccgtaaagaccggaacccggtaaggtaacccgtacgttcgttttaacgttttaaccgtttacgtaacggtaaacccgtaaattcccggttcccgtttaacgggaacccgggggtaacccggggggttacctaaaccccggggttaacccgtcggggtttaaccccaccggtttcccgttaaccgtccgtaaacccccg

SEQ ID NO: 96532 - DNA, 868 bp, Homo sapiens
  misc_feature: GYAE6OF01DBQSA.43.38.D05.1.454.CMB.1.raw
  modified_base (418)..(418): a, c, t, g, unknown or other
  misc_feature (418)..(418): n is a, c, g, or t
tcagtgtgagtagtcacgaccggtgctcgatttagtatctgatagtttgggtttgggggaggtctcagagaggagccttagcccgtggactccgaaaggccctttcacttggtgattcagtccactgacgcacaggagacctacaccatggaagttggggacttgagtcgttggggtttttccttgttagtccttaagttttaaggaacggtcgtcctagttggtgtaggtcgacgaagcgtcggtcggacgttcggtgggggacgtacgttcggtacccgacgggtcccgggggggtcctggtaacgtaccgttccgtccgttggtcgacgtaacggtcccttcgttacgggaatttccctaacccgtttttcccgtgggttcggaccaactacgtggacgtccgttacgggtcccnccgtaaggtccgtaccggacgggggtaaacggggccgtaggggtaacggttggggtcgggacccgtaggaccgtaagttaacggaaacgtaaaaggtaacgtaacggaaaaaaacctaaaaagtttgtacggtaacggtactttacgtggtacggacggggtcctagttacctactacgtacgtaccaagggtaacgaaccgaaaccggtacgtaaggtttactacgtaagtttttgtttaaaccttaacctaaaggtacgaaccgttacggtaccctttaaacggaccggtaaccgtacggaaccgttacggttaccgtttagtttttaccgtttacggtacgtaaaccgtaacgtacgttacccgttcggtaaccggggtaaccggggggaccctaaaggggtaaccccgttcggtaccgtaacccgttcgttcccgtctaaccccgg

SEQ ID NO: 96533 - DNA, 603 bp, Homo sapiens
  misc_feature: GYAE6OF01A97ET.43.38.D05.1.454.CMB.1.raw
  modified_base (310)..(310): a, c, t, g, unknown or other
  misc_feature (310)..(310): n is a, c, g, or t
  modified_base (338)..(338): a, c, t, g, unknown or other
  misc_feature (338)..(338): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttcctgttgctattttagaaggtgtccagtgtgaggtgcagctggtggagtctgggggagacgttgggtccagccgggggggtccctggaggactctcctgtgcagcctcgtggattcacctttcctggttggcacatgagctgggtccncaggctccgagggacgggctggagtggngcagcatagacaaagataggaaaacaaaattgagtaggaacctgtggtcgagggaccgtatacgactatctccgagacgaacaacgaccaagtacgttctatttagttctaacaaacttagaacagactaaagcggaccgaggacaaccggtcttagttacgttactacgtaacgaaacgacgttccgtacgtacgggaacccgggggggtaccaaacggggtaaccccgttggacccgtacccggtccttccgtcgtaacccgg

SEQ ID NO: 96534 - DNA, 852 bp, Homo sapiens
  misc_feature: GYAE6OF01ANI2X.43.38.D05.1.454.CMB.1.raw
tcagtgtgagtagtcacgaccggtgctcgatttagtatctgatagttgggtttgggggaggtctcagagaggagccttagccctggactccaaggcctttccacttggtgatcagcactgagcacagaggactcaccatggaattggggctgagctgggttttccttgttgcttatttagaggtgtccagtgtgaggtgcagctgggtggagtcgtgggggagacgttgggtccgagggcccggggggggttcccctggacgtaccttcctcccgtggtcgccacgtccctcgtcggtactttcctacccttttcccgttgggtttcggaccacgtagttcggacgtccggttcggggttcccgcccggtaacgggtcccgtaccgggaaggggggaacgggggtccgttaggggagggttcggggggtcggacccgtaaggaccgtaagtaacggaaacgaaaaggtacggttaaacggaaaaaactaaaaaagtttcgtaggttacgggtaaccttcggttaagggttcggggaacgggggtaccctaacgtttaccgaacgttaccgtcctaaccgaaggtaaccgaaaccgtaacccggtaccctaaaagttactttcgtaacgtttttcggtttaacctaaaccgtaaagttacgaaaccgttacggtaacccgttaaagggaccggacccgggtaaaggtacccggtacggttaccgtttagttttaactttcgtaaccggtaaaccgtaaacctaccgtcccgttacggaaccgggggaaacccggggggtcccaaccggggtaacccctgggttacccctaccggttccttcgttaccgacccg

SEQ ID NO: 96535 - DNA, 702 bp, Homo sapiens
  misc_feature: GYAE6OF01ASIJ1.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagacgttggtccgaggccgggggggtccctggagactctcctgtgcagcctctggattcacctttcctggttggcacatgagcgtgggtcccgccgaggcctccgaggggaaggggcgtgggaggtggggtcggccgaggcagtaagaacaaaaggataaggaaaacaaaaattagtaggtaggactcgtggtaggacggggccgtattccgacttactcctaccgaagaacgaacgaaccgaccgtaaagttattactaagttttacgtttacctaactaaagttacgaaactaacgtacctaaaggaccggaccggaacgggaaccgtaacggtactttagttttaactttcgtagtaaaccgtaaactacgttcccgtacggttacccgggggaaacccggggggggtaccctaaaccgggggtaacccccgttacgggtaccccgtaaccccggttcttcccgttaccgtaaccccgg

SEQ ID NO: 96536 - DNA, 904 bp, Homo sapiens
  misc_feature: GYAE6OF01AOMQU.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaagttggggctgagtcgttgggttttccttgttgtcttaagttttagaaggttcgtccagtgtggaggtgcgtagcgtgggtggagtcggtaggggagtacgttggtccgacggggtcccggggggtccctaggacgtccgtccgttccgtaggtcgccgacgtcccttgtacggtactttacccgtacccgttttccgtggttcggactaacgtacgtggacggtccggtcgggtacccgaccgtacgggtccgtaccgggaagggggaacgggtcggtagggtagggttcggggtaccggaccgtaaggtacgtaacggtaacggaaacgtaaaaaggtaacgtaaaaagaaaaaacgtttaaaagtttacgtaggttaacgggtaaccttacgggttaagggtacggggtaccgggttaacccggttaactttaacccgtaacgtttaccgtacccggtaaaccgtaaagggaaaccccgtaaaacgtaaacccccgtagtttaaaaactttccgtttaaacgttaagttttaaccggtttaactaaaacgtaaagttaccggaaacttaacggtaaccgtaaacggaaccggtaccggtaaacggacccggttaggtttaccttttaagttttaaccgttacgaaaccgggtaaaccttaaaacgtcccggttaaacccggtacgggtaaccgggggaaaccggggtcccgtaaacggtacccggttcgtaacccgtcccgtcttcggtaacctacccgg

SEQ ID NO: 96537 - DNA, 837 bp, Homo sapiens
  misc_feature: GYAE6OF01CVCZA.43.38.D05.1.454.CMB.1.raw
tcagtgtgagtagtcacgaccggtgctcgatttagtatctgatagttgggtttggggaggtctcagagaggagccttagccctggactccaaggtccctttccacttggtgatcagcactgagcacagaggactcacagtggaagttggggctgagtcgttggttttccttgttgtacttagttttagaaggttcgtcctaggttggtggaggtgcgagtcgtgggtggagtcggtaggggagtacgttcggtacccggacgggggtcccggggggttaccctggacgtaccgttccgtccgtgtcgccgtacgtcccgttgtacggtaccttttcccgtacccgtttttccggtagggttcggaccaacgtaggtacgggtaccgtccgggttccgggtccccgaccggtacggacccgtaccggggaaggggggtaccggtcggtggggtacggtggggtaccgacggaagtacgaagtaacggaaacgaaaagtaacgtaaaagtaaaaacgtaaaattcggtaggtacgtactacggtggacggacgggtacctattaccgtactagtaccgacgaagaacaaccgaacgtaacctaagttctacgttagtttacgtacctaaagtaacgtacgtaaaccgactaaaccgaaggaccgtaaccggaacggttaacctcgggttactttacgttttaccgtagttaaccggaaaccgtttaaaaccgtcccgttaacccgggtacgggtaaaccgggggtaaccccggggggaacctaacccggggttacccgtaccggttaccttacccggttcttccccgttaccgaacccg

SEQ ID NO: 96538 - DNA, 877 bp, Homo sapiens
  misc_feature: GYAE6OF01A4U39.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcggtgggggacgtacgttcggtaccgtacgggcccgggggggttcccctggacggtaccttccgttccgtggtcgcgtacgtccctcgtacgggtactttccgtacccgttttccggttgggtttcggacctaacgtagttcggacggtccggttccggggtccccggaccggtacgggtacccgtacccgggaaaggggggtacgggggtccgttaggggagggttcgggggtccgggaccgaaggaccgtaagtaaacggaaacgtaaaaggaacggttaaaacgggaaaaaaactttaaaaaagtttcgttaagggtaacggtacctttacggtaacgggtagggaccggggtaccgttaagttacccgaacgttaacctaccgtaccgaaaggtaacccgaaaccgtaaacccgtaacgtaaagtttactttacgttaagtttttacgtttaaacctaaactaaacggttaacgaaacgtaccgaaaccgtaaaggacggaacccggtaaggtaaccgtacggttctttacgtttactttaccgtaaacgtaaccgtaaacctcgttacccggtacggtaaccgggggaccgggggtaaccctaacggggttacccgttcggaaccccgtaccgttacccgttcgtccgtaaccccgg

SEQ ID NO: 96539 - DNA, 789 bp, Homo sapiens
  misc_feature: GYAE6OF01CLOO6.43.38.D05.1.454.CMB.1.raw
  modified_base (225)..(225): a, c, t, g, unknown or other
  misc_feature (225)..(225): n is a, c, g, or t
  modified_base (353)..(353): a, c, t, g, unknown or other
  misc_feature (353)..(353): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcgtggggganacgttggtccgacgggcccgggggggttcccctggacggtaccttccgtccgtggtcgcgacgtccctcgtaggtactttcctacccttttccgtggtttcggcacgtatggacgcgttcggggtccnccgaggcctccggaaggggtacgggcgtgggaggttggggtcggccgaggactaagtaacgaaacgaaaaggtagtaaacggaaaaaactaaaaagtttgtaggtacggtacttcgtaggtagggacggggaccttattacctaactactccgtaccgaaggtaacgaaccgaaccgtacctaagttacttaccgtagttttacgtttacctaaacgaaacttacgaaaccgtacgtaacccgtaaagggaccgaccggtaacggaccgtacggttactttggttttaactttcgttaacggtaaccgtaaacgttaccgttacccgttaccgggtaacccgggggtaacccggggggggtaccctaaaccggggtacccccgttacgggttaccccggtaacccggtttcccgttacccgttcccgtaaccccgg

SEQ ID NO: 96540 - DNA, 1017 bp, Homo sapiens
  misc_feature: GYAE6OF01CRXY0.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaagttggggctgagtcgttgggtttttccttgttgcttagttttagaggtgtccagtgtggaggtgcagcgtgggtggagtcggtggggatcgttggccgagggcccggggggtcctggacgtacctcctcgtgtgcacgcctgtggtatttcctacccgttttccgtggttcgccacgtagtggacgtccggttccggggtcccgaccggtacgggtcccgtacccggggaagggggggtaacggggtccgtttaggggggtaaggggtttcggggggtaccgggaccccggtaacgggtaccgaaaacggttaaagggaaaaaaccggaaaaaagggttaaaacgggtaaaaccgggtaaaaaaaaaaccgttttaaaaaaaagtttcggttacggggttaaacgggtaccctttacggggtaacggggttaagggtaaccggggggacccctttaagtttacccgtaacgtttacgttaacccccgtaccgtaaacgggaaaccggtaaaacccctaaacgggtaaacccctaaaggtttaactttaccgtttaaacgttttttaccgttttaaaccggtaaaaacttaaacggtttaaccggaaaacccgttaagggttaaacccccgtaaaaggggtaccccgggaaaccgggtaacccggggttaaacgtacccgggggttttaaccttttaacgggttttttaccgtttaaaccgttaaccggtaaaacccggttaaaccgtacccggtttaaccccggttaaccgggtaaccccgggggtaaaccgggggggtacccccgtaaaccggggttacccccgtaacgggttacccctacccggtttaccctcccggtttacggaacccccgg

SEQ ID NO: 96541 - DNA, 807 bp, Homo sapiens
  misc_feature: GYAE6OF01C6UIQ.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagagactcaccatggaattgggctgagctgggtttcctgtgctattttagaggtgtccagtgtgaggtgcagcgtgggtggagtcgtggggggagtacgttgggtccgagggcccggggggggtccctggagtacctctccgtgtcgcacgcccttcgtggtacttcctaccttttccgtggttggccacatgagtcgtggtcccgccaggctaccggaaggggaagggcgtgggaggtggggtcggaccaggcaagtaagaacaaaaaggagtaaggaaaaaactaaaaaagttgtagtaggtactcgtaggtagggaacgggggcctaatttccaacttactccgtaccgaagacggaaaccaaaccgggacctaaaaggttactttacctaagtttttacggtttaactaaaaccgtaaattacggaaaacctaacggacccgtaaaaggaccggaaccccggggaaggtaacccgtaccggggttacttttacggtttttaacgttttaccgtaacgggttaaaacctaaaaaaccccgttcgtttaccccccggtacggttaaacccgggggggaaaccccgggggggggggtacccccaaaccgggggtaaaccccccggtttcgggtaaacccccgtaaccccggtttcccttacccgttacccgtaacccccggg

SEQ ID NO: 96542 - DNA, 836 bp, Homo sapiens
  misc_feature: GYAE6OF01CB4I1.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaagttggggctgagtcgttgggttttccttgttgtcttattttagaaggtgtcagtgtggaggtgcaggcgtgggtggagtcggtgggggagtacgttcgggtaccgacggggtcccgggggggtccctggacgtaccttccgtccgtggtcgcacgtcccttcgtggtacttccgtaccgttttccggtgggttcggacctactagtggacggtccggtccgggtcccgccgacggccgtaccgggaagggggaacgggtcgtaggggcgggtcggggtcggaccgaagcgtaagtaacggaaacgaaaaggtaagtaaacggaaaaaacttaaaagttagtaggtaacggtactacggtagggtacgggaacggggtacctacgttaccgacttactccgtaccgaaggaaccgaaccgaaccggtaacttaagttacttaccgttaagtttacgtttaacctaaacgtaaacgtaacgtaaacccgtacggtaaaccggtaaacgggtacccggaaaccgggtaacggaacccggtacgggtttactttaacggtttaacctttaacggtaaccgttaaaaccgtaaacgttcccggttaacccggtaccgggtaaccgggggaaccccggggggtacctaaaccggggtacccgttacgggtaccctacccggttcttccgtccgtaccccg

SEQ ID NO: 96543 - DNA, 920 bp, Homo sapiens
  misc_feature: GYAE6OF01DNNXQ.43.38.D05.1.454.CMB.1.raw
tcagtgtgagtagtcacgaccggtgctcgatttagtatctgatagtttgggtttggggaggtctcagagaggagccttagccctggactccaaggcctttccacttggtgatcagcactgagcacagagactcaccagtggaagttgggctgagtcgttgggttttccttgttgtcttatttagaagtgtccagtgtgaggtcgcagtcgtggtggagtcggtggggacgtacgtttcggtccgacgggtcccggggggttccctaggacgtaccgttctccgtgtcgacgtacgtcccgttcgttacggtaactttcccgtacccgtttttccgtgggttttacggaccaacgtagttcggacggtccggttccgggtcccggaccgtacgggacccgttacccgggaagggggtaaacggggtccgttaggggtaacggggttcggggtaccggacccgtaaggtaccgaacgttaaacggaaaaccgaaaaaggtaaacgttaaacgggaaaaaaacttaaaaaaaggtttcgtaagggttacgggtaaccttacggttagggtacgggtaacggggtacccgttaagtttaccgtaaaccgttaacgttaacccgtacccgaaaagggtaaacccggaaaccgtaaaacccgggtaacccgttaaaaggtttacgttttaaccgttaagttttttaccggttttaaccttaaaacgttaaaacgttaccggtaaaaccgtacggtaaaccgttaaagggaaccggtaacccggtaagggaaccgtacggttacgtttacgttttaaacgttccgttaagtaaaccgtaacgtacgttacccgtacggtaccggggaaccggggggaccctaaccgggtaacccgttcggtacctaccggttcttccgttcgacccg

SEQ ID NO: 96544 - DNA, 761 bp, Homo sapiens
  misc_feature: GYAE6OF01ACC2X.43.38.D05.1.454.CMB.1.raw
  modified_base (647)..(647): a, c, t, g, unknown or other
  misc_feature (647)..(647): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcgttgggttttccttgttgcttattttagaaggtgtccagtgtgaggtgcagcgtgggtggagtcgtgggggagtacgttggtccgagggtcccgggggggtccctggacgtacctccgtccgtggtcgccacgtccctcgtaggtacttcctacccgttttcccgtgggttcggccactagtggacgtccggtcggggtcccgccgacggtccgtacccgggaagggggaacgggtccgtaggggtagggtcggggtcggccgaaggaccgtaagtaacggaaacgaaaaggtaagtaaacggaaaaaacttaaaaacgttgtaggttacggtacttcggtaggtcgggtacggggtacctaacgttacctacttacgtccgtaccgaacggaacgaaccgaacgtacctaaagttcttaacgttatttacgtttaactaactaaagtacgaaccgtacgacgtaacgacgaccggtaaggacgttaccggtntttacgtttacttacgtacgtaaacgtaacgtaccgttccgtacggtaccggggtaaccgggggaccctacgggtaacccgtcggtacccgtaccgtccttccgtcgtacccgg

SEQ ID NO: 96545 - DNA, 856 bp, Homo sapiens
  misc_feature: GYAE6OF01DFGOX.43.38.D05.1.454.CMB.1.raw
  modified_base (179)..(179): a, c, t, g, unknown or other
  misc_feature (179)..(179): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagagactcaccatggaagttgggctgagcgttggtttcctgtgctatttagagtntcagtgtgaggtgcagcgtggtggagtcggtgggggagtacgttcggtcccgacgggtcccgggggggtccctggaacgtccttccttcccgtggtcggccgtacggtcccttcgtacggtacttttaccgttacccgttttcccgtggggttcggacctaacgtaacgttggacggtcggttccgggtccccgtccggacgggtccctacccggggaagggggaacgggccgttaggggtacgggttcggggtcggaccgtacggaccgtaaagaacgaaaaccgaaaagggtaagtaaacggtaaaaaactaaaagttagtacggttagaaccgtttggtggttacgggaccgggtacttagttaccaacgttactaccgtacaaggaacgaaaccgtaaccgaccgttaaagttaccttagtttaacgtttacgtttaaactaaacgtaaacgtaacgaaacctaacggtaccgttaaacggacccgggacccgggtaacggtaacccgtcgggtttaacgttttacgtttaacgttttacgtaaccgttaaaccgtaaaccttccggttaaacccggttcgggtaaaccccgggggtaccgggggggaaccccaaccggggttacccgtacgggtaccccttaaccgtcccgtttacgtaccccgtaacccgg

SEQ ID NO: 96546 - DNA, 1032 bp, Homo sapiens
  misc_feature: GYAE6OF01B279N.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcttgggttttccttgttgcttattttagaaggtgtccagtgtgaggtgcagtcgtggtgggagtcgtgggggacgtacgttcggtcccgagggtccccggggggggttccctggacggtaccttaccgttcccgttggtcggccgacgtccctaccgtgggtaactttccctaccccgtttttcccgttaggggtttcgggaccaacctaggtacggacggtccggttccgggggttaccccggcccggtaacggggtcccgttaccccgggaagggggggaaacggggggtcggtttacgggggaggggttcgggggttcgggacccgaagggaccaaggtaacgaaaccgaaaaaggaacgtaaacgggtaaaaaacctaaaaaagttttacgtaggttacggtaaccgtttcggtacgggtcgggaaacggggggtcccggttaacgttctaaccggtttaacttccgttaaccccgaaggaaaccggtaaccgtaaacccggaacccgtaaaagggtttacttttaaccggttacttttacggttttacccttaaaaccgtaaaacgtttaacggaaaaccgtaacgggaaccccgttaaaacggggtaaccggaccccggggtaaagggaaaccccggtaccgggtttaccgtttttaagggttttttaaccggtttaccgttaacggggtttaaaaccccctaaaacgtttacccgtttacccccgggttaccgggtttaaaccccgggggggggaaacccggggggggggttaacccccgtaaacggggggttaacccccccggttacggggttaacccccggttaaccccggttttccggtttaaccccgtttcccgggtaaaccccgggg

SEQ ID NO: 96547 - DNA, 894 bp, Homo sapiens
  misc_feature: GYAE6OF01C6XQL.43.38.D05.1.454.CMB.1.raw
  modified_base (343)..(343): a, c, t, g, unknown or other
  misc_feature (343)..(343): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaagttggggctgagcttgggttttccttgttgtcttattttagaaggtgtccaggtgtgaggtgcaggctgggtggaggtcggtggggggaagtacgttgggtccgacggggtcccgggggggtccctggacgaccgttcctccgtggtcgcacggtcctcgtaggtactttccacccgttttccgtggttacggacacgtancggtacgtcgtcgggtcccggaccgaggtaccgtaccggaaggggggaacggggtcgtgggggaggttcgggggtacggacccgaaggacctaagtaaacggaaacgtaaaaggtaaggtaaaaacgggaaaaaaactaaaaaggtttagtagggttaacggttaaccgtttacggtcggggttaacggggacgggggtacccgttaacgtttccgaacgttacgttacccgtaaccgaaacggtaaccgaaaccgaaacccgtaccgttaaaagtttacttacggtttaagttttaaccgtttaccgtaaaaacgtaaacgttaacgaaacgaaaccgttaacccgaaagggacccggaacccggtaaggaaccgttacggttaccgttttagtttaacgttttacgaacggttaaaaccgtaaaccgtaaccgttcccccggtaacgggtaaccgggggggtaaccccgggggggaccgttaaaccccgggggtaaccccgttccgggtaacccgttaccccgtcccgtttaacccgtccggtaccccg

SEQ ID NO: 96548 - DNA, 1051 bp, Homo sapiens
  misc_feature: GYAE6OF01BG2X5.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacaggaggactcaccatggaagttggggctgagcgttgggttttccttgttgtcttatttagaaggtgtccagtgtggtaggtgcaggtcgtgggtgggaggtcggtggggggtagtacgttcgggtaccggacgggggtccccgggggggggtccctaggaacggtaccctccgttcccgtggttcgccgtacgtcccgttcggtacggttaccttttacccgttaccccgtttttccggttggggtttaccggacctaaccgttaggttagggaccgggttccgggtttaccggggggttaccccccgacccgggttaacccgggggtccccgtttaacccgggggggaaaacgggggggggtaaaccgggggggttcccggttaggggggttaaacgggggtttcgggggggttaccgggaacccccgggaaggtaacccgtaaagggttaaaaccggaaaacggtaaaaacggttaaagggttaaaaaccggtaaaaaaaaacgtttaaaaaacgtttagggtacgggttacgggtaacccgtttagggtaggggtaccgggggaggggtacccgttaagtttacccgtaacttaccgtcccgtaaaccgtaacgaaacccgtaaacccgtaaacccggtaaccgttaaacgttactttacttaacggttttaaccgtttaacctaaaagtaaacgttacgtaaaccgtaacgtaacccggtaaacggacccgggaccgggtaaaggtaacccggttaccggttacgtttacggtttaactttacggtaaacggttaacctaaacctacccgttcccgtaaccgggggaaccgggggtaccccggggggaccttaaaccccgggggtccgtttacccggtaacccgttccccggttaccgtttccgtaacccgggtaaccccccg

SEQ ID NO: 96549 - DNA, 906 bp, Homo sapiens
  misc_feature: GYAE6OF01CVUTC.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggtaattggggctgagtcgttgggtttttccttgttgtcttagttttagaaggtgtccagtgtgtaggtgcgagcgtgggtggagttcggtgggggagtacgttgggtaccgacggggcccggggggtcctggacgtacgtcctaccgtgtcgcacgtccctgtcggtacttccctaccttttccgtggttcggctaactagtcgacggtccggttccggggtcccgaccgacgggtcccgtaaccgggaaggggggtaaacggggtccggttaggggtacggggttacgggggtaccggacccgtacggacgtaaagtaacggaaaacggaaaaagtaagtaaaacggtaaaaaaactaaaagtttagtaggttacggacttcggtaggtagggtaaccggggtaccgttaacgttacctaacgttacgttaccgtaaccgaacggtaaacgaaacccgtaaccgtaaccgtaaacgttactttaccgtttaacgtttacgtttaacctaaacgtaaaagtacgtaaaacgtacggtaacccgtaaacgacggaacccgggtaaggtacccgttaccggtttacgtttacggtttttaaacgtttacccgttaaagttaacccggtaaaacttcccgttaaacccgttacccggggtaaaccggggggtaaaccccgggggggtaaccccgttaacccgggggttaaaccccgttcgggttaacccccgttacccgttacccggttaccgttaccccggtaaccccg

SEQ ID NO: 96550 - DNA, 738 bp, Homo sapiens
  misc_feature: GYAE6OF01A094L.43.38.D05.1.454.CMB.1.raw
  modified_base (318)..(318): a, c, t, g, unknown or other
  misc_feature (318)..(318): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcgtgggggagtacgttgggtccgagggcccgggggggtccctggacgacctctccgtggtcgcacgccctcgtggtacttccgtacctttccgtggttgcacntgagtcgtcgggtccgccacggctccgaggggaggtcgtgggagtgggtcgccgagcagtaagaacgaaagagtagaaaactaaaagttgaggtagactcgtaggtcgggacgggtccgtagttactacttacgtccgtacccgaaggtaacccgaaccgaaccgtaacccgtaaagttaactttacgtacgttttacgtttaacctaaacgtaaaacgttacgaaaccgtaggtaacccctaaagggacccggtaaccggaaacgggtacgtacccgggtactttaccgttttaatttaccgttaagtaaacccggtaaactaccgttacccgtaccggttaaccgggggaccggggggtcccaaaccggggtacccgttacgggtaccctaccggttcccgttcgttccgaaccccgg

SEQ ID NO: 96551 - DNA, 859 bp, Homo sapiens
  misc_feature: GYAE6OF01A4ZED.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaagttggggctgagtcgttgggtttttccttgttgtcttaagtttttaggaaggttgtccaggtgtggaggtgcagcgtgggtggagtcggtgggggagtacgttcgggtccgacggggtcccggggggggttccctggacgaccgttccgtccgtggtgccacggccttcgtagggtactttccgtacccttttcccgtgggtttaggccaacgtagtgacggtccggttcggggtcccgacccgtacgggtcccgtacccgggaaggggggtaagggggtccgttaggggacgggttgggggtcgacccgaggaccgaagtaacggaaaccgaaaaaggacgtaaaacgggaaaaaactaaaaacgtttgtaggttacggtaacgttacgttaggggtacgggaacggggggtccctttaagttaccgttaaccgttacgttacccgtacccgaaaggtaacccgtaaaccgaaacccggtaacccttaaaaggtttacctttaacgttaacgtttttacgttttaacctaacgttaaaagttacgaaacctaacgtaacccggtaaaggaacccggaaccgggaacgtaccgtacggtttatttacggtttttaacttcgtaacgtaaacaacgttccgtccggttacgacgggggtacccgggggacctaaccgggacccgttggtaccccgaccgttcgttccgttccgacccg

SEQ ID NO: 96552 - DNA, 824 bp, Homo sapiens
  misc_feature: GYAE6OF01C549G.43.38.D05.1.454.CMB.1.raw
tcagtgtgagtagtcacgaccggtgctcgatttagtatctgatagtttgggtttggggaggtctcagagaggagccttagccctggactccaaggtcctttccacgttggtgatcagcacgtgagcaacaggacgactcaccagtggaagttgggctgagtcgttggttttccttgttgtcttagtttagaggtcgtcagtggtggaggtgcgaggtcggtgggtggacggtcggtggggagtacgtttcggccggacgggggtccgggggtcctgggactccttccgtccgtgtcgacgcggtcctcgtggtacttccgtcgttttcgtggtcgacctagagtcgacgtcggtcggccgacgcggccgtacgggaaggggacgggcgtaggggtaggcgggtacgaccgaggacgtaacgaaaggaaacgaaaaggtaagtaaaaaccgtaaaaaattaaaagtttgtacgggtaacgttacgttacgggtaggaaccgggtacgggtaacctaactttaccgaacgttacgttacccgtaaacgaagaaaccgaaaaccgtaacccgtaacttaaaaggtttcttacggttaacttttaacgttaaaccgaaatttaaacggaagtaaacccgtaacgtaccggtaaaggaccggtacccgaaaggtaaacccgttggttacctttaagtttacccgtagttaaacgtaacccgaaacttcccggttaccggtacccggggtaaacgggggccccgggggtaaacctaccggggtaccctacggttacccttacccgttacgttcccgtaacgtaacccccg

SEQ ID NO: 96553 - DNA, 850 bp, Homo sapiens
  misc_feature: GYAE6OF01C35XU.43.38.D05.1.454.CMB.1.raw
  modified_base (539)..(539): a, c, t, g, unknown or other
  misc_feature (539)..(539): n is a, c, g, or t
tcagtgtgagtagtcacgaccggtgctcgatttagtatctgatagttgggtttggggaggtctcagagaggagccttagccctggactccaaggtccctttccacttggtgatcagcactgagcacagaggactcaccatggaagttggggctgagtcgttgggttttccttgttgtcttattttaggaggtgtcagtgtgaggtgcagcgtgggtggagttcggtgggggagtacgttgggtcccgacggggtcccgggggggtccctaggacgtaccgttccttccgtggtcgccacgtcccgtcgttggtactttcctacccgttttccgtggggtttcgaccgtaactagtggaccgtccggttcggggtcccgccgtacggccggttaccggagggggaagggtcggtagggtagggttggggccgaccgtagccgaaagtaacgaaacgaaaagaagtaaacggaaaaaacttaaaaagttgtacggttacgacgttcggtaggtagggaccgggtctacgttcaactttacnccgtactaacggaactaaccgaaccgtaaccgtaagttactttcgttaactttacgtttacctaaactaagttaacgaaccaacgtacccgttaaagacccggaccggtaaagtaacccggttacgttaccggtttttagttttaacctttaaccgttaacggtaaaacccgttaaactacccggttccccggttaacggggtaaacccgggggggtaacccgggggggtaaacccccaacgggggtttaaccccgtaaccccgggttcttaaccccgggtttccttaacccggtttacccgaacccccgg

SEQ ID NO: 96554 - DNA, 858 bp, Homo sapiens
  misc_feature: GYAE6OF01CTY5Z.43.38.D05.1.454.CMB.1.raw
  modified_base (718)..(718): a, c, t, g, unknown or other
  misc_feature (718)..(718): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtggaggtgcagctgggtgggagtcgtgggggagtacgttgggtccgagggcccgggggggtccctggaggtaactcctccgtgtcgcacgtccctcgtcggactttcctaccttttccgtgggtttcggactacgtagttcggacggtccggttcggggttccccgaccggtacgggtcccgttacccgggaaggggggtaaacgggggtccgttacgggggtagggttcgggggttccgggacccgaaggaccgtaaagttaacggaaaccgaaaaagggtacgttaaaacgggaaaaaaccttaaaaaaaagttttcgtaacggttacgggtaaccgtttcgttaacgggttacggggaaccgggggtacccgttaagtttacccgtaaccgttaaccgttacccttaccgaaggtaaccgaaccgtaaccggtaacccgtaaaggtttacttacgttaacttttacgttactaataaacgtacgaaacgacgtaacctaaaggacggtacccggaggtaaccncggtacgtttagtttacgtttactacgttaaaccgaaactcgtaccgtagttaccggtaaccggggtaaccggggggaccctaaccgggggtaaccccgttagggtaccccgttacccgttccggttacccttacccggg

SEQ ID NO: 96555 - DNA, 715 bp, Homo sapiens
  misc_feature: GYAE6OF01DRSHK.43.38.D05.1.454.CMB.1.raw
  modified_base (223)..(223): a, c, t, g, unknown or other
  misc_feature (223)..(223): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (308)..(308): a, c, t, g, unknown or other
  misc_feature (308)..(308): n is a, c, g, or t
  modified_base (387)..(387): a, c, t, g, unknown or other
  misc_feature (387)..(387): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtggggganacgttggtccaggccggggggtccctgagactctcctgtgcngcctntgattcacctttcgtggtgcacagtgagctcgggtccnccgaggctaccgaggggacgggcgtgggaggtgggcgcagacagtagaacgaaagagtaaggaaaaactaaaaagtttntaggtacggactttacgtggttagggaacgggggtccaagtttacgaccttaagttacctaacccgaacggaacgaaccaaaccggacctaagttacttactaatttacgtttactaaacgtaaatacgtaaaccaaggtaacctaaaggacggtaccggtaaggtaaccgtacggttaccttttaggttttaaccttttacgtaaacggttaaaccgtaaactaccgttaccgttaacgttaacccgggggaaaccgggggggtacccgtaaaccgggaaccccggttcggtacccgtacccggttcctaccgtttccgaaccccgg

SEQ ID NO: 96556 - DNA, 857 bp, Homo sapiens
  misc_feature: GYAE6OF01BLW8G.43.38.D05.1.454.CMB.1.raw
  modified_base (399)..(399): a, c, t, g, unknown or other
  misc_feature (399)..(399): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccagtggaattggggctgagcgttgggttttccttgttgtcttattttaggaaggtgtccagtgtgaggtgcagcgtgggtggaggtcggtgggggacgtacgttcgggtccgacggggtcccgggggggttcccctggacgtacctcctccgtgtcgcacgcctcgtgtacttccgtaccttttccgtggttcggacacgagtcggacgtcggtccgggtcccgccgacgggccgtaccgggaggggacggggtcggtaggggngggttgggtcggccgaaggacgaacggtaaagaaacgtaaaagaagtaaacggtaaaaactaaaaagttagttacggtacggtacttacggtaggtacggggtaacgggtaccgttaacgttaccgaactttacgtacctaccggaaagtaacggaaacccaacccggtactaaaagtttctttaacgtttaacgttttacgttttaaaccaacttaaaaggtacgaaaccgtaacggtaaacccgtaagggaacccggaccggggaacggtaaccgttacgggtccgttttaaggttttaacttaccggtaacgtttaaaacccgaaacctttccggtacccggttaacccggggtaaacccgggggggaaccccgggggtaacccgtaaccccgggttaaaccccgtcgggttaaccccgttacccggttccgtttacccgtaccgtaacccccgg

SEQ ID NO: 96557 - DNA, 883 bp, Homo sapiens
  misc_feature: GYAE6OF01CY7BN.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgacgcacaggaggactaccaccagtggaagttggggctgagtcgtttcgggttttccttggttcgtacttagtttttaaggaaggttcgtaccgtaggttggtaggacggtcgtacaggtccgttgggtggacggttcggtaggggggactaccgttcgggtacccgacggggtcccggggggtcctggacgtaccgtctccgtgcgcacgtcctagtcgtacttcctaccgttttccgtaggttcgcacgtagtcggacgtcggtccgggtccgaccgtacggccgtacggagggggacgggtgtacgggtagggtcgggtcgacgacggactaaggtacgaaacgaaaggtaacgtaaacgtaaaaactaaaagtttcgtacgggttacgtacgttccggtaggtaacgggtaccggggtaaccttagttaccgtaaccgttacggtcccgttaacccggtaaggtaaccccgtaaaccgtaaaccggttaacgttaaacgttttctaaccgtttaagttttcgtttaaacccctaagtaaaccgtaaccggaaccttaacccggggtaaaccttaacggggaccctttacccggggaaagggttaaccccgtttaggttaccgttttaggtttaccttaccggtaacgtaaacccgtaacctacggttccccggtaggggtaacccggggggtaccggggacccttaacggggtccccgttacgggtaccctccccgggtttattcccggttaccgaacccg

SEQ ID NO: 96558 - DNA, 1051 bp, Homo sapiens
  misc_feature: GYAE6OF01CY9OU.43.38.D05.1.454.CMB.1.raw
  modified_base (213)..(213): a, c, t, g, unknown or other
  misc_feature (213)..(213): n is a, c, g, or t
  modified_base (374)..(374): a, c, t, g, unknown or other
  misc_feature (374)..(374): n is a, c, g, or t
tcagtgtgagtagtcacgaccggtgctcgatttagtatctgatagttgggtttggggaggtctcagagaggagccttagccctggactccaaggcctttccacttggtgatcagcactgagcacaggagactcaccagtggaattggggctgagtcgtttcggggtttttccttggttgtcttattttaaggaaggttgtccaggttggtggnggtcgcgtacgcggttgggtggtacggttggtggggggtacgtaaccgtttcgggtcccggacgggggtccccggggggggttccctgacggtacctccgtccgtgtcggcacggtcccttgtacggactttccgtacccttttcgtcgggttcgactacngtcggacgtcgtcgggtccgccgtacggcctccggagggggaacgggtcgaggggtacgggtgggtcggacccgagaccgaaagtacggaaataaaacggtaacggtaaaggtaaaaacctaaaaaagttttacgaggggttaccgtaaccgttcggttacgggttaacggggaacggggggttacccttaacggtttaccgttaaaccgttaccgtttaaccccgtaaccccgggttaaaacggtaaaccgaaacccgggtaaacccggttaaacccgtaaacgggtttaacccttttaaccggtttaacgtttttaacccgtttaaaccgtaaacctttaaacggtaaccgttaaaacggtacccgttaaaacccggtaaacgggttaacccgggaaacccggggtaaaccgggttaacccggtaaccgggtttaccgtttttaaccggtttttaacgtttttaaaacccggtttaaccggttaaaacccggttaaaaccccggttaaccccgttttaccccggggtttaaacggggttaacccccgggggggaaaaccccggggggggggttaacccgtaaaacccccgggggggtaccccgtttacccgggggtaacccccggtttaaccccgggttttacccgttaaccccgtttacccgtaacccccgggg

SEQ ID NO: 96559 - DNA, 778 bp, Homo sapiens
  misc_feature: GYAE6OF01ARR1G.43.38.D05.1.454.CMB.1.raw
  modified_base (433)..(433): a, c, t, g, unknown or other
  misc_feature (433)..(433): n is a, c, g, or t
  modified_base (645)..(645): a, c, t, g, unknown or other
  misc_feature (645)..(645): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaagttggggctgagtcgttgggttttccttgttgtcttattttaggaaggtgtccagtgtgaggtgcgagtcgtggtggagttcggtgggggacgtacgttcgggtaccggacggggtcccggggggttcctagacggtccttccgttccgtggttccgcgtacgtcccgtacgtcggttacctttcccgttaacccgtttttccggtacgggtttcggacctacgtagtggtaccggtcggttccgggtcccgccgacggtccgtaccgggaggggaacgggtcgtaggggnggtacggggtcgaccgagacgaagtaacgaaagaaagtaagtaaacgtaaaaactaaagttgtagtacgtactacggttggacgggtacgggtcctagtacgtactactccgtacgagacgaaccgacgtaactaagttacttacgttaagttcttaacgtaaactaacgtacgaaaccgacgtacgtaaaggccgaacgtacgtaaccggngtttacgtttagtttacgttacgtaacgtaacgtaacttaccgtcccggtacgggtaacccggggtaaccgggggacccttaccgggtacccgttcggtaccccgttacgttcctccgttcccgtaaccccgg

SEQ ID NO: 96560 - DNA, 806 bp, Homo sapiens
  misc_feature: GYAE6OF01DK388.43.38.D05.1.454.CMB.1.raw
  modified_base (336)..(336): a, c, t, g, unknown or other
  misc_feature (336)..(336): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagtcttgggttttccttgttgtcttattttagaaggtgtccagtgtgaggtgcagcgtgggtggagttcggtagggggacgtacgttcgggtccgacgggtcccgggggggttccctggacgtacctctccgtgtcgcacgcctgtggactttacctacccgttttccgtaggttcggacctaanagttcggaggtccgttcggggtcccgccgacggccgtaccgggaagggggaagggcgtgggacggttcgggggtcgaccgaggtaccaagtaacggaaacaaaaggtactaaacgggtaaaaaactaaaaagtttagacggttacggaccttaggtggttacgggaggggtaacctagttacgtaacttacgtcctaacgaacggtaacgacctaaacgacctaaagtttctacttaacgtttgttaacctaaactaagtacgaaacgtacgtaaaccgtaagggtaccgaaccgggtaaggtaaccgtacggttacgtttacgtttttaacggttaacctaggtaaacccctaaactaccggttacccgtacggggtaaccgggggtaaccgggggggtaacccgtaaccggggtaccccttacgggggtaaccctacccgggtttaccgttccgtcggtaacccccgg

SEQ ID NO: 96561 - DNA, 770 bp, Homo sapiens
  misc_feature: GYAE6OF01BTFZK.43.38.D05.1.454.CMB.1.raw
  modified_base (602)..(602): a, c, t, g, unknown or other
  misc_feature (602)..(602): n is a, c, g, or t
  modified_base (616)..(616): a, c, t, g, unknown or other
  misc_feature (616)..(616): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaagttgggactgagtcgttgggtttttccttgttgctttagttttaggaaggtgtccgtagtgtggaggtcgcagcgtgggtggagttcggtagggggtagtacgtttcggccgaggggtcccggggggtcctaggagtaccttccgtccgtggtacgctacggtcctgtggtacttcttaccctttcggtaggtcgacacgtgtcggacgtcggtaccgggtcccacgcggtccgtaccggggaaggggacgggtcgtaggggtacgggttcggggtacgaccgtagacgttaaggtaacgaaacgaaaagtacggtaaaacgaaaaagtttaaaacggttgttacggtacgtacgttcgtaggacgggtacggtacgttacttacctacgtacttacccgtacgaagaacgaacctaaccggaccttaagttactttacttagttttacgtttaacaaanacgttaacgaaccnggtaaccaaggaccgaccgtaacgtaccgttaggttctttagtttacgtagttaccgtaataaaccttcgttaacccggtacggggtaacccgggggacgggtacccgaaccgggtacctcgggtacccttaaccgcttaccgtaccgaccccg

SEQ ID NO: 96562 - DNA, 817 bp, Homo sapiens
  misc_feature: GYAE6OF01B0QUC.43.38.D05.1.454.CMB.1.raw
tcagtgtgagtagtcacgaccggtgctcgatttagtatctgatagttgggtttggagaggtctcagagaggagccttagccctggacctccaaggtcctttccacttggtgatcagcactgagcacagaggactcaccagtggaagttggggctgagtcgttgggtttttccttgttgtctttaagtttttaggaaggttcgtaccaggttggtggaggtgcgagtcgtgggtgggtaggtcggtagggggagtaccgttgggtacccgacgggggtcccgggggggttccctggtacgaccttcctccgtgtcgcacgtcctcgtgtacttccgttacctttcggtggtacgacacgtagtggacgtccggtcgggtcccgcgacgggccgtaccgggaaggggtacgggtgtaggggagggtcgggtacgaccgtagacgtaagtaaacggaaacgtaaaggtaaacgtaaaggtaaaaactaaagtttgtacggtaggtacctggtggtacgggtacgggtactttacgtaccgtaaacttcgacccgtaaccgaaggtaaaccgaaccgtaaccggttaaactaaggttttacttaccttagggttttacccttaacgtaaaacgtacggtaaagaaccgtaaccgtaacggttaaacgggaccggtacccgtaagggttacctcgggtttacttttacgtttaacgttacgtaaacgtaaccgtaactccggttaccgaccggggtaaccgggggacccgggtaccgtaacggttaccccgtacgtaccgttacccgttcgtccttaacccg

SEQ ID NO: 96563 - DNA, 905 bp, Homo sapiens
  misc_feature: GYAE6OF01DRYX3.43.38.D05.1.454.CMB.1.raw
tcagtgtgagtagtcacgaccggtgctcgatttagtatctgatagttgggtttggggaggtctcagagaggagccttagccctggactccaaggtccctttccacttggtgatcagcactgagcacagaggactcaccagtggaagttggggctgagtcgttgggttttccttgttgtcttattttagaaggtgtccagtgtgaggtgcagtcgtgggtggagtcggtagggggagtacgtttcgggtcccggacggggtccccgggggggttcctggaacgtacctccgtccgtggtcgccgacgtccttcgtggtactttcccgttacccgtttttccgtgggtttcggacctaacgtagttacggacggtccggttccggggtcccgacccggtacggtcccgtaccggggaagggggtacggggtcgtagggtacgggtcggggtaccggaccgtaggaaccgtaaggtaacgaaaaccgtaaaaaggtaaacgtaaaacggtaaaaaacttaaaaaagtttgtaaggttacggtacgttcggtagggtacgggtacggggtaccttacgttaccgtaacttacgtaccgtacgaaaggtaaccgaaaccgtaaacccgaaccgttaaagttactttacgttaacgtttttacgtttaaacctaaacgtaaacgtaactaaaccggtaacgtaaccggtaaaggacccggaacggtaaccggtaaccgtaccggttacttttacgttttaagttaacccgttaagtaaacccgttaaactacccggttccccggttaaccgggtaacccgggggaaacccggggggtaccgtaaccccggggttaaaccccggtcggtaccccgttaacccgttcccctttccgttacccggtaacccccg

SEQ ID NO: 96564 - DNA, 781 bp, Homo sapiens
  misc_feature: GYAE6OF01EAXEG.43.38.D05.1.454.CMB.1.raw
  modified_base (412)..(412): a, c, t, g, unknown or other
  misc_feature (412)..(412): n is a, c, g, or t
  modified_base (460)..(460): a, c, t, g, unknown or other
  misc_feature (460)..(460): n is a, c, g, or t
  modified_base (502)..(502): a, c, t, g, unknown or other
  misc_feature (502)..(502): n is a, c, g, or t
  modified_base (643)..(643): a, c, t, g, unknown or other
  misc_feature (643)..(643): n is a, c, g, or t
  modified_base (700)..(700): a, c, t, g, unknown or other
  misc_feature (700)..(700): n is a, c, g, or t
tcagtgtgagtagtcacgaccggtgctcgatttagtatctgatagttgggtttggggaggtctcagagaggagccttagccctggactccaaggccctttccacgttggtgatcagcactgagcacagaggactcaccagtggagttgggctgagtcgtttggttttccttgttgtactttaagttttaggaaggttgtccgtaggtggttggaggttgcaggtcggttggggtagggtacggttcgggtaggggggacgttaccggtttcggggtacccggacgggggttccccgggggggtaccctaggtaccggtaccttccgttccgtggttcgccgtacgtcccgttcgtcggttacttccgttaccgttttcgtggtcacaagtgtcgacggtccggtcgggtccncggtacggcgtaccgggaggggacggtgtgggacggtgggcgacaganaagtaacaagaagtaagtaacgaaaataagtgtaggtacgtntacggtggacggcggtacttatactacttcgtaccgaggaagtaaccgaacgaaaccttcggtaatttacctaggtttaactttacgttaaacaaacgtaagtaacgaacgtacggtaacgtaagggaccacggggttaanaacctcggtttacgttattttaaccggtacgtaacgttaaaccgaactttccccggnggggtaacccgggtaacccggggggcgggaaccctaccggtagtaccggtttcccgaccgtttctccggaacctacccggg

SEQ ID NO: 96565 - DNA, 908 bp, Homo sapiens
  misc_feature: GYAE6OF01BC234.43.38.D05.1.454.CMB.1.raw
  modified_base (502)..(502): a, c, t, g, unknown or other
  misc_feature (502)..(502): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagagactcaccatggagttgggctgagtcgttgggttttccttgttgcttatttagaggtgtccagtgtgtaggtgcagtcgtggtggacgtcggtagggggagtcgttcgggccgacgggggtcccggggggtcctaggacgtcctccgttccgtggtcgaccgacggtccctcgttaggtactttcccttacccgttttccgttggggttcggactacgagtcggaggtccggttcggggtcccgaccggacggtcccgtaccggggaagggggtagggtccgttaggggcgggttacgggggtccggaccgtaaggacaacggttaaacgaaaccgtaaaagtaacgtaaaacggtaaaaactaaaaacggtttntacgggttaacggtacccttagggttcggtaacggggacgggggaccctttaacgttaccgtaaccgttacttacccggtaaccgtaacgggtaaccgtaacccgtaaacccgtaacgtttaaaacggtttacttaaccgtttaagtttttaccgtttaaaccgtaaactaacgtaaccggttaaaccgaacgttaaccggttaaaccggaccgggaacccggtaacgggtaccctaacgggtttccttttaaggttttaacctttacgggtaacgttaaacccgtaaccgttacggtttccccgtacccggggtacccgggggtaacccggggggtacccgtaaacccggggttacccggtacccggttaccggttaacctccccgttcggtaccctaacccggg

SEQ ID NO: 96566 - DNA, 903 bp, Homo sapiens
  misc_feature: GYAE6OF01E4LGT.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaaccagtggtaagttggggctgagtcgttgggttttcctttgttgtacttagttttaaggaaggttgtcctaggtggtgaggtgcaggcgtgggtggagtcggtagggggagtacgttggtcccggacgggcccgggggggttcctggacgtacctccgtccgtgtacggccacgccctcgtagggtactttccttacccgttttccgtagggtttcggacctacctagtcgtaggccggttcgggtaccccgccgtacgggccgtaccgggaacgggggtaacgggacgtgggtacgggttcggggtcggaccgagacgacgtaaacgaacgtaaaaagtacgtaaaagggtaaaaacttaaaaagttagttaacggtacggtaccttcggttaggacgggtaccgggggtaccgttaccgtttacgtaccgttaacgtcctaaccgggtaacgtaacgaaacccgtaaccgtaaccgtaaacgtttaccgtttaacgttacgttttaacgtttaaccctaagtaaacttacggaaaacgtacgtaaacccgtaaaggaaccgggacccggaaaggtaacccgttaccgggttacttttaacggttttacgttaaccgttaacggttaaaaccgtaaacccttaccgttaccccggtaccgggttaaccccggggggtaacccgggggggaaccccgtaacccgggtaaccccggttacccggtaccccggttacccggttacccgtttcccgtaaccggtacccccgg

SEQ ID NO: 96567 - DNA, 1041 bp, Homo sapiens
  misc_feature: GYAE6OF01BY2ND.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcacatggaagttggggctgagtcgttcgggtttttccttgttgcttagttttaaggaaggtgtcctagttgtggtagtgcgagtcgtgggtggaggtcggtgggggatacggtttcggaccggacggggtcccgggggggttccctaggacgtaccttcctccggtggtcgcgtacgtcccgttcgttaggttacctttaccgttaccccgtttttccggttacggggtttcggacctaccggtagttagggtaccggtccggtttccgggggtccccgaccggtaaccggggtcccgttaacccggggaagggggggtaacgggggtcggtagggggttacggggtcggggggttccggaccggtaacggtacgtaaacggtaaacggaaaaccgaaaaagggttaaacggttaaaacgggtaaaaaaaactttaaaaaacggttttaggttaacgggttacggttaaacccgtttaacgggttcgggggttaacgggggtaacccgggggttacccgttaagtttacccgttaacgtttaacccgtttacccgtaacccggaaagtaaacccggtaaacccgtaaacccgtaacccgttaaacgtttaacttttacgtttaacggttttaaccgttttaaccgtaaaacgttaaacgttaccggtaaaaccgtaaccgtaccggttaaaacgggacccggtaacccgggggtaaccgtaaccgggttaccggtttacgttttaacggttttaacgtttacccgttaaacggtaaacccgttaaaaccgttcccgttaacccgggttacccggtaaacccggggggttacccggggggaaacccgtaccggggtaaccccggtttacggtacccgttaacccgttccgttaccggtaccgtaccccgg

SEQ ID NO: 96568 - DNA, 932 bp, Homo sapiens
  misc_feature: GYAE6OF01CF4DQ.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccagtggaagttgggctgagtcgttgggttttccttgttgtcttagttttagaaggtgtccagtgtggaggtgacgtagcgtgggtggagtcggtgggggacgtacgttcggtccgacggggtccccggggggtacctggacgtaccttccgtccgtgtcgcgacgccttcgtggtacttccgttaccctttcgtggttcgacacgtagtgacgtcgtcgggtcccgccgacggtccgtaccggaaggggacgggtcgtgggtaggtggggtcgaccgagacgtaagtaagaaacgaaaaggtacgtaaaggaaaaaacttaaaagtttagtaggtaacggtaccgttcggttaaggggttacggggaccgggtaaccgttaacgtttaccgtaaccgtttaaccgttaccccgttaaccggaaacggtaaaccgaaaacccgtaaaccggtaacccgttaaaagttttactttaaccgtttaacgtttttaaccgtttaaaccgttaaacgttaaaacgttaaccggaaaaaccgtaacggtaacccgttaaaagggtaacccggaacccggtaaacgggtacccgtaaaccggttttccgtttttaagtttttaaccgtttaccggttaaaccggttaaaaacccgaaacccgtttaaccggttacccccggttaacgggtaaaccccgggggggtaacccgggggggaccccgttaaaacccggggttaccccggttaccgggttacccccgttacccgggtttacccgttcccgttacccggtaaaccccccgg

SEQ ID NO: 96569 - DNA, 543 bp, Homo sapiens
  misc_feature: GYAE6OF02HWN3U.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagacttggtccaggccgggggggtccctggagactctcctgtgcagcctctggattcacctttcctggttggcacatgagctgggtccgccaggctccgaggggaagggctggagtgggtggccagcatagacaaaagataggaaaacaaaaattatgtaggactctgtgaggggccattcactatctcagagacaacgccaagtattcatttgtttactaacaaatgaacagacctaagagaccgaggacacggctgtttattctgtacgaacatcctctacggaacggggggccagggaccctggtaccaccgtctctcacg

SEQ ID NO: 96570 - DNA, 542 bp, Homo sapiens
  misc_feature: GYAE6OF02G77KH.43.38.D05.1.454.CMB.1.raw
  modified_base (306)..(306): a, c, t, g, unknown or other
  misc_feature (306)..(306): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagacttggtccagccgggggggtccctgagactctcctgtgcagcctctggattcacctttcctggttggcacatgagctgggtccnccaggctccgaggggaaggggctgggagtgggtggccagcatagacaaagataggaaaacaaaaattatggtaggactctggtggaggggccattcactatctccagagacaacgccaagtattcatttgtttactacaaatgaaacagacctaagagccgaggacacggctgttattctagtacgaacatcctctcggaacggggggccagggaccctggccaccgtctctcacg

SEQ ID NO: 96571 - DNA, 601 bp, Homo sapiens
  misc_feature: GYAE6OF02GUDOP.43.38.D05.1.454.CMB.1.raw
  modified_base (356)..(356): a, c, t, g, unknown or other
  misc_feature (356)..(356): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcgtgggtttcctgttgctatttagaaggtgtccagtgtgaggtgcagctggtggagtctgggggagacttggtccaggcccgggggggtccctggagactctcctgtgcagcctctggattcacctttcctggttggcacatgagctgggtccgccaggctccgaggggaagggctggagtgggtggccagcatagacaaagntaggaaaacaaaaattatagtaggacttctggtggaggggtccgattcactatctccagagacaacgccaagtacttctatttgtttactaacaaattagaacagaccctaagacgaccgaaggacacggacttgtttaactttctagtaccgtaaactacgttccctaccgtcggtaaaccggggggggccctaacggggaaccccgtcgggttaccgacccggttccttccgttctaacccgg

SEQ ID NO: 96572 - DNA, 566 bp, Homo sapiens
  misc_feature: GYAE6OF02HJO0J.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagacttggtccaggccgggggggtccctgagactctcctgtgcagcctctggattcacctttcctggttggcacatgagctggggtcccgccaggcctccgaggggaaggggctgggagtgggtggccagcatagacaaagataggaaaacaaaaattatagtaggaactctggtgaggggccattcactatctccagagacaacgccaagtatcatttgttactacaaatgaacagacctaagacgaccgaggacacggcttgtttaattctagtacgaactactcctcgtacggaaccgggggggccaacggggaacccgtgggtaccaccggtctccttcaccg

SEQ ID NO: 96573 - DNA, 595 bp, Homo sapiens
  misc_feature: GYAE6OF02H6F2G.43.38.D05.1.454.CMB.1.raw
  modified_base (308)..(308): a, c, t, g, unknown or other
  misc_feature (308)..(308): n is a, c, g, or t
  modified_base (360)..(360): a, c, t, g, unknown or other
  misc_feature (360)..(360): n is a, c, g, or t
  modified_base (377)..(377): a, c, t, g, unknown or other
  misc_feature (377)..(377): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcgtggtttccgtgtaggctatttagaaggtgtccagtgtgaggtgcagctggtggagtctgggggagacttggtccaggccgggggggtccctggagactctcctgtgcagcctctggattcacctttcctggttggctacatgagctgggtccnccgaggcctccgagggaaggggctgggagtgggtggccagcatagacaaagntaggaaaactaaaaatntgtggactctggtggaggggcctagttcaacgtactctccaaggacgacaacgaccaagtattactatttgttactaacaaatgaaacagtacctaaagcgtaccgaaggacgacggtctggttttaacttcttagtacgaaactagtccctacgtacggaaccgggggggccacggggaacccttcgggtcctacccggttcgttccctcgtacccg

SEQ ID NO: 96574 - DNA, 578 bp, Homo sapiens
  misc_feature: GYAE6OF02FGOTS.43.38.D05.1.454.CMB.1.raw
  modified_base (284)..(284): a, c, t, g, unknown or other
  misc_feature (284)..(284): n is a, c, g, or t
  modified_base (307)..(307): a, c, t, g, unknown or other
  misc_feature (307)..(307): n is a, c, g, or t
  modified_base (356)..(356): a, c, t, g, unknown or other
  misc_feature (356)..(356): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcgtgggttttcctgttgctattttagaaggtgtccagtgtgaggtgcagctggtggagtctgggggagacttggtccagccgggggggtccctgagactctcctgtgcagcctctggattcaccttttccnggttggcacatgagctgggtccnccaggctccgagggaaggggctggagtgggtggccagcatagacaaagntaggaaaacaaaaattatgtaggactctgtgaggggccattcactatctccagagacaacgccaagtattcattgtttactacaaatgaacagacctaagagccgaggacacggcttagtttatttacgtagttacgaaactacgttccctacgtaccgaacggggggggtccaacgggggaaccccgtgggtacccgtaccggtccttccgttaccaccgg

SEQ ID NO: 96575 - DNA, 730 bp, Homo sapiens
  misc_feature: GYAE6OF02HGR5Z.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagacttggtccagccggggggtccctgagactctcctgtgcagcctctggattccacctttcctggttggcacatgagcgtgggtccgccaggctccgagggaggggctgggagtgggtggccagcagtagacaaaagataggaaaaacaaaaagttataggtagggaaccttctggttggaacgggggtacccgtatttccgaacttacgtccttacccaaggacgaaccgaaaccgaccaaagttacgttactaagttttacgtttaccttaactaaaacgttcgaaactaacgtaacccgttaaaggacggacccggaagggtaaacccgtaaccgggtacgtttacggtttttaacgttttaccgttacggttaaccggtaaaaccgtaccgttcccgttaccggttaccgggtaaacccggggggggggtccctaaaccgggggtaacccccggttacgggtaccccgtaaccccggttacccttacccggttacccgtaacccgg

SEQ ID NO: 96576 - DNA, 530 bp, Homo sapiens
  misc_feature: GYAE6OF02JH0P5.43.38.D05.1.454.CMB.1.raw
  modified_base (219)..(219): a, c, t, g, unknown or other
  misc_feature (219)..(219): n is a, c, g, or t
  modified_base (302)..(302): a, c, t, g, unknown or other
  misc_feature (302)..(302): n is a, c, g, or t
  modified_base (349)..(349): a, c, t, g, unknown or other
  misc_feature (349)..(349): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (474)..(474): a, c, t, g, unknown or other
  misc_feature (474)..(474): n is a, c, g, or t
  modified_base (479)..(479): a, c, t, g, unknown or other
  misc_feature (479)..(479): n is a, c, g, or t
  modified_base (511)..(511): a, c, t, g, unknown or other
  misc_feature (511)..(511): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaaccatggaattggggctgagcgtggtttccgtgtagctatttagaaggtgtcagtgtgaggtgcagctggtggagtctggggganacttggtccagccgggggggtccctgagctctcctgtgcagcctctggattcacctttcctggttgcacatgagctgggtccnccaggctccagggagggctggagtgggtggccagcagtagacaaagntggaaaacaaaattangtagactntgtgaggggcagttcatatctaccagagacaacgcctaagtattcattgttcacgaaatgaacagcctaagagccgagacaggctgtttatctgtacgaantcctntacggaaccgggggcaagggaccctggtaccnccggtactccttacgaccg

SEQ ID NO: 96577 - DNA, 1013 bp, Homo sapiens
  misc_feature: GYAE6OF02FRK9U.43.38.D05.1.454.CMB.1.raw
tcagtgtgagtagtcacgaccggtgctcgatttagtatctgatagttgggtttggggaggtctccacgagaggacgccttagcccgtggacctccaaggcctttccacctttggtgatcacgcactgaggcaaccagaggacgtcaccactcggtaacttggggctgagctagggtttccttgttgctactttagaaggtgtccgagtgtgaggtgcagctggtggaggtcgtgggggagacgttggtccgacggtccggggggtccctgacgacgtctccgtgtcgtcaggacctctggtagttccaaccttttccgtggttggcctacgattcgacgtttaggggtccgtccgacgggaccttcccgaacggggtaaagggggccgttagggggaacgttgggggttacgggcccgtaaggtccgaagttaagggaacctaaaaacggtaccgttaagggaaaaaccgtaaaaaaacggttttagtaacggttaacgggaaccgtttacccgtttacgggtttacgggaaacggggggtaccccgtaaaggttttacccgtaaccgtttaaacggtttcccgtttaaccccggaaacgggtaaccgggtaaacccgtaaaacccgggtaccccgttaaaaacgggttaaccgtttaacccgtaaacggttttttcccggttttaaacccgttaaaccgtaaaaacgttcgggtaaaaccctaacggtaaccccgtttaaaacggaaccgggtaaccccggtaaccgggtaaacccgtaaaccggggttacccgtttaacggttttttaaaccgttttaccgtttaaccggtttaaacccggttaaacccgtttaccgttaccccgtttaacggttaacccggggtaaaccccggggggggggtacccctaacccgggggtaaaccccccggtttacgggggttaaccccgggttaaccccgggttttacccgtttacccggttttacccggaccggtttaacccccccggg

SEQ ID NO: 96578 - DNA, 599 bp, Homo sapiens
  misc_feature: GYAE6OF02H58ZP.43.38.D05.1.454.CMB.1.raw
  modified_base (364)..(364): a, c, t, g, unknown or other
  misc_feature (364)..(364): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagacttggtccagccggggggggtccctggagactctcctgtgcagcctctggattccaccttttcctggttggcacatgagctggggtcccgccgaggcctccgagggaaggggctgggagtgggtggccagcatagacaaagntaggaaaacaaaaattatagtggaactcgtgtggaggggcctattcactatctccagagacaacgccaagtattcatttgtttctaacaaatagaacagtacccgtaagacgaccgaggaccgacggctagttttacttcttaggtacaaacgtacttccgttccgtacgggaaccggggggggtcccaacggggtacccttcgggtaccctacccggtcttccgttccgaccgg

SEQ ID NO: 96579 - DNA, 611 bp, Homo sapiens
  misc_feature: GYAE6OF02H0U3C.43.38.D05.1.454.CMB.1.raw
  modified_base (312)..(312): a, c, t, g, unknown or other
  misc_feature (312)..(312): n is a, c, g, or t
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
  modified_base (418)..(418): a, c, t, g, unknown or other
  misc_feature (418)..(418): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagactttgggtccgaggccgggggggtccctggagactctctgtgcagcctctggattcacctttcctggttggcacattgagctgggtccnccgaggctccgagggacggggctgggagtgggtgccaggcataggacaaagataggaaacaaaattangtagactntaggtggagggccattcactatctacaganacaacgcaagtatcatttgttactaacaaatacgaactagaacccgttaagacgaccggaaggaaccacgggtacttagtttaatttcgtagtaaccgtaactacgtacccttcgtaccgggtaaccgggggggacccaacggggtaacccggttcggtacccgtacccggttcgttacccgttactaaccgg

SEQ ID NO: 96580 - DNA, 597 bp, Homo sapiens
  misc_feature: GYAE6OF02IMV6R.43.38.D05.1.454.CMB.1.raw
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagacgttggtccagccgggggggtccctgagactctctgtgcagcctctggattcacctttcctggttggcacatgagctgggtccnccaggctccagggagggctggagtgggtggcagcatagacaaagataggaaacaaaattnagtgactctgtaggagggcctagttcacgtactctccgaagacgaacaacgcctaagtattacatttcgttactaactaaatagaaccagtacctaaagacgaccgaaggaaccgacgcttagttactttacgtagtacgtaaactcgtacctactaccggggaaccggggggaccaacggggtaacccgtcgggtacccgaaccggttcccttacgttacccgtaaccgg

SEQ ID NO: 96581 - DNA, 588 bp, Homo sapiens
  misc_feature: GYAE6OF02GJAAD.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagacttggtccaggccgggggggtcctgagactctcctgtgcagcctctggattcacctttcctggttggcacatgagctgggtccgccaggctccgagggaaggggcgtggaggtgggtggccagcgatagacaaagataggaaaacaaaaattaatgtaggactctgtggaggggcgattcactatcctcagagacaacgaccaagtattcattgtttacaacaaatgaacagcctaaagagccgaaggaccacgggtcttgttttaatttctagtaccgaaacattcccgtcttaccgggaaaccggggggggtacccaacggggtaaccctcgggttcccaaccggttccttaccgttacaccgg

SEQ ID NO: 96582 - DNA, 571 bp, Homo sapiens
  misc_feature: GYAE6OF02HSGFK.43.38.D05.1.454.CMB.1.raw
  modified_base (379)..(379): a, c, t, g, unknown or other
  misc_feature (379)..(379): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagacttggtccaggcccgggggggtccctgagactctcctgtgcagcctctggattctacctttcctggttggcacatgagctgggtcccgccgaggcctccgaggggaggggctggaggtgggtgccagcatagacaaagataggaaaacaaaattanagtaggaactcgtagtggaggggcctattcactatctcagagacaacgcaagtattctatttgtttactaacaaatagaacagacctaaagagaccgaggacacggtcttagtttattctagtacgaactacgtcctcgtacggaaccggggggaccacgggacccgtcggaccgacccgtctactctaccg

SEQ ID NO: 96583 - DNA, 571 bp, Homo sapiens
  misc_feature: GYAE6OF02FZX8I.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagacttggtccagccggggggggtccctgagactctcctgtgcagcctctggattcacctttcctggttggcacatgagctgggtccgccaggctccgaggggaaggggctgggagtgggtggccagcatagacaaagataggaaaacaaaaattatagtaggactcgtgtggaggggccattcactatctccagagacaacgccaagtattcatttgtttactaacaaatgaaacagacctaagacgaccgaaggacacggcttagtttatttctacgtacgaacactcctacgtacggaaccgggggggccaacggggaccctgggtacctaccggtcctccgttcaccg

SEQ ID NO: 96584 - DNA, 754 bp, Homo sapiens
  misc_feature: GYAE6OF02J2EEN.43.38.D05.1.454.CMB.1.raw
  modified_base (155)..(155): a, c, t, g, unknown or other
  misc_feature (155)..(155): n is a, c, g, or t
  modified_base (190)..(190): a, c, t, g, unknown or other
  misc_feature (190)..(190): n is a, c, g, or t
  modified_base (205)..(205): a, c, t, g, unknown or other
  misc_feature (205)..(205): n is a, c, g, or t
  modified_base (745)..(745): a, c, t, g, unknown or other
  misc_feature (745)..(745): n is a, c, g, or t
tcagtgtgagtagtcacgaccggtgctcgatttagtatctgatagttgggtttggggtaggtcgtcagagaggaggccttagccctcggactccaaggcctttccacttggtgatcagcactgagcacagaggactcaccagtggaagttgggcngagcgttcggtttcttgtgtcttagtttagaggtntcagtgtggagtgcngcgtggtcggtagtcggtgggacgtcgtttggccggacgggtccggggggtccctggtaacggtctccgttccgtggtacgccgacgtcccgtcgtcggttccgttccgtcccgttttcgttcggttcgtccgtaccgtagtggtcgtccggtcggtcccgccggtacggccggttaccggaacggggtaggggtcggtacggggtacggtggggtcggccgtaacggcgtaagtacgaacgtaaacgaagttaaaggaaaacgtaaaatacgtacggtacgtaacgttccggtagggttacggagggtacctgttaaccgtcgtaacttccgtaacgaagggtaccaaccgaacggtaccgtaagttcttaacttcgtttaaggttaactaacgtaaagtcaaaccggtaactacggtaacgaacgtccggtaacggaccgttacgttcgtttaacttctagtaccgtacaacgttcctaccggtacgacggggtaccgggtaacgacgaccggttcgaccgtaaccgtcgtttacccncgtacccgg

SEQ ID NO: 96585 - DNA, 661 bp, Homo sapiens
  misc_feature: GYAE6OF02HODI4.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcgtgggttttccgtgttgctattttagaaggtgtccagtgtgaggtgcagctggtggagtctgggggagacttggtccagcccgggggggtccctgagactctcctgtgcagcctctggattccaccttttcctggttggccacatgagctgggtcccgccgaggcctccgagggaacggggctgggacgtgggtcggccgagcataagaacaaagataggaaaactaaaagttagtgtaggacttacgtggtaggaggggtccctattcacgtatccgtacagagaaccgaacgaccgtaaagttattaccgtagtttcgtttactaacgtaaattacgaaactacgaaccgttaaagacgaccggaaggaccgtaaccggtctttagtttactttacgtacgttaaccgaactacgtaccctcgtaaccgggaaccgggggggtcccgtaaccgggtaacccgttcgggtacccgtaccggttcccgttaccgttaccgtaacccg

SEQ ID NO: 96586 - DNA, 635 bp, Homo sapiens
  misc_feature: GYAE6OF02HXEM8.43.38.D05.1.454.CMB.1.raw
  modified_base (381)..(381): a, c, t, g, unknown or other
  misc_feature (381)..(381): n is a, c, g, or t
  modified_base (442)..(442): a, c, t, g, unknown or other
  misc_feature (442)..(442): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagacgtttggtccgaggcccggggggggtccctggacggactcctccgtgtgcagcctcgtggattcctaccttttccgtggttcggcacatggagcgtggggtccgccgaggcctccgaggggaaggggctgggagtggggtgccagcagtagacaaagngtaaggaaaactaaaaattgtagtagactcgtgtaggaggggccattcactatcctcaganacgaacgccaagtatctattgttactaacaaatagaacagtacctaagacgacgaaggacacggtcttaggtttatttcgtacgtaacgtaactaccgttcctaccggtaccggggtaaccggggggggtacccaacggggtaaccccgttccggggtacctaaccccggtttcttacccgttacgtacccgg

SEQ ID NO: 96587 - DNA, 805 bp, Homo sapiens
  misc_feature: GYAE6OF02H2VO6.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgcttattttaggaggtgtccagtgtgaggtgcagtcgtgggtggagtcggtagggggatacgtttcgggtccgaggggtccccggggggttcctggacgtacttccgtcgtgtcgcacgccctgtcggtattcctaccgttttccgtggttcggacctacgagtgacgtccgtacgggtccccgcgacgcccgttaccggaaggggaacggggtccgtaggggtacgggtggggtaccggaccgaggaccaaggttaacgaaaaccggtaaaaggtagtaaaacgggtaaaaaaacctaaaaaagtttcggtaacgggttacggtacccttaaggttcgggtaacggggtaaccgggggtacccgttaacgtttaccgtaaccgtttaccgttaccccttaccggaaacggtaacgtaaaccgaaacccgtaaccgttaaaggtttacctttaacgtacgtttttaaccgtttataaaacccttaagtaacaaaccgtcgaaaccgtaaggacggtaaccgaggaactaagtcggtactttgtttaacttcgtacgtaacgtactcgttcccgtacgaccggggtaccggggacctaccgggtacctcggttaccgtacccgttcgtaccgtaccg

SEQ ID NO: 96588 - DNA, 682 bp, Homo sapiens
  misc_feature: GYAE6OF02G1E1R.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtccgtgggggacgacgttggtccacggcccgggggggtccctggacgactcctcctgtcgcagcctcgtggacttcctaccttttccgtggttcggcacatgagcgtcgggtccgccgaggcctccgaggggaacgggcgtgggaggtgggtcggcgagcagtaagaacgaaaagagtaaggaaaaactaaaattagtaggtagacttcgtaggtaggacggggtacctagtttccgaacttactacctaccgaagaacgaacaaccgacctaaagttacttactaagttttacgtttactaaacgtaatacgaacacgtacctaaacggacgaccggaaggaaccgtacggtacgttagttttaacttacgtacgttacgtaacgtactcccgttacgtaccgggtaaccggggggtaccgaacgggttacccgtcggtaccgtaccggttcgttaccgttacacccgg

SEQ ID NO: 96589 - DNA, 670 bp, Homo sapiens
  misc_feature: GYAE6OF02IPUY4.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagacgttggtccaggcccggggggggtcccctggacgacctctcctggtcgcagccttcgtggacttccacccttttcctgggttcggcacatggagtcgtggggtccgccaggcctccgaggggagggctgggagtgggtgccgagcagtacgacaaagatagggaaaaactaaaagttagtaggtaggacctcgtaggaggacgggggtacctaagtttcaaccgttatcctacgaagtacgaacacgacgtaacgtattctatttcgttacctaactaacgtgaaaccagttaccgtaaaggccggaccggtaagaaccgacgggtactttggttttaaacttcgttacgtacgtaaactccgttccgtaaccggaccggggaaccggggggtacctaaccgggtacccgtcgggtaccctacccggttctacccgttccgaacccg

SEQ ID NO: 96590 - DNA, 586 bp, Homo sapiens
  misc_feature: GYAE6OF02JFMT9.43.38.D05.1.454.CMB.1.raw
  modified_base (423)..(423): a, c, t, g, unknown or other
  misc_feature (423)..(423): n is a, c, g, or t
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagacttggtccaggccggggggggtccctgagactctcctgtgcagcctctggattcacctttcctggttggcacatgagcgtggggtcccgccaggcctccgaggggaaggggctgggagtggggtcggccagcagtagacaaagataggaaaactaaaattatagtgactcgtggtggacggggctattcactatctcaganacaacgacaagtnttcatttnttacactaaatgaacacgacctaagacgaccgaggacacggtcttagtttactttcgtacgtacgtaactacgttcctaccgtacgggaaccggggggccaacggggacccgtggtacccgtaccggttctccttcgtaccg

SEQ ID NO: 96591 - DNA, 648 bp, Homo sapiens
  misc_feature: GYAE6OF02G7Z5Q.43.38.D05.1.454.CMB.1.raw
  modified_base (163)..(163): a, c, t, g, unknown or other
  misc_feature (163)..(163): n is a, c, g, or t
  modified_base (168)..(168): a, c, t, g, unknown or other
  misc_feature (168)..(168): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (178)..(179): a, c, t, g, unknown or other
  misc_feature (178)..(179): n is a, c, g, or t
  modified_base (181)..(182): a, c, t, g, unknown or other
  misc_feature (181)..(182): n is a, c, g, or t
  modified_base (184)..(184): a, c, t, g, unknown or other
  misc_feature (184)..(184): n is a, c, g, or t
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (195)..(196): a, c, t, g, unknown or other
  misc_feature (195)..(196): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
  modified_base (308)..(308): a, c, t, g, unknown or other
  misc_feature (308)..(308): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcgtgttcgtntagcnttanagntcnngnngngcngcngnganngggnctgcngcggggtccngagctctcngtgcagcctcnggtatcacttcctggtggcacatgngctggtccgcgaggctccgaggaacgggctggagtgggtgccaggacntaagacgaaagatagggaaaactaaaattaagtggtagaacgttcgtaggtggtaacggggcccagtttcccgaacttaacgtccgttacccgaaggtacgtaaccgtaaacgacccgttaaagttacgttcctaacgttttcggtttaccttaaacaaacgttaccgtaaagtaccgtacccgtttaaaggacggtaccggtaacggacctaccgggttctttacgtttagttaccgttacggtaactaaccggtacttcccgtaggtacccgggaaccggggggtacccgtaacgggtacccgtaggtcccgacccgttcgttaccgttacgacccgg

SEQ ID NO: 96592 - DNA, 723 bp, Homo sapiens
  misc_feature: GYAE6OF02IJ2GE.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagacttgggtccaggcccgggggggtcccgtcggagacctctcctgtgcagcctctggattcctaccctttccgttcggttggtcacatgagcgtcgggtccgccgacggccgtccgacggggaaggggcgtgggaggtgggtcgggccgagcgagtaacggaacaaaggaagtacggaaaaactaaaagttaacgtaggtaggacttcgttggtacggacgggggtaccgtactttaccgaaccgttataccgtccgaacgtaacggaacaacccggaaccctaacgttaactttcctaagttttacgttttacctaaacctaaattagaaacccacggtaaccgttaaaggacggacccggaagggaccaacgggttcttacggttttaattccgttaagtaccgaaactcctcccgtaccggtaccggggaacccggggggtaccgaaccgggttaacccgttcgggtaccctaccggttccttacccgtacgtacccgg

SEQ ID NO: 96593 - DNA, 605 bp, Homo sapiens
  misc_feature: GYAE6OF02HQDSO.43.38.D05.1.454.CMB.1.raw
  modified_base (310)..(310): a, c, t, g, unknown or other
  misc_feature (310)..(310): n is a, c, g, or t
  modified_base (383)..(383): a, c, t, g, unknown or other
  misc_feature (383)..(383): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagacttggtccaggccgggggggtccctggagactctcctgtgcagcctctggattcacctttcctggttggcacatgagctggggtcccnccgaggcctccgaggggaagggctgggagtgggtcggccagcagtagaacaaagataggaaaactaaaaattnagtagacttctggtggaggggccattcactatctccagacacgaacgccaaagtattcaatttgtttactaacaaagtcgaaacacgacctaaagacgaccgaaggacgaccggtctttagtttactttcgagttaaccgaactacgtccctacgtaccggggaaccgggggggtaccaacgggtaacccgtggtaccctaccggttctccttacgtacccg

SEQ ID NO: 96594 - DNA, 545 bp, Homo sapiens
  misc_feature: GYAE6OF02HE1R2.43.38.D05.1.454.CMB.1.raw
  modified_base (369)..(369): a, c, t, g, unknown or other
  misc_feature (369)..(369): n is a, c, g, or t
  modified_base (433)..(433): a, c, t, g, unknown or other
  misc_feature (433)..(433): n is a, c, g, or t
  modified_base (483)..(483): a, c, t, g, unknown or other
  misc_feature (483)..(483): n is a, c, g, or t
  modified_base (489)..(489): a, c, t, g, unknown or other
  misc_feature (489)..(489): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttcctgttgctattttagaaggtgtccagtgtgaggtgcagctggtggagtctgggggagacttggtccagccgggggggtccctgagactctcctgtgcagcctctggattcacctttcctggttcggcacatgagctgggtccgcaggctccagggaagggctggagtgggtgccaggcatagacaaagataggaaaacaaaattangtggactctgtgaggggccattcactatctccagagacaacgccaagtattcattcgttactanaaactgaacagactaagacgcgaggacacgctgttaattctgtacgaacngtaccncttacggaacggggggtcacgggaacccgtggtaccgaccgtctaccgttcaccgg

SEQ ID NO: 96595 - DNA, 570 bp, Homo sapiens
  misc_feature: GYAE6OF02HJ1KU.43.38.D05.1.454.CMB.1.raw
  modified_base (358)..(358): a, c, t, g, unknown or other
  misc_feature (358)..(358): n is a, c, g, or t
  modified_base (410)..(410): a, c, t, g, unknown or other
  misc_feature (410)..(410): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagacttggtccaggccgggggggtccctgagactctcctgtgcagcctctggattcacctttcctggttggcacatgagctggggtccgccaggctccgaggggaacgggctgggagtgggtgccagcatagacaaagntaggaaaactaaaattatgtacgactctgtggagggcatcactatctcaganaacaacgaccaagtactcgatttgttactaanaaatnaacagacctaaagacgaccgaggacacggtcttagtttactttctagtaccgaactacgttcctactaccgggaacggggggccaacgggtaccgtcggtaccgaccggttctcgttcgaccg

SEQ ID NO: 96596 - DNA, 228 bp, Homo sapiens
  misc_feature: GYAE6OF02F3VG3.43.38.D05.1.454.CMB.1.raw
  modified_base (221)..(228): a, c, t, g, unknown or other
  misc_feature (221)..(228): n is a, c, g, or t
tcagtgtgagtagtcacgaccggtgctcgatttagtatctgatagttgggtttgggggccagggaaccctggtcaccgtctcttcagcctccaccaagggcccatcggtcttcccctggcgccctgctccaggagcacctccgagagcacagcggccctgggctgcctggtcaaggactacttccactactcacactgagcgggctggcaaggcgcatagnnnnnnnn

SEQ ID NO: 96597 - DNA, 642 bp, Homo sapiens
  misc_feature: GYAE6OF02G96FB.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagacttggtccgaggcccggggggggtccctggagactctccgtgtgcagcctctggacttctacctttccgtggttggcacagtgagcgtggggtcccgccgaggcctaccggaaggggaacggggccgtggggaggttggggtcggcccgaaggcaagtaacgaaacgaaaaggagtaaggaaaaaactaaaaagtttagtaggtaggaacttcgtaggtaggacggggacctattccaacttactctaccgaagaacgaaccaaaccgcaaagttacttctatttacgtttaccaataaatacgaacacgaacctaaggacgaccgaaggaccacggtcttagtttattcgtagtacaactcgtcctacgacggggaaccggggacaacgggtacctcggtacctcgtctcgttcaccg

SEQ ID NO: 96598 - DNA, 563 bp, Homo sapiens
  misc_feature: GYAE6OF02GV6WI.43.38.D05.1.454.CMB.1.raw
  modified_base (284)..(284): a, c, t, g, unknown or other
  misc_feature (284)..(284): n is a, c, g, or t
  modified_base (308)..(308): a, c, t, g, unknown or other
  misc_feature (308)..(308): n is a, c, g, or t
  modified_base (371)..(371): a, c, t, g, unknown or other
  misc_feature (371)..(371): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagacttggtccaggccgggggggtccctgagactctcctgtgcagcctctggattcacctttccnggttggcacatgagctggggtccnccaggctccgagggaagggctggagtgggtggccagcatagacaaagatggaaaacaaaattngtagactctgtgaggggctatcactatctccagagacaacgcaagtattcatttgtttcaactaaatcgaacagaccctaaagacgaccgaggacacggctagtttattctagtacgaactagtccctacgtacggaaccggggggggccaaggggaacccgtgggtaccgtacccggtctccgtctacccg

SEQ ID NO: 96599 - DNA, 545 bp, Homo sapiens
  misc_feature: GYAE6OF02H0KKE.43.38.D05.1.454.CMB.1.raw
  modified_base (224)..(224): a, c, t, g, unknown or other
  misc_feature (224)..(224): n is a, c, g, or t
  modified_base (286)..(286): a, c, t, g, unknown or other
  misc_feature (286)..(286): n is a, c, g, or t
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
tcagtgtgagtagtcacgaccggtgctcgatttagtatctgatagttgggtttggggaggtctcagagtaggagccttagccctggactcccaaggcctttaccacttggtgatcagcactgagcacagaggactcaccatggaattggggctgagctgggttttccttgttgctattttagaaggtgtccagtgtgaggtgcagctggtggagtctggggganacttggtccaggccgggggggtccctgagactctcctgtgcagcctctggattcactttccnggttggcacatgagctgggtccacgaggctccgagggaacgggctggacgtgggtagccagcatagacaaagntaggaaacaaaattnagtgactctgtgacggggccattcactatctccagacgacaacgcaagtatcattgttcacaaatgaacagacctaagacgcgagacagctgtttattcacgtagaactgtctacgtcggaacggggggtccacgggtaccctgggtccaccggttctacgttcgaaccgg

SEQ ID NO: 96600 - DNA, 885 bp, Homo sapiens
  misc_feature: GYAE6OF02I3SNV.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagagactcaccatggaattgggctgagctggtttccttgttgctatttagaaggtgtccagtgtgaggtgcagctggtggagtcgtgggggagtacttggtccgaggcccgggggggtccctggacgacctctccgtgtcgcagcctctggattccacctttcctggttggcacatgagcgtgggtccgccgaggcctcgaaggggaacgggctagggaggtgggtcggccgagcgaagtacgaacgaaaagagtaacggaaaaactaaaaagttacgtaggttaacggacgttacgtagggtagggaacgggggtaccctaagtttacccgtaaaccgtttaaactccccgtaaccctaaagggaaccggtaaaccgtaaacccggtaacccgtaaaacggtttaacgtttacccgttaaagttttttaacccgggtttttaacctaaaaaccgttaaaaacgtttaaccggaaaaccgtaaaccgtaacccggtttaaaaacgggaaccgggtaaccccgggtaaagggtaaaccccgtaaaccgggttaaccgttttacggttttttaaacgttttacccgtttaaacgggtttaaaccgtaaaaacctaccgttttaacccccggttaaccggttaaacccggggggtaaaacccgggggggggtaccccgtaaacccgggggttaaacccccgttagggggttaacccccgtaaccccgggtttacccggtttacccgttacccgtaaaccccggg

SEQ ID NO: 96601 - DNA, 673 bp, Homo sapiens
  misc_feature: GYAE6OF02HE53D.43.38.D05.1.454.CMB.1.raw
  modified_base (479)..(479): a, c, t, g, unknown or other
  misc_feature (479)..(479): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaatgggctgagctgggtttccttgttgctatttagaggtgtcagtgtgaggtgcagctggtggagtcgtgggggagtacgttggtccgaggtcccgggggggtccctaggacgacgttccgtccgtggtcgccgtacgccgttgtggtactttcctaccgttttccgtgggtttggacctacgagtgacgtccggtcgggtcccgccgaggcctccgaaggggaggggtctgggaggttcgggcgggcccgagccgaagtacgaacgaaagtagtaggaaaaactaaaattgagtacggacttcgtggtacgggacggggtcctagttacgacgtttanccgttaccaggaagaaccgaacgaccgtaaagtagtactagtttagttactaacaaatcgaacacgtacctaaagccggaccgaagtacgacgttcgttattaacgttcgtagtaccgaatcctaccgcgttacgggaaccgggggtcccaacgggtacccggtacgtcccgtaaccgtccttacgtcgtaccg

SEQ ID NO: 96602 - DNA, 589 bp, Homo sapiens
  misc_feature: GYAE6OF02HBAC8.43.38.D05.1.454.CMB.1.raw
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctgggtggagtcgtgggggagacttggtccgaggccgggggggtccctgagactctcctgtgcagcctctggattcaccttttcctggttcggcacatgagcgtggggtccgccaggctccgaggggaagggctggagtgggtgccagcatagacaaagntaggaaaacaaaattnagtagactctgtggagggctatcactatctcagacgacaacgaccaagtacttacatttgtttactaactaaatagaacagtacctaaggacgacgaaggactacgtcgttagttttattcgtagtaacgtaaactactccgttacgtacgggaaccgggggggtacctaacgggtaacccgttgggacctaccggtccttcgtcgtaccg

SEQ ID NO: 96603 - DNA, 814 bp, Homo sapiens
  misc_feature: GYAE6OF02I41QO.43.38.D05.1.454.CMB.1.raw
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagacttggtccaggcccgggggggtccctgagactctcctgtgcagcctctggattcacctttcgtggttcggcacntgagtcgtgggtcccnccgaggctccgaggggaagggctgggagtgggtggccgaggcagtaggaacaaaggagtagggaaaaacctaaaaagttagtaggtaggtaaccttcgtagggtacggacgggggtaccgtagtttaccgaacgttaacttccgttaacccgaaggtaacgtaaaccgaaaccgtacccgtaaaagttaccgtttacgtaacgtttttacggttttaccttaaacgttaaaacgtttacggaaaccgtaaccgtaacccgttaaaaggaccgggtacccggtaaacgggaacccgtaaccggggttccgtttaacggtttttaaacgtttaccgtttaaccgggtaaaccgtaaaaccgtaaccgttcccgtttaaccggtaacccgggggtaaacccggggggggggtacccctaaacggggggtaacccccgttacccggggttaacccgtaacccccggggttaccttttacccggttacccggttaaacccccgggg

SEQ ID NO: 96604 - DNA, 842 bp, Homo sapiens
  misc_feature: GYAE6OF02IC6WF.43.38.D05.1.454.CMB.1.raw
  modified_base (225)..(225): a, c, t, g, unknown or other
  misc_feature (225)..(225): n is a, c, g, or t
tcagtgtgagtagtcacgaccggtgctcgatttagtatctgatagttgggtttggggagtctcgagagaggagccttagccctggactccaaggccctttccacttggtgatcagcactgagcacagaggactcaccatggaagttggggctgagcgtgggttttccttgttgcttattttagaaggtgtccgagtgtgaggtgcagctggtgagtcgtgggganacgttggtaccgaggccggggggtcctacggagacttcgtccgtcgtgcgacgtcctcgttaggacttaccgtacccctttaccgttcgggttacggacctaacacgtgtaagtcgtacgggttccgaccgacggccgtccgaacgggaaggggtccgtaggtaggtgggtcggacgacgacgtagtaacgacaaaacggtaagtacggaaaaactaaaaaagtttaacgtaggtacggtacgttacgtggtaggacggggtcccggtacttacgtacgtaacgtaccgttaaccgtagaaacggaaaccgtaaacggtaaccctaaaacggttaactttaaccttaaacgttttacgtttaaccgtttaagtaaaaacgttaagtaaaaccgacggttaaaccgtaaaacggacgaacccgggtaaacgaacccgggttaaccgtaccggtttagttttaacgttttacgttaaccggttaccgtaaaaacggtaccgtaaaccgttaccggtaaacccgggaaccgggggggttaaccccggtaaccggggtaaccccggttacgggtacccgttaaacccccggtcgttacccccggttacgttaacccccggg

SEQ ID NO: 96605 - DNA, 726 bp, Homo sapiens
  misc_feature: GYAE6OF02GO0N5.43.38.D05.1.454.CMB.1.raw
  modified_base (215)..(215): a, c, t, g, unknown or other
  misc_feature (215)..(215): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattgggctgagcgtggtttctgtgctatttagaaggtgtcagtgtgaggtgcagctggtggagtcgtggggganacgttggtccgaggccgggggggtccctggacgactctcctgtgcagtcctcgtggtattcctacccttttccgtggttcggcacatgagcgtcgggtcccgccgaggctccggaaggggacgggctgggagtgggtcggccagcgagtagaacgaaagagtaaggaaaaaactaaaagttagtaggtcgaacgttcgtaggtcgggaacggggtcctaattaccgacttataccgtacgaacggtaacgaaccgtaaaccgaacccgtaaagttacttacttaagtttcgttttaacaaaccttaaagtacgaaacacggtaacctaaaggaccggtaccggaacggaaccggtaacggttcgtttaacggttttaactttaccgtacgttaaccgaaaccttacgtacccggttacggtacccggggaacgggggggtaacccgtacggggttaaccccgttcgggtaaccccgttaacccggttcccgttaccgtcccgtaaccccgg

SEQ ID NO: 96606 - DNA, 683 bp, Homo sapiens
  misc_feature: GYAE6OF02JWNCZ.43.38.D05.1.454.CMB.1.raw
  modified_base (218)..(218): a, c, t, g, unknown or other
  misc_feature (218)..(218): n is a, c, g, or t
  modified_base (297)..(297): a, c, t, g, unknown or other
  misc_feature (297)..(297): n is a, c, g, or t
  modified_base (601)..(601): a, c, t, g, unknown or other
  misc_feature (601)..(601): n is a, c, g, or t
tcagtgtgagtagtcacgaccggtgctcgatttagtatctgatagttggggtttggggaggtctcagagaggagccttagccctggactccaaggcctttccacttggtgatcagcactgagcacagaggactcaccatggattgggctgagctgggtttccttgtgctattttagaggtgtccagtgtgaggtgcagctggtggagtcgtggggganacgttggtccaggccggggggtcctgagacctctccgtgtcgcagtcctcgtggacttctaccttctggttggcacgangagtcgtcggtccgccgaggcctaccggaggggaagggtctgggaggtgggtcgccgagtcaacgtagaccgaaagtcgtaacggaaaactaaaagttctaggtacgacgttacgtggtaggggaacgggtctatttaccgaacttacgtccttaccgaaggtaacgaccgaaccgtacgtaaagttacttaccaggttttcttaaccgtaacgtaaacgtacgaaactaaccggtaaactaaccggtacgggtaccgtaaaacgggacctaacgggttacttaacggtttttataccggttanaaccggtaactacgtccgtaacgttacgggggaccggggtacgtacgggacctggtcccgaacggttcctcgtacgtaccgg

SEQ ID NO: 96607 - DNA, 817 bp, Homo sapiens
  misc_feature: GYAE6OF02JTQOM.43.38.D05.1.454.CMB.1.raw
  modified_base (519)..(519): a, c, t, g, unknown or other
  misc_feature (519)..(519): n is a, c, g, or t
  modified_base (534)..(534): a, c, t, g, unknown or other
  misc_feature (534)..(534): n is a, c, g, or t
  modified_base (807)..(807): a, c, t, g, unknown or other
  misc_feature (807)..(807): n is a, c, g, or t
tcagtgtgagtagtcacgaccggtgctcgatttagtatctgatagttgggtttggggaggtctcagagagggacgccttacgcccgtggacctaccgaacggtcctttcctacgttggtgactcgacgcctactgagccacgaggacggtacctccacctagtaggtaaggttcggggctaggagtcggtttcgggttttccttggttcgtactttagttttaggaaggttcgtcctaggttggtggtacggtcgcgtaggtcgttagggtggtacgtcgggtagggggtactaccggttcggaccggacgggggtcccgggggtcctaggacgtaccttcgtccgtgtcgcgacgtccgtcgtgtacttccttaccgtttccgtgggtcgactactgtcggtacgtcggtccggtccgaccgacggtcccgtacgggacggggtacgggccgtagggtcggggtcgggtcgaccgagtacgaagtacgaaacgaaagtagtaaagaaaataagttcgnggtacgtacttaggnggtacgggccgggcttacgtacgtactacgttaccacgaaacgtacgaaaccgtacctaacgttacttaacgttcttaaacggttttctaaacgttaaaaccgaagtaccgtaacgaaccggttaacttaaacggccgggttaacggaccggtaacgttacgttcgtttttaaacgtacgtttacgaacgttaaccgtacttccgtcgggtaaacggtcgggggaacccgggtacgtaaccggttacggccttacccggtactccggttaccnccggtacccg

SEQ ID NO: 96608 - DNA, 646 bp, Homo sapiens
  misc_feature: GYAE6OF02IXDVJ.43.38.D05.1.454.CMB.1.raw
tcagtgtgagtagtcacgaccggtgctcgatttagtatctgatagttgggtttgggggaggtctcagagaggagccttagccctggactccaaggccctttccacttggtgatcagcactgagcacagaggactcaccatggaattggggctgagctgggttttccttgttgctattttagaaggtgtccagtgtgaggtgcagctggtggagtcgtgggggagacttgggtccaggcccgggggggtccctgacgactctcctgtgcacgcctctggattcctaccgtttcgtggttggccacatgaggtcgtcggggtccgccgaggccgtccggaggggagggcgtgggaggtgggtcggcgaggcagtagaacgaaagagtaggaaaactaaaattagtagtagactgtggtaggagggtacctattctactatcctacgagacgaccaaacgccaaagtcttctagtttagtttactaacaattacgaacacgtacctaagacgaccgagaaccgaccgtactttacggttttacttcgtaacgtaaccgtaaactccgttcccttacggtaccggggaaccggggggtacccgaaccggggtaccctcgggtacccgtaccgttacgtccgtaccgtccg

SEQ ID NO: 96609 - DNA, 806 bp, Homo sapiens
  misc_feature: GYAE6OF02IHCEJ.43.38.D05.1.454.CMB.1.raw
  modified_base (399)..(399): a, c, t, g, unknown or other
  misc_feature (399)..(399): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcgtgggttttccttgttgctattttagaaggtgtccagtgtgaggtgcagctggtggagttcgtgggggagtacgttggtccgagggcccgggggggtccctggagaccgtctccgtgtgcacgcctcgtggacttcctacctttccgtcggttcggctacatggacgtcgtcggggtaccgccgtacggccgtacggaaggggaacggggtcgtagggaggtggggtcgccgaagactaagtaanaacgaaagagtaacggaaaaaacgtaaaaagtttagtaggttacggtacctacgttagggtaacgggtacggggtacctacggtttaccaaccgtttactccgtaacccgaaggaactaaccggaaacccgtaaccgtaaacggttactttaaccgttaattttaccggttttaacctaaaaccgttaaaacgttagtaaaacccggagttaacccgtaaaggaacggttacccggaaggaaccgtaccgggtcttttaaggttttaacttacgttaacggtaaccgtaaactttacctcccggtttccggtaaaccggggaaccccgggggggtacccgtaaccgggttaaccccggtccgggttaaacccgttaccccggtttcttacccgtttcctaaccccgg

SEQ ID NO: 96610 - DNA, 712 bp, Homo sapiens
  misc_feature: GYAE6OF02H7EUM.43.38.D05.1.454.CMB.1.raw
  modified_base (278)..(278): a, c, t, g, unknown or other
  misc_feature (278)..(278): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtgggagtcgtgggggagacttgggtcccgaggcccggggggggtccctggacgactcctcctgtgcagcctntggattcctacctttcctggttggcacatgagcgtgggtcccgccgaggcctccggaggggaaggggctgggaggtgggtcggccagcagtagaacaaagataggaaaactaaaaattgtagtaggactcgtggtaggacggggcctattcacttactctccaaggaacgaaccgaaccgacccgtaaagttacttactaacgttttagtttacctaaactaaagttacgaaaccgtacgtaacccgttaaaggaccggacccggtaaagggacccgtaccggttcctttaggttttaacttttaccgtaagttaaccgtaaacctcgttaacccgttaccggtaaccggggtaaacccggggggggccctaaccggggtaacccgttaccgggtcccgtaacccggtttccttacccgttaccgtaaccccgg

SEQ ID NO: 96611 - DNA, 637 bp, Homo sapiens
  misc_feature: GYAE6OF02HGD0W.43.38.D05.1.454.CMB.1.raw
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagacttggtccagccgggggggtccctgagactctcctgtgcagccctctggattcgacccttttcctggttggcacatgagctgggtccgccaggctccagggaaggggctgggagtgggtggccagcatagacaaagntaggaaaacaaaattanggtaggactcgtgttaggaggggccgtattacactactctccagtagacaacgccaaagtacttacatttcgtttactaacaaacttcgaactagacctaaggacgtacccggagggaaccacgggtccttaggttttaactttcgtaggttaccgaaaactacgttacccttacgtacccgggtaaaccggggggggccctaaacgggggtaaccccgttacgggtacccgtacccgttaccgttaccgttctaacccgg

SEQ ID NO: 96612 - DNA, 796 bp, Homo sapiens
  misc_feature: GYAE6OF02JI4GE.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggtttccttgttgctatttagaaggtgtcctagtgtgaggtgcagctggtggagtcgtgggggagacttgggtccgacggtcccggggggggtacccctgggagtaccgtccgttcccgtagtcggcacggtcctcgtcggtactttccgtacccgttttcccttgggttcgggtacctaccgaagtcggacggtccggttcggggtccccgacccgacgggtccgtacccggagggggtaacggggccgtggggacggtggggtcggaccgacggacgagtacgaacgaaaaggagtaacggaaaaactaaaagttactaggtacggtaacttcgaggtacgggtaacgggcgtaacgttacgtaacgttactccgtaacgacggtaacgaactaacgaccgtaaacggtcttaactactttacgtttacaactaaagttacaagtaacgaccgttaagaacgtaccggaggaaccgtcgttacgttagttttaacgtaccgttacggttaaaccgaaacttacccgttacccgtacggtaaccgggggtaaacccgggggggtacccgtaaccggggtaaccccggttaaacgggttccccgtaacccgggtcccggtttaccctaccggtaccccgg

SEQ ID NO: 96613 - DNA, 603 bp, Homo sapiens
  misc_feature: GYAE6OF02GMVQ0.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagacgttggtccaggccgggggggtccctggagactctcctgtgcagcctctggattcaccttttcctggttggcacatgagctggggtcccgccaggcctccgaggggaaggggctgggagtggggtggccagcatacgaacaaagataggaaaacaaaaattataggtaggtactcgtggtggacgggggcctagttcactatctccagagacaacgaccaagtattctatttgtttactaacaaatgaacagacctaaggacgaccgaaggacgacggacttgtttattcgtagtacgaactacgtacctacgtaccgggaaccgggggggtaccacggggtaacccgtcgggtaccgtacccggtcttcgttacaccgg

SEQ ID NO: 96614 - DNA, 635 bp, Homo sapiens
  misc_feature: GYAE6OF02GUYUT.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggtttccttgttgctattttagaggtgtccagtgtgaggtgcagctggtggagtcgtgggggagacttggtccaggcccgggggggtccctggagacctctccgtgtgcagcctctggattcacctttcctggttggcacatgagcgtgggtccgcaggcctccgaggggaaggggctgggagtgggtcggccagcatagaacaaagataggaaaactaaaatgtagtaggactcgtggtggacggggccattcactatctcgagacgaccaacgaccaagtacttactatttcgtttactaactaaagtacgaaacagtacctaaagacgtaccggaacggaaccgtaccggtctttaggttttactttacgttagtaaccgaactacgtcccttacgtaccggggaaccgggggggacctaaccggggtaacccgttacgggtaccgtacccggttaccgttccgttacgtacccgg

SEQ ID NO: 96615 - DNA, 911 bp, Homo sapiens
  misc_feature: GYAE6OF02IOQJF.43.38.D05.1.454.CMB.1.raw
tcagtgtgagtagtcacgaccggtgctcgatttagtatctgatagttgggtttggggaggtctcagagaggagccttagccctggactccaaggtcctttccacttggtgatcagcactgagcacagaggactcaccatggaagttgggctgagtcgttgggttttccttgttgtcttagttttagaggtgtccgtaggtgtgaggtgcagtcgtgggtggtacggttcggtagggggacgtacgttcgggtccgacggggtcccggggggtcctaggacgtaccgttccgtccgtggtcgcgacgtccgtcgtcggtacttaccgggggggggggggggggggggggggggggggttaccctttccggttcggttcggtacgtacgtagtaggtacggtccggttccgggtcccggtaccgtacggtaccggtaccgggaacggggtacggggtacgggtacggggtacggggttcggggtcgggtccggtacggtacgtaacgtaacggaaacgaaacggaacggtaaacggtaaaaacgtaaaaacgttaagttacggtacggtaacgttacgtacggtacgggtaacgggtaccgtacgttacgtacgttacgtaccgtacgtaacgaacgaaccgtaaccgtaaccgtaacgttaacgttacgttaacgtttacgtttaacttaaacttaaacgtaacgtaaacgtaacgtaaccgtaaacggtacgtaaccggtaacggtaaccgtaaccggttacgtttacgtttaacgtttacgttaacgttaaccgtaaacgtaacgtaacgtaaccgttaccgggtaaccggggtaaccggggggtaacccgggtaaccgggtaacccggtaccggttacccggtacccggttacccgttaccgttacccg

SEQ ID NO: 96616 - DNA, 828 bp, Homo sapiens
  misc_feature: GYAE6OF02IUSJ2.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttccttgttgctatttagaggtgtccagtgtgaggtgcagcgtggtggagtcgtgggggagtaccgttggtccgaggcccgggggggtccctggacgtaccttcctccgtggtcgccaggtccctcgtgggactttccgtacccttttccgtgggtttcggcactagtgacgcgtcgggtccgccgacggcctaccggaggggaacgggctagggaggtcgggtcgccagtcgataacggacaaaaggagtaaggaaaaactaaaagttgtaggtacgtaactcgttaggacggacggggtacgtattacacgttatacctaccgaagtacgaactaaccgaccgtaaagtactttaccgtaagttttcgtttaaacctaacgtaaaaagttccggaaaaccttacggtaaacccgtaaaacgtaccgggaacccgtaacgggtaacgtaacggtttcccgggtaacgttttttaagtttttaaaccgttttccgtaacgggtttaaaaacccgtaaaacgtttacccgttaaccccgtttaccggggttaaaccccggggggaaaacccgggggggttccccgttaaaaaccggggtaaccccccgggtttttacggggaccccgtttaaccccccggtttacggtttacccccgttttaaacccgg

SEQ ID NO: 96617 - DNA, 735 bp, Homo sapiens
  misc_feature: GYAE6OF02FX7YW.43.38.D05.1.454.CMB.1.raw
  modified_base (187)..(187): a, c, t, g, unknown or other
  misc_feature (187)..(187): n is a, c, g, or t
  modified_base (222)..(222): a, c, t, g, unknown or other
  misc_feature (222)..(222): n is a, c, g, or t
  modified_base (293)..(293): a, c, t, g, unknown or other
  misc_feature (293)..(293): n is a, c, g, or t
  modified_base (429)..(429): a, c, t, g, unknown or other
  misc_feature (429)..(429): n is a, c, g, or t
  modified_base (512)..(512): a, c, t, g, unknown or other
  misc_feature (512)..(512): n is a, c, g, or t
tcagtgtgagtagtcacgaccggtgctcgatttagtatctgatagttgggtttggggaggtctcagagaggagccttagcccttggactccaaggcctttccacttggtgatcagcactgagcacaagaggactcaccatggaattggggctgagcgtaggtttcctgttaggctatttagaaggtntcagtgtgaggtgcagctggtggagtctggggganacgttcggtccaggcccgggggggtcctgaggactctcctgtcgcgacgcctctggacttcacctttccgnggttcgctacagtgacgtcgtcggtcccgcgaggtccgtcgaacggggacggggtcgtgggtaaggtcggggtgacccgtagcgaacgtagaacgaacgtacgtagaaaaactaaaacttagtacgtggaaccgtntacgggttagacggggcccgtaagtttacgacgtagtcccggtccaacggacggaaaccaaccggtactaaacggtacctttntaacgtttacgtttactaaacctaaagttacgaactacgtaacccaaggtaaccggaccggaacgggacctaacgggtccttaaggtttttaccttagtacgttaaccgtaaccgacgttacccgtacgttaaccgggggttaaacccgggggggtcctaaaccgggggtaacccctgggttaaccccggttacccggtacccggtttcgtaaccgttcccgg

SEQ ID NO: 96618 - DNA, 845 bp, Homo sapiens
  misc_feature: GYAE6OF02JVZVO.43.38.D05.1.454.CMB.1.raw
  modified_base (349)..(349): a, c, t, g, unknown or other
  misc_feature (349)..(349): n is a, c, g, or t
tcagtgtgagtagtcacgaccggtgctcgatttagtatctgatagttgggtttggggtaggtctcagagaggagccttagccctggactccaaggcctttcctacttggtgatcagcactgagcacagaggactcaccatggaattggggctgagctgggtttccttgttgctatttagaaggtgtccagtgtgaggtgcagcgtggtggagtcgtgggggtacgacgttcggtccgagggtccgggggggtccctggacgtactcctccgtgtcgcacgtcctcgtggtacttccgtacctttccgtgggttaggcctaccgtaatcgacggtccgtcggggtccccncgtacggccgttccggaaggggtaacgggcgtggggaacgttcgggggtcgtaccgagccgtaagtacgaacctaaaaggacgtaaggtaaaaaacctaaaaagtttaggtcgggtaggtaaccttacgtaggggtacggtacgggggtactaacgtttaccaaccgttacgtacctcccggtaaggtaaaccggaacgtaaaccgtaaccgtaaggtttaacctacggtattttacgggttaaacctaagtaaaccgtaggtaaaaccctacgggttaaccttaaaccgggaaccgtaccgggaaacgggtaccgtaaccgggttaacctttacggttttaaccgttttacgaaccgttaaccggtaaacttaccgttaacccggttacggtaacccgggggttaaaccgggggggaccccgttaaacgggggtaaccccgtttcggggttacccgtaaaccccggtttcggttaccccgttaaacgtccccggg

SEQ ID NO: 96619 - DNA, 787 bp, Homo sapiens
  misc_feature: GYAE6OF02FFQJY.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattgggctgagctggtttcctgttgcttattttagaaggtgtccagtgtgaggtgcagctggtcggagtcgtgggggacgtacgttggtcccgacgggcccggggggggttcccctaggacggtacctcgtcccgtggtcgcacgccctcgtggtacttcctacccttttccgtgggtttcggactacgagttgacggtccgtcgggttcccgaccgtaagggtcctacccggaagggggaacggggtccgtagggagggttacggggtcggccccgaaggccgtaagtacggaaaccgaaacgaagtaaacgggaaaaaacctaaaaagtttacgtacggtacggtaaccttacgttacggtacgggtacgggggtaccgtaacgtttaccgaactacgttaccgtaccgaaggaacggaaccaaccggtaccaaaggttactttactaacgtttcgttttaacctaaacgtaaatacgaaaccgtacgaacccgtaaagacgacccggaaggaccgtacggtcttagttttacttcgtacgtaacgaaccgtacttacccgacggtaaccggggaacccggggggtacctaaccggggaacccttccgggtacccgtacccgttccgttccgtacgtaaccccg

SEQ ID NO: 96620 - DNA, 1027 bp, Homo sapiens
  misc_feature: GYAE6OF02HXB9R.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattgggctgagctgggtttcctgttgctattttagaaggtgtccagtgtgaggtgcagctggtggagtcgtggggagacgttggtccgaggccgggggggtccctggacgacgtctccgtgtgcgagtcctcgtaggacttaccgtacctttcccgtgggttcggtccgaactagtggtaacggccgttcggggttcccggacccgtaacgggtccgtacccggaagggggtaaacgggggtcccgttaaggggtaacgggtcggggggttacggaccccggtacggaaccgtaagtaaacggaaccgtaaaaaggtaacgtaagggaaaaaacctaaaaaagttacgtaaggttcgtaaccttacggtaggtacgggtaacgggggaccggttaaacgttaccgttaacgttaaccgttaccgtttaacccggaaacgggttaaaccgaaaccggtaaaacccgggtaaacccgttaaacgggtttaaaaccgtttaacgttaaacccggtttttagttttaaaccccgttaaaaacggtaaaaaacctttacggaaaaaacccggtacggttaaaaacccccggtttaaaaggaaacccggggtaaaacccggggtaaaaccccgggtaaaccgggttaaaccccgggttaacccgtttttaaacggggttttttaaccccttttaacggggtttaaacccgtaaaaaccgggttaaaacccgttaaacccgttttaaccccggttaacccgggtaccggggggttaaaacccccgggggggggtaaccgtaaaccccggggttaacccccgggttacccggggttacccgttaaaccccccgggttttacggttacccccgtttaacccggtaaacccccggg

SEQ ID NO: 96621 - DNA, 828 bp, Homo sapiens
  misc_feature: GYAE6OF02HA8E4.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattgggctgagtcttggttttccttgttgtcttatttagaaggtgtccaggtgtgaggtgcagcgtggtggagttcggtgggggaagtacgttcgggtccgacggggtccccggggggggttccctaggacgtaccgttccgttccgttaggtcggccaccggtcccttcgtaggtacttccgttaacccgttttccgttggggttacggacctaacgtacgttacggacggtccggttccgggtccccgaccgtaacgggtcctaccgggaagggggaacgggtcgttagggacgggttgggtccggacaaggctaagtaacgaaacgaaagtaagtaaaggaaaaaacttaaaaagtttacgtaggtacgtaacgtcgtagggtacggacgggacgtacttcgaacttcgtaccgtaacgtacgaaacgaacgtaaccgaccttaaagtaccttacgttaagttttaccgttaacctaaagtaaaactcgtaaaaccgtaccggtaaccgtaaacggacccggtaccgaaaggtaacccgtaggttaccgtttagtttaaccgtttacgtaacgtaaccgtaacgtacccgttaaccggtaccggtaacgggggtaacccggggtaccgtaaccgggtaacccgttcggtacccgacccggttactttaccggtaccctaccggg

SEQ ID NO: 96622 - DNA, 849 bp, Homo sapiens
  misc_feature: GYAE6OF02GUQOF.43.38.D05.1.454.CMB.1.raw
  modified_base (291)..(291): a, c, t, g, unknown or other
  misc_feature (291)..(291): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcgtgggttttcctgttgtcttatttagaggtgtcagtgtgaggtgcagcgtggtggaggtcggtgggggactacgttggtccgacgggtccccgggggggtccctggagacctccgttccgtgtcgcacgcccttagnggtacttccgtaccttttcgtgggttacggctactagtggacgccggttcggggtacccgccgtaccggtccgtaccggaagggggaacggggtcggtaggggtaggtcggggtacgggtccgaacggtcgaagtacggaaacgaaaaggtaagtaacgggaaaaaactaaaacgttagtacggtacggtaactacgtgggtaccgggacgggtaccgtacgttcgaacgtacgtaccgtacggtaacgaacgtaacgtaaaccgtaaccgtaaagttacttacgttaagttttaccgttaactaaaccgttaaagaaccgttaacgaacgtaacctaaagggtacccggaaccggaaacgggtacccgtacggttacgttttacgttttaacttaccgggttaagtttaacccgggaaactttaccggttacccggttaaccgggtaacccggggggaaaccgggggggttaaccccgtaaaccggggggttaaaccccggttaccgggtcccgggtttaacccgttacccgttttacccggtccggtaacccccgg

SEQ ID NO: 96623 - DNA, 754 bp, Homo sapiens
  misc_feature: GYAE6OF02IU5Z1.43.38.D05.1.454.CMB.1.raw
  modified_base (184)..(184): a, c, t, g, unknown or other
  misc_feature (184)..(184): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcacatggaagttggggctgagcgttggttttcttgttgcttatttagaggtntccagtgtgaggtgcagctggtggagtcgtggggatcgttcggtccgacgggcccgggggtcctggacgacctcgtccgtgtcgccacgtcctcgtggtactttcctacccgttttccgtggttcggaccacgtagtcggacgtcggtcgggtcccgccgtacggtccgtaccggaagggggtacggggcggttacggggtaggttcggggtacggacccgtaggacgtaagaaaccggaaacgaaaaaggtaacgttaaaaggaaaaaaaccttaaaaagtttacgtaggtacggtaaccttacggttagggtaacgggaacggggtctaactttaccgtaacgtaacctccgtaacgaggaaaccaccgaaacgtacctaaaggttacttacgtagttttagttaccaaataaacgtacgaaaccgtaaggtaacctaaagggaccgtacccgaaaggtacccgtagttaccgttttagtttacgttactaacgtaactaactacgtacccgtcgaacggggaccgggactaccgggacctcggtaacctccgtacttcgtaccaccg

SEQ ID NO: 96624 - DNA, 880 bp, Homo sapiens
  misc_feature: GYAE6OF02HOHSM.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaagttggggctgagtcgttgggtttttccttgttgtcttagttttaggaaggttcgtaccgaggttgtggaggttcgcgagtcgttgggtaggtacggttcggtagggggactacgtttacgggtacccgtacggggtcccggggggggtaccctaggacggtaccttccgttccgttcggtacgcgaaccggtcccttcgtacgggtaccttaccgtaaccccgtttttccggtagggttcgtaccgtacgtagttacggacgtcggtccgggtcccgaccgtacggtaccgtaccggaggggggtacgggtccgtagggtaggggttacgggttccggccgtagacgtacgtaaacggaaccgtaaaggaacgtaaacggtaaaaacctaaaagttacggtacggttaacgggtacccttaggtagggtacgggtacggggtacccttagttacccgtaacgttactacccgttacgaaggtaaccgaaacgtaacccgtacgttaaacgtcctttaacgttagttttacccggtttaactaaaccgtaacgtaaccggtaacctaacgggtaaccgtaaaaggtcccggaaacgggtaaccgacgggttaaaccgtcttttaacgttaaccgttactacggtaacctaacgttcctaaccggtccggtacggggaaacccggggtctaaacccggtccggtacggtaccgttacccgtacgacttaccggtaacccg

SEQ ID NO: 96625 - DNA, 808 bp, Homo sapiens
  misc_feature: GYAE6OF02FVR6L.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctggagcgttgggttttccttgttgcttatttagaaggtgtacagtgtgaggtgcagctggtggagtcgtgggggagtacgttcggtccgacggggtcccgggggggtcctcggaagtcctctccgtgtacgcacgtcctcgtggtacttccgtaacccttttccggtgggttcggaccacgtactacggacggttcggtcgggggtacccgccgaggggtaccctaccgggaaggggggtaacgggtccggtaggggaggggttcgggtacggccgacgtactaagtaaacgaaacgtaaagaacgtaaaggaaaaaactaaagtttaaggtaggtacggtaactcggttaggtacggggtaaccgggtctaagtacctaacgtacctacgtaccgaagtacgaaaccgtaacgaacgtaaacgttacttaacttagtttacctttaacaaacgtaacgtaataaacggtaacaaccgtaacggtaccgaaccggggtaaacgtacggtacgttaaccgttttagtttaccgttaccgttaaagtaaccgtaaacttccgtaccgttaccggggtaccggggtaacccggggggaaccggttaccgggaaccccgggttcgtacccggtacctttacccggacccgttacgtaacccgg

SEQ ID NO: 96626 - DNA, 744 bp, Homo sapiens
  misc_feature: GYAE6OF02HAZP4.43.38.D05.1.454.CMB.1.raw
  modified_base (336)..(336): a, c, t, g, unknown or other
  misc_feature (336)..(336): n is a, c, g, or t
  modified_base (602)..(602): a, c, t, g, unknown or other
  misc_feature (602)..(602): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggttttcctgttgctattttagaaggtgtccagtgtgaggtgcagctggtggagtcgtgggggatacgttcggtaccgagggtcccgggggggtcctggacgacctcctccgtgtcgcacgtcctcgtaggtacttcctaccttttccgtggttcggcacatggagtccgtcggggtccnccgaggccgtaccgaaggggacgggctgggagtgggcgccgagcagtagaacaaagagtaaggaaaaactaaaattacgtggttacgaacttcgtagggtacgggacgggtcctattaccgaacgttactcccgtacgaagaaccggtaaaccaaaccggtacctaaaggttattccgtaaagttttcggtttaaacctaaacgtaaacttacggaaaccgtacgaaccgtaaagccggtaacccggaaggtaacccgtaccggtnttttaaacgtttaacgtttccgtaagttaaccggaacttcgttccccgtaacggaaccgggggggtaacccggggggaccttaacggggtaacccccgttggtaccccttaacccgggttctttaccgtaaccgtaccccgg

SEQ ID NO: 96627 - DNA, 718 bp, Homo sapiens
  misc_feature: GYAE6OF02IHHK4.43.38.D05.1.454.CMB.1.raw
  modified_base (189)..(189): a, c, t, g, unknown or other
  misc_feature (189)..(189): n is a, c, g, or t
  modified_base (226)..(226): a, c, t, g, unknown or other
  misc_feature (226)..(226): n is a, c, g, or t
  modified_base (405)..(405): a, c, t, g, unknown or other
  misc_feature (405)..(405): n is a, c, g, or t
  modified_base (594)..(594): a, c, t, g, unknown or other
  misc_feature (594)..(594): n is a, c, g, or t
tcagtgtgagtagtcacgaccggtgctcgatttagtatctgatagttgggtttggggaggtctcagagaggagccttagccctggactccaaggcctttccacttggtgattcagcactgagcacagaggactcaccatggaagttggggctgagtctgggtttttccttgttgcttattttagaggtntccagtgtgaggtcgcagctggtgaggtcgtgggganacttggccgagggcccggggggtaccctggacggacttccgtcctgtcgccaggcccttgtacgggtattcctacccgttttccgtgggttcggactacgattcgaggtccgtacgggtcccacggtacggcttacccgggaaggggacgggtcgtgggtacgggttggggtcggaccncgggtactaacggtacggaactaaaacggcgtaacgggtaaaaaactaaagtttcggacggttagggaacctcggttgtacgggacgggggtacctagtttaccgactagtcctaaccgaggtactaaccgacgcctaagttacttcgagttttacttaccgaaataacgtcgaaactcaccggtaaanccggaccgagaccgtacggtcttaggttttaactcgtaagttaccgaactttccttaacggaccgtacggggacggggttacacccggggttccctaggccccgtacctacgttccctagtccg

SEQ ID NO: 96628 - DNA, 1199 bp, Homo sapiens
  misc_feature: GYAE6OF02FNOJU.43.38.D05.1.454.CMB.1.raw
tcagtgtgagtagtcacgaccggtgctcgatttagtatctgatagttgggtttggggaggtctcagagaggagtccttagccctcggactccaaggtcctttccacttggtgatcagcactgagcacagacggactcaccatggaactttgggggctggagtcgttcggggttttttccttggtttggtcttaagtttttaaggaagggttagttccctaaggttcgttggtaacgggttgtccaggccgttggggttagggtaggttccggtaggggggacgtaacgttttcggggtacccgacggggtccccgggggggggttcccctgggtaacgtaccgttccgttcccgttggtcgtacgacggtcccttcgttacgggtacttttaccacccgttttttcccgtggggttttcggccctaaacgtacgttacggaaggttcccgtttacgggggttccccgacccggtaagggggtccctttacccgggaaaagggggggtaaacggggggttcccttagggggggtaacgggtttcgggggggtttaccgggaccccggtaaggtaccggttaaacgggttaaaccggtaaacccgggtaaaaaagggttaaccggttaaaacggggtaaaaaaaaacccgtttaaaaaaaacgttttaacggttaacggggttaaaccggggttaaacccgttttaccggtttaacggggttaccggggggaaaaccgggggggtaccccttaaaccggtttttaaccgttaaaacccgttaccggtttaaccccgttaacccggtaaaccgggtaaaccgggtaaaacccggtaaacccgggttaaacccggtaaaacgggtttaaccttttaacccggtttaacgtttttaacggttttttaacccgtaaaaaccgttaaaacgtttaaccgggaaaaccttaaacgggttaaaccccggttaaaagggtacccgggtaaacccggtaaacggggtaacccgggtaaaccgggttaccgtttttacggttttttaacgttttaaccgttaacggtttaaacccgtaaacggtaccgttttaccccggttaacccggttaaccgggggtaaccccgggggggggtaaccgttaacccgggggtaaccccggttttccggggttaacccgttaccccgggtttacctttacccggttaccg

SEQ ID NO: 96629 - DNA, 683 bp, Homo sapiens
  misc_feature: GYAE6OF02HYYVO.43.38.D05.1.454.CMB.1.raw
  modified_base (227)..(227): a, c, t, g, unknown or other
  misc_feature (227)..(227): n is a, c, g, or t
  modified_base (303)..(303): a, c, t, g, unknown or other
  misc_feature (303)..(303): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaatttggggctgagcttgggtttttccttgttgcttattttagaaggtgtccagtgtgaggtgcagcgtggtggagtcgtggggganacgttggtccgaggccgggggggtcctggacgactctccgtgtgcagcctgtggacttcacctttctggttgcacntgagcgtggtccgccgacggtctccggaaggggaacggggcgtgggacggtgggtcggccgagcaagtagaccgaaaagagtaaggaaaaactaaaaatttagaggttaggactcgttggtaggagggggacctagttcaacgtatccgtacgtaagaacgacaaaccgactaaacgttacttcgtaacgtttagtttactaaacgtaaatacgaaacgagaacctaaaggacggaccgaacggaccgacggttcttagtttaactttcgtaacgttaactaacgtacgttcccttaacggtaccgggaaccgggggggtacccgaacgggtaacccgttacgggttacccgaccccggttacttccggtaccgtaccgg

SEQ ID NO: 96630 - DNA, 879 bp, Homo sapiens
  misc_feature: GYAE6OF02FN401.43.38.D05.1.454.CMB.1.raw
tcagtgtgagtagtcacgaccggtgctcgatttagtatctgatagttgggtttggggaggtctcagagaggagccttagcccctggactccaaggcctttccacttggtgatcagcactgagcacagaggactccaccataggaagttggggctgagcgttgggttttccttgttgcttattttagaaggtgtccagtgtgaggtgcagtcgtgggtggagtcggtgggggagtacgttcggtcccgacgggcccgggggggtcccctggacgtacctccgtcctggtcgccacgtccctcgtcggtacttcctacccctttttccggttgggttacggcctacgtagtcggacgtccggttccgggggtccccggcccgtaacgggtcccgttacccgggggaaggggggtaaacggggtccggttagggggtacggggtgggggttccggaccgagtaccgtaagtaacggaaacgaaagtaagtaaaacggaaaaaactaaaaacgtttagtaacggtagggtaacctttcggtagggtacgggggaccggggtacgtacgttaccgtaacttacctaccgtaacccgaaggtaaccgaaaccgtaaacccgtaccgtaaacggttactttaccgttaagttttacttttaacttaaaccgaacgttaacgaaccgtacgtaaccgtaaacggtaccgaaccggtaacggaccgttaaccggttactttacgttttattaccgttaacgtaacccgtaaacgttcccgttaacccggttaccggaacccgggggtaaaccggggggtcccgtaaaccggggttacccgttaccgggtacccgttacccggtttccgttaccgttacccgtaccccg

SEQ ID NO: 96631 - DNA, 777 bp, Homo sapiens
  misc_feature: GYAE6OF02GSE0B.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattgggctgagcgtgggtttccttgtagcttatttagaggtgtccagtgtgaggtgcagctggtggagtcgtgggggagtacttggtccgaggtcccgggggggtaccctggacgtacctccgtcctgtcgacagcctcgtggacttccgtaccctttccgtgggttcggcaacattgagcgtagggtccccgacgaggtcctaccggaggggaacggggtccgtagggtcggtcggggttcggcccgtaagccgtaagttaacgaaccgaaagtacggtaaaggaaaaaccgtaaaaaagtttaggtaggtacgggtaacgttccgtaggtacggggtacggggaccttacgttaccgaaacgttacctccgtaaccgaagtaaaccgaacgtaaacccgactaaacggtttactcgttaaattttccggtttaaacctaactaagtactaaaccgtaccgtaccggtaaaggccggaccgggtaagtacccggaagtcgtttaaggttttccgttataacggttaaccgaaccgtaccgtcgttaccggttacccgggggaaacccgggggttaccaccgggttaaccccgtggtaacccccgtacggttacccgttccgtaccgtaaccccgg

SEQ ID NO: 96632 - DNA, 698 bp, Homo sapiens
  misc_feature: GYAE6OF02HY3N8.43.38.D05.1.454.CMB.1.raw
  modified_base (181)..(181): a, c, t, g, unknown or other
  misc_feature (181)..(181): n is a, c, g, or t
  modified_base (401)..(401): a, c, t, g, unknown or other
  misc_feature (401)..(401): n is a, c, g, or t
  modified_base (514)..(514): a, c, t, g, unknown or other
  misc_feature (514)..(514): n is a, c, g, or t
  modified_base (521)..(521): a, c, t, g, unknown or other
  misc_feature (521)..(521): n is a, c, g, or t
  modified_base (545)..(545): a, c, t, g, unknown or other
  misc_feature (545)..(545): n is a, c, g, or t
tcagtgtgagtagtcacgaccggtgctcgatttagtatctgatagttgggtttggggaggtctcagagaggagccttacgccctggacctccaaggcctttccacttggtgatcagcactgagcacagaggactcaccatgattgggctgagctgggtttcctgtgctattttagaggttnccctagtgtgaggtgcagctgggtggacgtcgtgggggagacgttcgggtccgagggcccggggggtacctgagtacccgtacgtcgtgacgtcgcgttccgtcggtgtagttaccttccgttcggtggtccgatacctagtacgtgtaccggtcggtccgtaccgaccgtccgtaacggaacggggaggtccggtaggtcggggttacggtcggtaacncggacaaggtaacagaaacgaccgtaaaaggaaaactaagtagtaccggtgtaactcgtagtgggaccgtagacttagcttacgacgttaccgagaacgtaaccgaatacgtnttaactnttagtacttaaggtacaacgtaanacttaaccgaatcggtacggactacggacgttacgtacgtttcgtaaacttccggtacgagttaacccgtgtaacccctacgggaccgggtaacccggaaccggtacgttaccccgggtctaaacccggtccggtaacctcgtactaaccccg

SEQ ID NO: 96633 - DNA, 643 bp, Homo sapiens
  misc_feature: GYAE6OF02IV6YN.43.38.D05.1.454.CMB.1.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (310)..(310): a, c, t, g, unknown or other
  misc_feature (310)..(310): n is a, c, g, or t
  modified_base (421)..(421): a, c, t, g, unknown or other
  misc_feature (421)..(421): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagacgactcaccaatggaattggggctgagtctgggtttcctggttgtctatttagaggtgtccagtgtgaggtcgntagcgtggtggagtccgnggggtanacgttggtccagggcccggggggttcctgacgactcgtcctcggtgcaggtcctgtcgtattcctacctttcgtggttacgccnctagtggacgtcgttacggcccgacgcggcctacgagggacggtcgttaggacgttgggtccgacagacgtagtaacgaagtaaacgacgttaggaaaaactaaaaggttntaggtacgtaaccgtgttaggcgtaacgggctaatacgtacttagctaccgagtaacgacaacgacgtaacgtatcgtatttacgttacgtaaaccaagttcggaaatatacccgtagacgaccgagtacgacgcgtttagtacgttgtacaacgtatacgtcctaggtaccgggaaccgggtacgaacggacttccggactaccgtactcgttacgacccg

SEQ ID NO: 96634 - DNA, 869 bp, Homo sapiens
  misc_feature: GYAE6OF02HZ2BQ.43.38.D05.1.454.CMB.1.raw
  modified_base (154)..(154): a, c, t, g, unknown or other
  misc_feature (154)..(154): n is a, c, g, or t
  modified_base (294)..(294): a, c, t, g, unknown or other
  misc_feature (294)..(294): n is a, c, g, or t
tcagtgtgagtagtcacgaccggtgctcgatttagtatctgatagttgggtttggggaggtctcagagaggagccttagccctggactccaaggcctttccacttggtgatcagcaactgagcacagaggactcaccatggaattgggctgagngttgggttttccttgttgcttattttagaggtgtccagtgtgaggtgcagcgtgggtggaggttcggtagggggagtacgttcggtacccgacgggcccggggggggttcctggaacgccgttccgtcgttgtcggaccncgtccgtcgtcggtacttccttaccgtttcgttcgggttacggctaccagtggacgtccgtcgggtcccgccgaggcctaccgggaagggtacggggtcgtgggtacgggtggggtcggacccgaggacttaaggaaacgaaacgaaaggtaagtaacggaaaaaactaaaaagtttaggtaggttacggaacctttcggacgggttaacggccggggttaacctacttaaccacgttaactaccgtaccgtaacggaacgtaaaccgaaacgaaccttaacgtttagttacgttaacgtttcgtttaaccaaaagttaactaggaaaacccgttcgaaaccgttaaagggaaccggtaccgggaaacccggaacggtaccgggtttacttttacggtttaaacgtttaccgtaaaccgggtttaaaaccttaactaaccccggttccccggtttaacccgggtaaccgggggggaaaccccggggggtaaccccggtaaaccgggtacccccggtttacgggtaaccccgttaaaccccgggttttcccgaccggttttaccccgaaccccggg

SEQ ID NO: 96635 - DNA, 820 bp, Homo sapiens
  misc_feature: GYAE6OF02HBFXK.43.38.D05.1.454.CMB.1.raw
  modified_base (395)..(395): a, c, t, g, unknown or other
  misc_feature (395)..(395): n is a, c, g, or t
  modified_base (440)..(440): a, c, t, g, unknown or other
  misc_feature (440)..(440): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcttgggttttccttgttgcttattttagaaggtgtccagtgtgaggtgcagcgtggtggagtcgtgggggagtacgttggtcccgagggcccggggggggtccctggacgtacctccgtaccgtggtcgcacgtcctcgtggacttcctacccttttccgttaggttcggcctacagtgaaggtccgtcggggtcccgaccgacgggtacctacccggaagggggaacgggtcgttaggggnggttacgggggcggacccgaagtccgaagtaacgaagtaaaacgngtaaacggaaaaactaaaagtttgaggtagtacgtgtaggtaggaccggggtactacttacaacgttacgtccgttaccgaaggtaacgtaaaccgaacggtaacccgtaaagtttaccttacgttattttaaccgtttactaaactaaaacgtacgtaaacctaacggtaacccgttaaaggacggtacccgggaaaggaacccggtacgggtttaccgttagtttttaaccgtttcgttaaccggtaaccgtaaaccttaacgttccccggtacggttaaccccgggggaacccgggggggttaaccccgtaaccggggtaaaccccgttcgggttaaacccggtccccgtacggtttaccctaaccggtaaccccgg

SEQ ID NO: 96636 - DNA, 767 bp, Homo sapiens
  misc_feature: GYAE6OF02HPL3N.43.38.D05.1.454.CMB.1.raw
  modified_base (146)..(146): a, c, t, g, unknown or other
  misc_feature (146)..(146): n is a, c, g, or t
  modified_base (700)..(700): a, c, t, g, unknown or other
  misc_feature (700)..(700): n is a, c, g, or t
tcagtgtgagtagtcacgaccggtgctcgatttagtatctgatagttgggtttggggtaggtcgttcgagagaggagccgttagccctggacgtccaaggccttccaccttggtgactctacgcactgagcacagagactcaccangaattgggctgagcgttgggttttccttggttctacttattttagaaggtcgtccgtagtgtgtaggtcgcagcgtaggtggacgtcgtgggggagacgtttgggccgagggtcccgggggggtcctacggagaccgttccgtccgtggtcgctacgccgttcgtcggagttacctacccttttccgtgggtttccggctacgaagttcggtagtcggtccgggtcccggaccgtaggcccgttacccggaacgggggtaacgggggtcctaggggagggttcggggggtaccgtaccggacggtacgtaacgtaacggaaccgaaaaagtcggtaacggaaaaaacttaaaattacgtaggtacgggtaaacttctaaggggtcggaaggggtccctaacgttacgaaccttcgtacccgtacgaaggtaaccgaacaaaccgtccgtaaagtacttaccgtaatttcgtacttaaaccgaatcgtaaactacgaaccgttaagaccgaccgaacggaccctaggtccttatttacctacgtgaaaccgtacnccttcgtactaaccgggagggggaaccctggacccggttccgacgtaccgttctacccgctaaccgg

SEQ ID NO: 96637 - DNA, 192 bp, Homo sapiens
  misc_feature: GYAE6OF02F5I9E.43.38.D05.1.454.CMB.1.raw
  modified_base (189)..(192): a, c, t, g, unknown or other
  misc_feature (189)..(192): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggtttctgttgctatttagaaggtgtcagtgtnnnn

SEQ ID NO: 96638 - DNA, 830 bp, Homo sapiens
  misc_feature: GYAE6OF02FF9CR.43.38.D05.1.454.CMB.1.raw
  modified_base (330)..(330): a, c, t, g, unknown or other
  misc_feature (330)..(330): n is a, c, g, or t
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagctgggtttccttgttgctatttagaaggtgtccagtgtgaggtgcagctggtggagtcgtgggggatacgttggccacggcccgggggggtaccctggagactcgtcctgtcgcacgcctcgtggtaacttcaccttttccgtgggttcggacacgtatagacgtcgtcgggtcccnccgaaggcctaccggaaggggtaacggggcgtagggaggttcggggtcggcccaggacctagtacgaaacgtaaagacgtaaggaaaaaactaaaagttacgtaggtacggtaactcgttaggtacgggacggggtaccgtattaccggtaaactacgtaccgttaacccgaaggaacggaaccgtaaacccggtaccgtaaaaggtttacttacggttaaacgttttcggtttacctaaaccttaaaagttaccggaaactaacggtaacccgttaaaagggtaccgaccgggaaacggtaacccgaacgggttaccctttagggttttacctttaccgttaacgttaaccggtaaaacctaccgttaacccgttaccgggtaaacccggggggtaacccggggggggggtaacccgttaaaccccgggggtaaccccgggtttacgggtaaccccggtttaaccggtccccgtttacccgttaccggttaaaccccgg

SEQ ID NO: 96639 - DNA, 701 bp, Homo sapiens
  misc_feature: GYAE6OF02J08U1.43.38.D05.1.454.CMB.1.raw
tcagtgtgagtagtcacgaccggtgctcgatttagtatctgatagtttgggtttggggaggtctcagagaggagccttagccctggactccaaggcctttccacttggtgatcagcactgagcacagaggactcaccatggaattggggctgagtcgttgggttttccttggttgcttattttagaaggtgtccagtgtgaggtgcagtgtggtggaggtcgtgggggagtacgttggtccgaggggtcccggggggtccctggacgtaccgtcgtccgtggtcgcacgtcctcgtcggtactccgtaccgtttccgtgggttcgacgtactagtacgacgtcgtacggggtccctccgaggtccgtaccgggaagggtaacgggggtcgtaggggtggttcggggaaccggtcgtaacggacgtaagtaacggaaccaaaggtacgtaacggaaaactaaaaacggttgtggtacggaacttggtacggtgggaacgggacccttagtccgtaatcgtactacgtaacgacgaaccaacggtactaacgtattcgtaacgtttattacgtaacgtaagtacgaaccgtacgtaaccgaggtacgaccggaagtacgacgttaacttgttaacgttacgtagacacgttactcgtacgacgggtacgggtacacggtacgtcgaccgtcgtctctacgtac

SEQ ID NO: 96640 - DNA, 798 bp, Homo sapiens
  misc_feature: GYAE6OF02GE9BN.43.38.D05.1.454.CMB.1.raw
  modified_base (745)..(745): a, c, t, g, unknown or other
  misc_feature (745)..(745): n is a, c, g, or t
tcagtgtgagtagtcacgaccggtgctcgatttagtatctgatagttggggtttggggaggtctcagagaggagccttagccctggactccaaggtcctttccacgttggtgatcagcactgagcacaggaggactcaccatggtaagttggggctgagtcgttcggttttccttgttgcttagtttagaaggtcgtctagtgtagaggtgcagtcgtgggtggagtcggtaggggagtacgttggtccggacggggtcccggggggttacctggacgtaccgttccgtccgtggtacgccgacgtccgtacgtggtacttccgttaccgtttcggtggttacgctaacgtagtcggtacgtcggtcgggtacccgcgtacggtccgtaccgggaggggtacgggtcgtggtacgggttcgggccgtaccgacggacgtaaggtaacgaaacgaaaggtaacgtaaaacggtaaaaacttaaagttaggtcggtacgtacgttcgtagggtacgggaacgggtcgtaactcgtaacgttactccgtaacgaacggaactaaacccggtaaccggaacgttaaagttcccgtttacgtaagttttaccgttaaaccaaagtaagtaaacgaccgtacggtaacaaagggtcccgaacggtaccgacttaccgggttagtttctttaacgtaccgaacgtaccgtaacttcggtaacccgtacgggaacggggggaacccgggttanaaccccgggttcgtaccggtaccccgtttacacccgttttacgacccgtaccg

SEQ ID NO: 96641 - DNA, 906 bp, Homo sapiens
  misc_feature: GYAE6OF02JVFIN.43.38.D05.1.454.CMB.1.raw
tcagtgtgagtagtcacgaccggtgctcgatttagtatctgatagttgggtttggggaggtctcagagaggagccttagccctggactccaaggcctttccacttggtgatcagcactgagcacagaggactcaccatggaattggggctgagcgttgggttttaccttgttgtacttattttagaaggtctcctagtgtgaggtgccagcgtggtaggacgttcggtggggacgtcttcgggtccgacgggccgggggggtccctggacgacgttcgtcctgtcggctagccgttcgcggtacttcctaccgtttccgtcgggttacggcctaccgatcggtacggtcgtccgggttccgaccgtacggtccctacggagggggaaccggggcgttcgggtaggttcggggtccggacgtagtacgtacgttaaacggaacggtaaaggtacgtaaaggggttaaaaaacctaaaaagtttacggtaccgggttaaggtaaccgtttacggttaagggttcggggaacggggttcccgttaagtacccgtttaaaacctccggtttaaacgtacccggtaacggaaaccggttaccaaacgggtaccgtttaaaacggttcgtttaaacccgtacgttttaaccggtttaacctaaaacgttaaacggtaaacgtaaaccgtacggttaacccgaaacggtttaaccggggaacccttaacgggaaccgttaccgtttaaccggttttactttaacggttttaaccgtaacggttaaaacgtaaccgttccggttaccctttaaccggggtaaccgggggaaacccggggggtttacccaaccggggtttaaaccctccggggtaaccgtttaccgtttacccggttcccgtaccggttacccgg

SEQ ID NO: 96642 - DNA, 817 bp, Homo sapiens
  misc_feature: GYAE6OF02GA6FH.43.38.D05.1.454.CMB.1.raw
  modified_base (523)..(523): a, c, t, g, unknown or other
  misc_feature (523)..(523): n is a, c, g, or t
tcagtgtgagtagtcacgaccggtgctcgatttagtatctgatagttgggtttggggaggtctcagagaggagccttagccctggacctccaaggcctttccacttggtgatcagcactgagcacagaggactcacctatggaagttggggctgagtcgtggttttccttgttgcttatttagaaggtcgtcagtgtgaggtgcagcgtggtggagtcggtgggggagtacgttgggtcccgacgggtcccgggggggtcctggacgtacctcctccgtgtcgaccgacgtccctacgtggtaactttcccgtaaccctttttccggtcgggtttagcctaacgtagtacggtaggtccggtttcggggtcccgaccgtacgggtcccgtaccgggaaggggggaacggggtcgtaggggtacggttcgggggtcggcccgtaagcgtaaagtaaggaaacgtaaagtaacggtaaaggtaaaaaaacttaaaaaggtttagacggttaagggtaaccgtttnttacggggtaggggaccgggtacccgttattacccgtaacgttactccgtaccgaaaggtaaccaaaccgtaacgaacccttaaaggtacctttaacgttattttaccgtttactaaacgtaactacgtaaacgcgttaaacgtaacgggaccgaccgggtaccggaacgtacgttctttagtttacttaccgtagtaacctaacctacgttccgtaaccgggacccggggtacgggggccctaacggggtacccttcgggtaccccgtcgtacccgttacctacggtaccccg

SEQ ID NO: 96643 - DNA, 828 bp, Homo sapiens
  misc_feature: GYAE6OF02HXR3L.43.38.D05.1.454.CMB.1.raw
  modified_base (133)..(133): a, c, t, g, unknown or other
  misc_feature (133)..(133): n is a, c, g, or t
  modified_base (228)..(228): a, c, t, g, unknown or other
  misc_feature (228)..(228): n is a, c, g, or t
tcagtgtgagtagtcacgaccggtgctcgatttagtatctgatagttgggtttggggaggtctcagagaggagccttagccctggactccaaggtcctttccacttggtgatcagcactgagcacagaggacncaccatggaagttgggctgagtcgttgggttttcctgttgtcgttatttagaggtgtcctagtgtgtaggtgcgagtcgtgggaggacgttcggngggggtacgtacgttcgggtaccggacgggtcccgggggggtcctggtaacgtccgttccgtccgtggtcgcgtcgtccgttacgtcggttacttccgttacccgtttccggttgggtttacgccgtactaggttcggacgtcggtcgggtcccgaccgacggtccgtacggaacggggaacgggtgtagggtaggtcggggtaccgacgtacgccgtagtaaacgtaacgaaaggtaagaaaacggtaaaacgtaaaagttacgaggttacggtaaccttcgtagggacggtacgggacgtttaactctaacgtacgtaccgtacgaacgtaacgaaaccggtaccgtaaactaggttactaacgttacgtttaacttacgtaactaaagttacgaaccgtacgtaaaccgttaacgacggtaccgggaacgtaaccggttagttaccgttacgttttaacgttccgggtttaaacgaaccgttaaaccgtcgtttacccggtaaccggttaccgggggaaccgggggttaacccgtaaccgggtccgttaaccggttaccgtaccccggtttacggttaccccgtacgttaaccccgg

SEQ ID NO: 96644 - DNA, 871 bp, Homo sapiens
  misc_feature: GYAE6OF02GKVGG.43.38.D05.1.454.CMB.1.raw
  modified_base (196)..(196): a, c, t, g, unknown or other
  misc_feature (196)..(196): n is a, c, g, or t
tcagtgtgagtagtcacgaccggtgctcgatttagtatctgatagttgggtttggggaggtctcagagaggagccttagccctggactccaaggcctttccacttggtgatcagcacgtgagcacagaggactcaccatggaattggggctgagcttgggtttcttgttgtcttatttagaaggtgtccagtgtgnggtgcagctggtggagtcgtggggatacgttggttaccgacggtcccgggggggtcctggacgtaccttccgtcccgtggttacgcgacgtccttacggtgacttccgttacccttttcctgggttacgcctaacgtactggacgtccggtcgggttcccgcctacgggtcccgtaccggaaggggtaacggggtcggtacggtagggttcgggtacgtaccgaagtccaaagtacgaaacgtaaagacgtaaacggtaaaaacctaaaagttgtacgttacgtaccgttacggtgggtcggaacggggtacctacgttaaccgtacgtacgttacctaacgacgaaccggtaaacaaacccgggtaacctaacgttaacgttcctttaaggtttaccgttttacgtaaaaaccgtaaacggttaacgaaaccgtaaaccggttaaccgtaaaaccggtacggtacccggtaaacggaaccggttaacggttaccgttttaaagttttcgttaaccggttaacgtaacccgtaaacccgtacgtttacccccgggttaagggttaacccggggggtaaacccccggggggttaccgaaaggggtttaacccccgggtccggttaacccccggttaacccgttcccggttttaacccgtacgttaaaccccccggg

SEQ ID NO: 96645 - DNA, 845 bp, Homo sapiens
  misc_feature: GYAE6OF02HY792.43.38.D05.1.454.CMB.1.raw
tcagtgtgagtagtcacgaccggtgctcgatttagtatctgatagttgggtttggggagtctcagagaggagccttagccctggactccaagcctttccacttggtgatcagcactgagcacgagaggactcaccatggaagttgggctgagtcgttggttttccttgttgtcttaagttttagaaggttctccagtgtgaggtcgcagcgtggtggagttcggtaggggagtcgtttcggtccgaacggggtcccgggggggttcccttagggacgtaccttccgttccgtggtcgccgtacgtccccgttcggtacggttactttccttacccttttccggttgggttcgacctacctagtagacgtccggttccgggtccgaccgtacggtccgtacggaacgggggtaacgggtcgtagggtacgggttgggtccggacccgaggtaccgtaagtaaacggaaacaaaaggtagtaaaaggaaaaaacttaaaagttcgtaagggtacgtacgttcgttagggtacgggtaccggggtacgttaacgtttccgtaacgtttacttccccgttaaccggagtaccgaaacgtaaccgtaacgtaacgtttacgtttacttaacgttttacgtttaactaaccgttaaagtacgaaccgttaagaacctaacgggaccgtaaccgtaggtaaccgtcggtttacgttttaacgttttaccttacggttaacctaacgttaacctaccgttcgttacccgggtaaccggggaacccgggggtacgtacccgggttacccgtacggttaccctaaccgggttcccttaccggttactaaccccgg

SEQ ID NO: 96646 - DNA, 559 bp, Homo sapiens
  misc_feature: GYAE6OF01CYJSD.22.52.E08.1.454.CMB.1.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (371)..(371): a, c, t, g, unknown or other
  misc_feature (371)..(371): n is a, c, g, or t
  modified_base (466)..(466): a, c, t, g, unknown or other
  misc_feature (466)..(466): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcggtcgtcgtttctaggtcggctatttaaaaggtgtcagtgtgaggtgcagctggtggagtcgtgggggaggcttggtacagccgtggggggtccctggagactcncctgtgcagcctntggatttcaccttttagctaattatgccatggagcttgggcccgccaggcctccgaggggacggggctgggagtcgggtctcgagcgtgttggtggtggtgngtggtggcacatactacgcacgactcgtacgaacgggccggtcgtaccactctccagagacaactacaacaacaccctatatatatacaaataanaacacgtacgagagacgacgaacgaacgacgaccgtactacgtacgtagtacggacggacggtacggtagtacgtacgacgacgcgtagtacg

SEQ ID NO: 96647 - DNA, 608 bp, Homo sapiens
  misc_feature: GYAE6OF01EWKOQ.22.52.E08.1.454.CMB.1.raw
  modified_base (155)..(155): a, c, t, g, unknown or other
  misc_feature (155)..(155): n is a, c, g, or t
  modified_base (183)..(183): a, c, t, g, unknown or other
  misc_feature (183)..(183): n is a, c, g, or t
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagttttgggctgagcggngtggttctaggtcggctaatttaaaggngtcagtgtgaggtgcagctggtggagtcgtggggagcgttggtacaggcctggggggtccctgagactcgcctgtgcncgctcgtgtgtcgtgttgngtctactgtcgtgtcgtcggtccgccgacggccgtccggagggacgggtcggtggtaggtgggtcggcgacgacgacgacgaacgaacgacggaacgaagtaagttaagtttagttgtcggtaccgtcgtacggtaggtacggtacgtacgtacgtacctactccgtacgacgaacgaacgaacgtaacgtaacgtactactacttacgttcgtacgtacgtagtagtacgtacgacgtcgtcgacgacgacgacgacgacgtcgtcgtacgttacgttcgttcgtagtacgtacgacgacgacgtacgtaactatagtagttagtag

SEQ ID NO: 96648 - DNA, 523 bp, Homo sapiens
  misc_feature: GYAE6OF01ETAGZ.22.52.E08.1.454.CMB.1.raw
  modified_base (446)..(446): a, c, t, g, unknown or other
  misc_feature (446)..(446): n is a, c, g, or t
  modified_base (491)..(491): a, c, t, g, unknown or other
  misc_feature (491)..(491): n is a, c, g, or t
  modified_base (519)..(519): a, c, t, g, unknown or other
  misc_feature (519)..(519): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggcttttcttgtggctattttaaaaggtgtccagtgtgaggtgcagctggtggagtctgggggaggcttggtacagcctggggggtccctgagactctcctgtgcagcctctggattcacctttagcaattatgccatgagctgggtccgccaggctccagggaaggggctgggagtgggtctcagctgttagtgggtggtgagtggtggcacatactacgcagactccgtgaagggccggttcaccatctccagagacaattccaagaacaccctatatatgacaaatgaacngacctgaagacgaccgaagaccgaacggccgtaatacctactggngcggaaagggccgtagagtagcaagcgngtcg

SEQ ID NO: 96649 - DNA, 551 bp, Homo sapiens
  misc_feature: GYAE6OF01CRNZ1.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtctttttcttgtggcttattttaaaaggtgtccagtgtgaggtgcagctggtggagtcgtgggggaggcttggtacagccgtggggggtccctgagactctccgtgtgcagcctctggattcacctttagcaattatgccatgagctggtccgcagctcgagggaagggctggagtgggtctcagctggttagtgggtggtgatgggtcggcacatactacgcagacctcgtgaacgggtccggttccaccactctccagaacgactaactaccaagaacgacgtagtactcttacaaatacgaacacgacctagagagaccgatacgacgacggccgtagtacttacgtgtgtgagtatactaaacttacgaagaccggcgggggtcctaaacccg

SEQ ID NO: 96650 - DNA, 659 bp, Homo sapiens
  misc_feature: GYAE6OF01BJPYE.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtctttttcttgtggcttattttaaaaggtgtccagtgtgaggtgcagctggtggagtcgtgggggaggcttggtacgagccgtgggggtccctgagactctcctgtgcacgcctctggacttctacctttagactaattatgccatgagcgtgggtcccgccgacggcctaccgaggggaacggggtctagggaggtcgggtcctcgacggtcgttaggttaggtgggtgggtgagtgggtcggacaacgtataccgtacgacacggtacctccgggtagggaacggggtcccgttaccaacccgtactcctaccgaagaacgaacctaacttacccgaaaacgaaaccctaccccttaataacttaagtacgaactaaatacgaaaccgacgtcccgtaagaacggtaaccgacccgaaaggaccgaaccgggtccttaaactaccgttacgtaggtacggaccgggtaaggggtcctaggacgtacgacgagcgtaggtaccg

SEQ ID NO: 96651 - DNA, 653 bp, Homo sapiens
  misc_feature: GYAE6OF01BEXP9.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtctttttcttgtggcttattttaaaaggtgtccagtgtgaggtgcagctggtggagtcgtgggggaggcttgggtacaggccgtggggggtccctgagactctccgtgtgcagcctctggtattcacctttagctaattatcgccagtgagcgtgggtcccgccgaggtcctccgaaggggaagggcgtgggagtgggtctgagtcgtgtagtggtggtgagtggtggcacgatacgtacgcagacctccggtagacgggccgttcacctatccgtacacgacgtaactaacttaccaaacgtaacctaacccgtataaacttacacgtaacaaacttaacgaacgtacgtaccctaggaaacgtaccggtaccgaaaacggtccgaaacccggggtcccgttaaagtaacccggtaacgttacggtacgggaacgggtaaaccggggtccgttaaggtaaacggttaaccggaccgtacggtaccgtaaggttacccg

SEQ ID NO: 96652 - DNA, 620 bp, Homo sapiens
  misc_feature: GYAE6OF01DU9LB.22.52.E08.1.454.CMB.1.raw
  modified_base (229)..(229): a, c, t, g, unknown or other
  misc_feature (229)..(229): n is a, c, g, or t
  modified_base (259)..(259): a, c, t, g, unknown or other
  misc_feature (259)..(259): n is a, c, g, or t
  modified_base (503)..(503): a, c, t, g, unknown or other
  misc_feature (503)..(503): n is a, c, g, or t
  modified_base (518)..(518): a, c, t, g, unknown or other
  misc_feature (518)..(518): n is a, c, g, or t
  modified_base (545)..(545): a, c, t, g, unknown or other
  misc_feature (545)..(545): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggtagtttgggctgagcgtgtcgttttctagtgctaattttaaaaggtgtccagtgtgaggtgcagctggtggagtcgtggggagcttggtacngcgtgggggtcctgacgctctcgtgtcgcngccctgtaggtacttcctacctttagactaattatcgacctatggagtccggtcgggtacccgcgacggtcctaccgggaggggaacggggtctgggtaggtcgggtctcgaggtcgttggtaggtgggtgtggtgtcggtaggcactacgtacgtacgccaaggtaccgttcgggtacggtaacgggccggttaccaccgatacctaccgagacgaactaactaccaaagtacccaactatanagtacgactaaagtnaacgaacgtccaagagacggaccgaanacccgtaccggtaactactacgtaccgttagggacgtacggaacgggtgtagaacctggaacctagcgacgttag

SEQ ID NO: 96653 - DNA, 674 bp, Homo sapiens
  misc_feature: GYAE6OF01AW2OB.22.52.E08.1.454.CMB.1.raw
  modified_base (266)..(266): a, c, t, g, unknown or other
  misc_feature (266)..(266): n is a, c, g, or t
  modified_base (313)..(313): a, c, t, g, unknown or other
  misc_feature (313)..(313): n is a, c, g, or t
  modified_base (661)..(661): a, c, t, g, unknown or other
  misc_feature (661)..(661): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtctttttcttgtggctaattttaaaaggtgtccagtgtgaggtgcagctggtggagtcgtgggggagcttggtacagccgtgggggtccctgagactctcctgtgcagcctntggattcaacctttagctaattatcgccaatgagcgttggggtcccnccgtagggcctaccggagggggaacggggcgtaggggacggttggggtcctcgacggtcgttaggtttaggtgggttagggtggtagttggggtacggcctaactacgttaacctaacggcctaacggaaccgttcccgggtagggaaaccggggttcccggttaccaaccctacgttcccgtaccgtaaggaacgtaaaccaaacgtttaaccgaaacgaaccctaaccccttaagtaactaactacgaactaaagtacgaaacacgtaccgtagaagaccgaccgaagaccgacggaccttaacgtaacgtcgtagtaggacggaaacgggtgtacgagtacgganacggcgtagtacg

SEQ ID NO: 96654 - DNA, 705 bp, Homo sapiens
  misc_feature: GYAE6OF01BYT6O.22.52.E08.1.454.CMB.1.raw
  modified_base (305)..(305): a, c, t, g, unknown or other
  misc_feature (305)..(305): n is a, c, g, or t
tcagacatacgcgtcacgaccggtgctcgatttagtcgagctctcaggagagaaaggggctgagagaggagcccagccctgggattttccaggtgttttcatttggtgatcaggactgaacagagagaagtcaccatggagtttgggctgagctggctttttctgtggctatttaaaaggtgtccagtgtgaggtgcagctggtggagtcgtgggggaggcttggtacagcctggggggtccctgagactctcctgtgcagcctctggattcacctttagcaattatgccatgagcgtgggtccnccaggctccgagggaagggctgggagtgggtctcgagtctggttagtggtggtgagtgggtgcacatacgtacgcagacctcggtaggaacgggtcccggttacacccgtatcccgtaccgaaggaacgtaaccgtaactttacccgaaaacggtaaacccctaacccccgtttaaattaacgttaactacggaaactaaaaacgttacggaaaaccctaacggtacccgttaagggaaaccggtaaccggaaccccggaaagggaaaccccgaacccggggtacccgttaaaacgttaaccgttaaccggtttaggggtaccgggtaaaccggggtaaacgggggtcggttaacggtaaacggttacggaacccggtaacgaccggtacggttaaccgg

SEQ ID NO: 96655 - DNA, 749 bp, Homo sapiens
  misc_feature: GYAE6OF01ALD3Q.22.52.E08.1.454.CMB.1.raw
  modified_base (313)..(313): a, c, t, g, unknown or other
  misc_feature (313)..(313): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggtagtttgggctgagctggtctttttcttgtggcttaattttaaaaggtgtccagtgtgaggtgcagctggtggaggtcgtgggggagtcgttggtacaggccgtcggggggtccctggacgacctctccgtgtcgcagcccttcgtggtactttcctaacctttagactaaattancgccaatggacgtcgtcgggtcccgccgtaggcctaccggaaggggacgggcgtagggacggtcggtctacgagtcgttaggttaggtgggttggtacgtagtgggtcgactacgtactacgtacgcgaacgtaccgtccgggtaggaaccgggtcccgttacacccgtataccctaccggaagaaccgtaaccaacgtttaacccaaaacgtaaacccctaaacccgttaataacgttaactaacgggaaacctaaaacgtacgggaaacccacgtacccgtaaggaaaccgtaaccggaacccggaaaacgtaaccccggtacccgggttaaaccttaacctaaccggttactagggggttacggaaaccgggtaaacgggggtccttaaaggtaaaccgttaacggaaccccgaagtcccggtaaggttaccg

SEQ ID NO: 96656 - DNA, 661 bp, Homo sapiens
  misc_feature: GYAE6OF01A8E0P.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggcttttctgtggctatttaaaggtgtccagtgtgaggtgcagctggtggagtcgtggggagcttggtacagcctgggggtccctgagactcgtcctgtgcagcctcgtggacttcacctttagcctaattactggcctatgagcgtgggtccgcaggcctcgagggaagggctggagtgggtctgacgctgtagtggtggtgagtggtcggctacgtatacgtacgctacggtactccgggtagaacgggtcccggtttacaaccgtagttcccgtaccgaaggaacgtaacctaacgtttaccaaacggtaccctacccgtatacgttaacgtacggtaactaaaacgttcggaaacccgtaggtacccgttaggaacgtaacggaccccggtaaagtaacccgaccggggttacccttaagttaacccgtacgttgggtacggtaccgggtaaagggtcccgttaaggtaccgttacggacccgtaaggtccgtaaaggttcccgg

SEQ ID NO: 96657 - DNA, 709 bp, Homo sapiens
  misc_feature: GYAE6OF01CNGP7.22.52.E08.1.454.CMB.1.raw
  modified_base (701)..(701): a, c, t, g, unknown or other
  misc_feature (701)..(701): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtctttttcttgtggtcttaagttttaaaaggtgtccagtgtgaggtgcagctggtggaggtcgtgggggagtcgttggtacgacggccggtggggggtccctggacgtaccttccgtccgtggtcgacacggtcccttcgtggtacttacctaccgtttagactaattatcgaccagtgacggtccgtcgggtcccgccgacggcccgtaccgggaaggggagggtccgtagggtacggtcgggtctacgaggtcgttaggttaggtgggttgggtagtacggttgggtacggacctaacgtaacgtaccgtaaccggacgtaacgtaccggttccgggtaacgggtacccggggtcccgtttacccaaccgtacgttacccgtaacccgaagtaaccgtaactaaccgttacccgaaaacgtaaccctaacccttagtaactatacgaactaaagtacgaccgtaacgtccgtagacgtaccgaacgtaacgacacgacgacctaactcgtagtacggcggacggaacggtctaaggactaggacnggctacgg

SEQ ID NO: 96658 - DNA, 557 bp, Homo sapiens
  misc_feature: GYAE6OF01DDJM6.22.52.E08.1.454.CMB.1.raw
  modified_base (463)..(463): a, c, t, g, unknown or other
  misc_feature (463)..(463): n is a, c, g, or t
  modified_base (519)..(519): a, c, t, g, unknown or other
  misc_feature (519)..(519): n is a, c, g, or t
  modified_base (544)..(544): a, c, t, g, unknown or other
  misc_feature (544)..(544): n is a, c, g, or t
tcagacatacgcgtcacgaccggtgctcgatttagtcgagctctcagagagaaaggggctgagagaggagcccagccctgggattttcaggtgtttcatttggtgatcaggactgaacagagagaagtcaccatggagtttgggctgagcgtggtcttttcttgtggctattttaaaaggtgtccagtgtgaggtgcagctggtggagtcgtgggggaggcttgggtacagccgtgggggtccctgagacgtctcctgtgcagcctctggattcacctttagctaattatgccatgagctcgggtccgccaggcctccgagggaaggggcgtaggagtggtctcgagctgttagtggtggtggagtggtggcactagtactacgcaacgacgtccgtggaagggtccgtaccaccgatcctccagacgactaactccaaagaacctaccctatactagtcaanaacagacagtcctaggacgacgaccgaagtaccaccgggtacctactaccgtacgngtagcggaaagggcgtaagacgtangtaagcgagtacg

SEQ ID NO: 96659 - DNA, 684 bp, Homo sapiens
  misc_feature: GYAE6OF01BSMBQ.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtgtcgttttctagtggctattttaaaggtgtcagtgtgagtgcagctggtggagtcgtgggggagcttggtacagccgtcgggggtccctggacgactctcctgtgcacgcctctggacttccacctttagactaattatcgtccagtgagtcgtcgggtcccgcgaggctccgagggaagggcgtgggagtgggtctcgagtcgttggttaggtgggtacggtgtagtgggtggcactacgtaccgtacggacgacgtaccgtcccggttaggaacgggttcccgttacgacctacgttcccgaccgtaagaacgtaacctaacgttaacccaaacgtaaccctaacccgttataacgtaactcggtaaacaagtacggaaaccgtcggtaccgtaaggaaccggtacggaaccggtaaaacggaccggtacccgggaaccgtttaaacgtaacgtttacgttacgggtacggaccggggtaaacgggtcggttacggtaaagtcggtaaccggcgttacgacggtttacg

SEQ ID NO: 96660 - DNA, 661 bp, Homo sapiens
  misc_feature: GYAE6OF01CSHXT.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatgggagtttgggctgagcttggtctttttcttgtggtcttattttaaaaggtgtccagtgtggaggtgcagcgtggtggaggtcgtgggggagcgttggtacaggccgtgggggtccctgagctctcctgtgcagccctgtggacttccaccttttagactaattatcgacctagtgacgtccggttcgggtcccgccggacggccctacccgggaagggggaacggggcgtaggggtaggttcggggtcctcgaggtccgttaggtttaggtggggttgggtgtaggttgggtacggactacgacgttaccgtacgctacggtacccgttcggtagggtacgggtcccggttaccaccgtactccctaccgaagacgaacctactaacccgaaactaaacccctaccttaatactacgtaacgaactaaaagtaccgaacacggtccgtagaacgacgaccggaacgaccgacggtacctatacgtacgtgtacggacgaggtcgagtacgagcaaggcctagtcg

SEQ ID NO: 96661 - DNA, 761 bp, Homo sapiens
  misc_feature: GYAE6OF01C8GZE.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtctttttcttgtggtcttaattttaaaaggtgtccagtgtgaggtgcagctgggtggagtcggtgggggaggcgttgggtacacggccggttcgggggggtcccctggacgtaccttcctccgtgtcgcacgtcctcgtggactttcctaaccgttttagactaattactcgcctaagtggtacggtccgtcggggtcccgccgacgggtcctaccgggaagggggaacggggtcgtagggtacggtcgggtacctcgaggtcgtttggttaggtgggttggtggtagtgggtcgactactactacgacgacgtacgaccgtccgggtaggaccggggtccgttaccacctacgttccctaccgaagtaacgaacctaacgttacccgaaaacgtaaccctaacctttaatacgtaactacgtaaactaaaagtacgaaacccgtggtacccgtaaggaacgtaaccgggaccccggaaaaggtaccccggaacccgggtaacccgtttaataacccggttaacggttacggggtacggtaaacgggggaaacggggttcgttaacgggtaagtaaccggcgaaacggtccgtaacgggttaacccg

SEQ ID NO: 96662 - DNA, 549 bp, Homo sapiens
  misc_feature: GYAE6OF01DYDRZ.22.52.E08.1.454.CMB.1.raw
  modified_base (199)..(199): a, c, t, g, unknown or other
  misc_feature (199)..(199): n is a, c, g, or t
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (453)..(453): a, c, t, g, unknown or other
  misc_feature (453)..(453): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtgtgtttctaggtcggctatttaaaaggtgtcagtgtgaggtgcagngtggtggagtgtgggggaggcttgggtaccagccgtgggggggtccctagacgcttctcctgtgcagcctntggattcacctttagntaattangccatgngcgttgggcccgcaggctccgagggagggctaggcgtggtctgagtntggttgtgggtggtggngtgcganactactacgccgcacgtcgtcggaggacgggtccgtacacctactcgacgaagtacactactaccaacaccgtactatatanacgaactaatagacgacgacgagacgacgaccgaagtccgacgtccgtaattcgacgtgtacgggcgaacggtgaagtcgacacgagcgtagtccg

SEQ ID NO: 96663 - DNA, 742 bp, Homo sapiens
  misc_feature: GYAE6OF01EPYH1.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtgtcgttttctagtggctaattttaaaaggtgtccagtgtgaggtgcgagcgtggtggagtcgtgggggaggtcgttggtacgaggccgtgggggtccctgacgctctcctgtcgcacgctctgacttctactttagctaattatcgacagtgacgtcgtcgggtccgaccgaggtccgtaccggaggggtaacggggcgtagggaggtcgggtactcgtacgtcgttaggttaggtggggtggttaggagttgggtcggaccaacgtaacgttaccgtacggataaccggaccgtaccgggttagggaaccgggttcccgtaacaccgtacttaccgaccgaagtacgaaccttacgtaacccgtaaacgaccctaacccgttaatacgttaacctagtaacccttaaaacggacgaaaaccgtacccgtacgtaggaaaccgggacccgaaacgggaaaccccgtacccggtaaccggggtaccgtttaaaaccgttaaccgtacggtttaccggggacgaaccggggggttaaacggtccgtaaagggtacgtaacggtaccgaacccggtttagaccgttttacgg

SEQ ID NO: 96664 - DNA, 831 bp, Homo sapiens
  misc_feature: GYAE6OF01BZ2JC.22.52.E08.1.454.CMB.1.raw
  modified_base (410)..(410): a, c, t, g, unknown or other
  misc_feature (410)..(410): n is a, c, g, or t
tcagacatacgcgtcacgaccggtgctcgatttagtcgagctctcagagagaaaggggctgagagaggagcccagccctgggattttcaggttgttttcatttggtgatcaggactgaacagagagaagtcaccatggagtttgggctgagctggtctttttcttgtggtcttaattttaaaggtgtccagtgtgaggtgcagcgtggtggaggtcggtgggggaggtcgttggtacgaggtcccggttgggggggtcccctggacgtaccttccgttccgtggtgaccacggtcccttcgtgggtaactttcctaacccttttaagcctaaatttacgtcgaccatggacggtcggttcggggtcccgccgacgggtccgtaccggaaggggaacggggtcgtaggggnggttcgggtctacgtagtcgttaggtttaggtgggttggtagtaggttcgggtagggacctaactacgtaaccgtaacgacgtaacgtaccggtaccgggtaggggaaccggggtcccgtttaccaacccgttacgttacccctaacgaacggaaaccgtaaccttaaccgttaaccccaaaacggtaaacccctaaccccgttaattaaattacgtaacgtaaaccaaagttaaccgaaaccgtacggtaccccgtaagggaacccgaaccgggaccgaaaacggtccccggtaaaccggggtaaacccctttaagttaaaccccgttaacgggttacggggaccggtaaacggggggaaacggggttccgtaaacggtaacggaaccggtaccgaacggtaccgtaaccgggtttaacg

SEQ ID NO: 96665 - DNA, 701 bp, Homo sapiens
  misc_feature: GYAE6OF01D7QJN.22.52.E08.1.454.CMB.1.raw
  modified_base (279)..(279): a, c, t, g, unknown or other
  misc_feature (279)..(279): n is a, c, g, or t
  modified_base (345)..(345): a, c, t, g, unknown or other
  misc_feature (345)..(345): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtctttttcttgtggtcttaattttaaaaggtgtccagtgtgaggtgcagcgtgggtggaggtcgtggggggaggtcgttgggtacaggtccggtggggggtcccctggacgctcctccgtgtgcncgtccctcgtggtacttcctaacctttagactaattctcgcctagtggacgtcggtcggggtcccnccgacggccgtaccggagggggacgggcgtagggaggttcgggtcgtcgtagtcgttaggttaggtgggtggtgtaggtgggtacgctaacgtactaccgtacgacgacggtaccgttccgggaggtaccgggtcccgtacaccgtatcccacgaagaacgaactaactaccgaaactacctacctaagttacatacgaactaaagtacaacgtacgacctaggaacgtaccggaaccggaacgacccggtaaccggtacccgttaaacgtcccgttaacggtaccgggtaacggtaaccggggtaaacgggggtctaaaggtacgtaccggacgaaccggtcgtaggttaaccgg

SEQ ID NO: 96666 - DNA, 928 bp, Homo sapiens
  misc_feature: GYAE6OF01DWLOV.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggctttttctgtggtctattttaaaaggtgtccagtgtgaggtgcagctgggtggagtcgtgggggagtcgttggtacaggccgtggggggtccctggacgtacttcctccgtgtcgcagtccctcgtggtactttcctaacccgttttagacctaaatttacgtcgaccctagtggtacggtccggttcggggtccccgacccgtacggggtcccgttacccggaaggggggtaacgggggtccgttaggggtaacgggtttcgggggttacctaccggtaacggttcccggtttagggttttaacggggttcgggggtttacggggttacgggttaaggtttacgggggtcgggtaaccgtaacggttaaaccgtttaaacccggttaacccggtacgtaaacccggtaacccggtttacccggggtaacggggtaaaaccccggggggttcccccggtttaaacctaacccccgtacgtttaacccccgttaccggaaaacgggtaaccggtaaaccccttaaacggttttaaaccccgaaaaaaccggttaaccccctaaaacccctttaagtttaaacgttaacgttaacggaaaccttaaaacggttaacggaaacccgtacggttaccccgttaagggaaccgtaaccgggaacccgtaaaacgaacccggtacgggtaaacccgtttaactaacggttacccgtggggttaaccggaacgggtaaagggtccgtaaggactaacggcgtaaacggcgtaggtttaccg

SEQ ID NO: 96667 - DNA, 658 bp, Homo sapiens
  misc_feature: GYAE6OF01BG3U6.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggtagtttgggctgagctggtctttttcttggtggcttattttaaaaggtgtccagtgtgaggtgcagctggtggaggtcggtgggggaggtcgttgggtaccgaggtcccggttcgggggggtcccctggacgtacctccgttcctgtcgccagccctcgtggtacttctaacctttagactaattatcgccatgagcgtcgggtcccgccgaggcctaccggaggggacgggtcgtgggaggttcgggtctcgacgtcgttggttacggtgggtggtgacgtgggtggctactactacgtacgcgacgtaccgtccgtaagggaccgggtccgtacacctactctaccgagacgaactactaccaaagaccctaccagttactagtacgaactaagacaaacgcgacctaggaactacgggaaccaaggacccgaaccgttccgtaaacttacgtacggttaggacgggaccgggaacggtcggttaagaacgttacgacgtaacgcgttaacggttaccg

SEQ ID NO: 96668 - DNA, 763 bp, Homo sapiens
  misc_feature: GYAE6OF01BYK8T.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtctttttcttgtggctattttaaaaggtgtccagtgtgaggtgcagctggtggagtcgtgggggaggtcgttggtacaggccgtggggggtcccctggagactctcctgtgcagtcctctggtattcctacctttagctaatttatgcctaatgagtcgtcgggtcccgccgaggtcctaccggagggggtaacggggcttaggggagggttcgggtcctcgacggtcgtttaggttagggttagggttgggtggtaggttggggtcggcaactaagttacctaccggctaacggtaccgttccgggtagggaaccgggtcccggtttacaacccctacgttcccctacccgaaggtaacgtaaaccctaacgtttacccgaaaaacggtaaacccctaacccgtttaataacgtttaactacgaaactaaaacgttcggaaacctacggtcccgttaaggaaacgggaacccggtaaccggaaaacggtacccggtaacccggggtacccgtaaactttaaccgtacggttacgggtacgggcccggggtaaaaggggtcccggtaaggaacgtttaacggaccggctaaagggttcttttaaacggg

SEQ ID NO: 96669 - DNA, 753 bp, Homo sapiens
  misc_feature: GYAE6OF01C9C0C.22.52.E08.1.454.CMB.1.raw
  modified_base (196)..(196): a, c, t, g, unknown or other
  misc_feature (196)..(196): n is a, c, g, or t
  modified_base (348)..(348): a, c, t, g, unknown or other
  misc_feature (348)..(348): n is a, c, g, or t
tcagacatacgcgtcacgaccggtgctcgatttagtcgagctctcagagagaaaggggctgagagaggagcccagccctgggattttcaggtgtttcatttggtgatcaggactgaacagagagaagtcaccatggagtttggctgagctggtcttttctgtggcttatttaaaaggtgtccagtgtggaggtgcngcgtgggtggagtcggtgggggtagtcgttaggtacgacggtccggtcggggggtccctggacgtaccttcctccgtggtcgcacgtcctcgtcggtattccgtaacctttacgactaattagtcgacctagtgaacgtcgttcggggtccncgacgggtccttaccgggagggggaacgggtcgtagggtagggtcgggtacctacggagttccgttaggtttagggtgggttaggtggtagttggggtacggacaaccgtacgtttaacggacgtacgtaaccgtaccggttaccgggtaacgggtaacccggggtacccggtttaccaacctacgtaccccgtaccgaagaaccgtaacctaaccgttaaccgaaacggaaaccctacccgttaataacttaagtcgaaactaaacgtacgaaacacggtaccgtaggaacgaaccggaccgtaaacgacccgggtaaccggtccgtaagttaccgtacggtaggtacgggaacgggtaacgggtcgtaaggtacgtaacggacgacggacttaacggttaccg

SEQ ID NO: 96670 - DNA, 679 bp, Homo sapiens
  misc_feature: GYAE6OF01B0IMG.22.52.E08.1.454.CMB.1.raw
  modified_base (533)..(533): a, c, t, g, unknown or other
  misc_feature (533)..(533): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtggtcttttctgtggctattttaaaaggtgtcagtgtgaggtgcagctggtggagtcgtgggggaggcttggtacacgccgtggggggtccctgagacgtctccgtgtcgcacgccgtcctggacttccaacctttagactaattatgcctatgagcgtcgggtcccgcgacggctccgaggggagggcgtggaggttgggctcgagtcgttgttagtgggtggtgtacgtgggtagacgactaatactacgctaaacggtcgtccggtaggaaaccggggtcccgtttacaccgtaattcccgaacgtaacgaacggtaccttaaaccgtttaccgaaacgtaaacccttaaccccttaataacgttaataccggtaaanaaaagtttaacggaaacctacggtacccgaggaagaaccggacccggaaacacccggaaccggtaccggttaaatacccttacgtggtacggaacgggaacgggtcccgaagggtaactacggaaccgtagtaccgtggtaaccgg

SEQ ID NO: 96671 - DNA, 776 bp, Homo sapiens
  misc_feature: GYAE6OF01E02W6.22.52.E08.1.454.CMB.1.raw
  modified_base (736)..(736): a, c, t, g, unknown or other
  misc_feature (736)..(736): n is a, c, g, or t
tcagacatacgcgtcacgaccggtgctcgatttagtcgagctctcagagagaaaggggctgagagaggagcccagccctgggattttcaggtgtttttcatttggtgatcaggactgaacagagagaagtcaccatggagtttggctgagcttggtctttttcttgtggtctattttaaaaggtgtccagtgtgaggtgcagcgtggtggagtcgtgggggagtcgttggtacagccgtcgggggtccctgagctctcctgtgcagcctctggtacttcctacctttagactaagttatcgcctagtggacgccgtcgggtcccgccgacggtccgtaccggaaggggaacgggtcgtagggtaggtcgggtacctcgagtcgttacggttaggtcgggttggtcggtaggttcgggtcggacctaacgtaacgtaccgtaacggcctaacggtaccgtcccggttacgggtaaaccggggtcccgttaacccaacgtaccgttaccctacccggaaacgggtactaaacccgttaaccgttaccccgaaaaacgtaaacccccttaaccccgtttaattaaagtttaacctaacgggtaaacctaaaacgttaacggaaacccgtaaccggtaccgttaaggaacggtaaccggaacccggaaacggaccccggtaaaccgggtacccgttaaacttacccgtttaacggtcgtaacgggaccgggtaacggggntttaccggaacggttaacgacgaacgtcgacggtttaccg

SEQ ID NO: 96672 - DNA, 650 bp, Homo sapiens
  misc_feature: GYAE6OF01A4QKV.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctgggttttcctcgttgctcttttaagaggtgtccagtgtcaggtgcagctggtggagtcgtgggggaggcgtggtccaggcctggggaggtcccctgagacctctcccgtgtgcagcgtctggacttcaccttcagtggacttagtggacagtgccacgtcggctcccgccgaggccgtccggggacgaaggggctagggacggtgggtcggactaagtttagacgttagggtatcggagttaggtaaagttaaagtaaaagtacttaagtggttacgggtaaccgttccggtagggaaacgggtcccgtaagttccgaaccctactccgttaacccgaacggacgaaccgtaacctaccgaaagaacctaacttcgttacgtttacctacccaaagtacgaactagtacctacgacggtacggcggtacggacgaccggacgtagtcgttagttacgtgtaggacggtagaagtacgtacgacgtagtagtaaccggg

SEQ ID NO: 96673 - DNA, 704 bp, Homo sapiens
  misc_feature: GYAE6OF01D67X1.22.52.E08.1.454.CMB.1.raw
  modified_base (468)..(468): a, c, t, g, unknown or other
  misc_feature (468)..(468): n is a, c, g, or t
  modified_base (621)..(621): a, c, t, g, unknown or other
  misc_feature (621)..(621): n is a, c, g, or t
  modified_base (691)..(691): a, c, t, g, unknown or other
  misc_feature (691)..(691): n is a, c, g, or t
tcagacatacgcgtcacgaccggtgctcgatttagtcgagctctcagagagaaaggggctgagagaggagcccagccctgggattttcaggttgttttcatttggtgatcaggactgaacagagagaagtcaccagtggtagtttgggctgagcgttggtcttttttcttgtgtaacttaagttttaaaaggtgtcctaggttgtggaggtgcagtcgtgggtggaggtcggtggggggagtcgttggtacagtccgttggtcgggtccctggacgtacctctccgtgtcgcgtcgtcctcgtggtacttacctactttagacctaattactcggacctagtaggtacggtccggttccggggtccccgaccggacggtccggtacccgggaagggggtacgggtcgttggggtacggttgggtcctacgtaggtcgttggtttagggtgggttggtgtaggtcgggnggtaacagtacgtaacccgtacggacgtacgtaccgtacggtacgggaccgggttccctacgaaccgtacttccgaacgtaagaacgaaccgtactaaccaaaccgtaaccctaccttaatactacgtagaactaaagtcgaaccgtgtacgngaacggacgtaccgaagtacgtacggtaccgtatacggttcgaggtacgacgggtaaggcgtagagtacncgtacgcggtacg

SEQ ID NO: 96674 - DNA, 737 bp, Homo sapiens
  misc_feature: GYAE6OF01A9JTR.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctgtcttttcttgtggctattttaaaaggtgtccagtgtgaggtgcagctggtggagtcgtgggggagcgttggtacagccgtacggggggtccctggacgacgtcctccgtcgtgcgagcctcgtggtacttcctaccgtttagacctaatttactcggacctatcggagtccggtccggggtccgaccggacggtccgtaccggaagggggtaacggggtcgtagggtacggttcggggtcctacgacggtcgttggtttaggtggggtgttggtacgtgggtcggactacgtaacgttaacgtacggcgtaaccgtaccgtcgggtaacggtaaccggggtcccgttaccgacccgtacgttccctaacgaacgaacgaacctaacgtaaccctaaacgaaccctaacccgttaataacgtatacgaactaaagtacgaacacgtaccgtaggaaacggacggaacccgaacggtaaaccgaccggtaacccgttaacgttaacgttaccggttaggacgggaaccgggaacgggtaacggttacgaaacggttaccggaaccaaggttaccgtacgggttacg

SEQ ID NO: 96675 - DNA, 601 bp, Homo sapiens
  misc_feature: GYAE6OF01CYH3N.22.52.E08.1.454.CMB.1.raw
  modified_base (586)..(586): a, c, t, g, unknown or other
  misc_feature (586)..(586): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtctttttcttgtggctattttaaaaggtgtccagtgtgaggtgcagctggtggagtcgtgggggaggtcgttggtacaggccgtcggggggtccctgagactctcctgtgcagcctcgtggtacttctacctttagactaattatgacctagtgagtcgtcgggtcccgccgacggcctccggaagggggaggggcgtgggaggtcgggtctacgagtcgttggttaggtgggtggtgagttggtggcaactatactacgcagacctccggtaggaacgggtcccgttacaccattcccacaagacgactaacttaccaaacgtaaccctaccttatactatacgaacaaagtacgaacagtcctagacgacgacgaacgacgaccgtacgtatacgtacgtggtacggcggaaggggtctaggaatacggnaaggtccgtgtaccg

SEQ ID NO: 96676 - DNA, 612 bp, Homo sapiens
  misc_feature: GYAE6OF01E4LZG.22.52.E08.1.454.CMB.1.raw
  modified_base (313)..(313): a, c, t, g, unknown or other
  misc_feature (313)..(313): n is a, c, g, or t
  modified_base (495)..(495): a, c, t, g, unknown or other
  misc_feature (495)..(495): n is a, c, g, or t
tcagacatacgcgtcacgaccggtgctcgatttagtcgagctctcagagagaaaggggctgagagaggagcccagccctgggattttcaggtgttttcatttggtgatcaggactgacagagagaagtcaccatggagtttgggctgagctggctttttcttgtggctattttaaaaggtgtccagtgtgaggtgcagctggtggagtcgtgggggaggcttggtacagccgtgggggtccctgacgactctcctgtgcagccctctggtacttccacctttagctaattatgcctatgagctgggtccgccnggcctccggagggaacggggctgggaggtgggtctgagtcttggttagtgggtggtgatgggtcgacacgatacgtcgcagtaccgtccgtaggacgggtacccgttcacctatccgtacagacgtacaacttaccaaactaaccgaaccctataatacgtagaacctaaatacggaaaccngtacccgtagaacgacggtacccgaaaggacccgaaccggtaccgtaactaccgttacgtggttacggacggtaaggggtccgtaggtaacgtacggaccgagcctaggttacccgg

SEQ ID NO: 96677 - DNA, 646 bp, Homo sapiens
  misc_feature: GYAE6OF01A0COO.22.52.E08.1.454.CMB.1.raw
  modified_base (199)..(199): a, c, t, g, unknown or other
  misc_feature (199)..(199): n is a, c, g, or t
  modified_base (408)..(408): a, c, t, g, unknown or other
  misc_feature (408)..(408): n is a, c, g, or t
  modified_base (425)..(425): a, c, t, g, unknown or other
  misc_feature (425)..(425): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtgtcgttttctaggtcggctaatttaaaaggtgtccagtgtgaggtncagctggtggagtcgtgggggagcttggtacaggccgtgggggtccctggagctctccgtgtgcagtcctcgtggacttccgaccttttagactaaatttacgtcggacccctaattggaacgtccgtcgggttcccgaccgacggtcctacccggtaaggggaacgggtcgtgggacggtgggtctcgagtcgtgttaggtcggtggngtagtggcggacaacgngtaactacggcagactcgtagaacgggtccgtcaacgcttcgaccagacacgaacttaccgaaagaaccctaacctatactactacgaactaacgaacgtaacacgtccgaagtacgaacgtacccgaaaggacccgtccgggaacccttatacccggttacagggttacgaaccgggaacggtcgttaacgacgtaacgacgcggtacgtaaccggttcg

SEQ ID NO: 96678 - DNA, 720 bp, Homo sapiens
  misc_feature: GYAE6OF01C7ILJ.22.52.E08.1.454.CMB.1.raw
  modified_base (175)..(175): a, c, t, g, unknown or other
  misc_feature (175)..(175): n is a, c, g, or t
tcagacatacgcgtcacgaccggtgctcgatttagtcgagctctcaggagagaaagggctgagagaggagcccagccctggatttcaggtgtttcgactttggtgatcaggacgtgaacagagagaagtcaccatggtagttggctgagctgtcttttctgtgctatttaaagtntccagtgtgaggtgcagcgtggtggagtcgtgggggagcttaggtacacggccggttcgggggtccctagacgtactcgtccgtgtcgcacgtccttacgttggtactttcctaaccgtttagactaattatacggacctatagacggtcgttacgggtcccgcgtacggcctaccggaaggggacgggtcgtagggtaggtcgggtactcgacgtcgttggttaggtcggtagggtgtacgtgggtcggactacgtagttaaccgtaccgtaccgtacgtaccgttccggtaaggaacccggggtcccgttaaccaccgtacgttcctaccgaagtaaccgaaccttaacgttacccgaaaacgtaaccctacccgtttaattaactacgtagaactaaagtacgaacgtaccgtccgtaacgggaaccgtaacgggacccgaaacggaacccggtaccggacccgttaagtaccgtacggttaaggaccgggtaacgggtaacgggcgtagtaaccggtaacgaggaacgcgttacgttaccg

SEQ ID NO: 96679 - DNA, 737 bp, Homo sapiens
  misc_feature: GYAE6OF01APSGB.22.52.E08.1.454.CMB.1.raw
tcagacatacgcgtcacgaccggtgctcgatttagtcgagctctcagagagaaaggggctgagagaggagcccagccctgggattttcaggttgttttcatttggtgatcgaggactgaacagagagaacgtcaccagtggtagtttgggctgagcgttggtctttttcttgtggtcttaagttttaaaaggtcgttcctaggttgtggtaggtgcgagtcgttgggtggtacggtcggtaggggggtacggtccgttagggtaccgtacggtcccgggttcggggggtccctaggtaccgtacttcgtccgtgtgcacgtcctagtaggtactcctaccttagtactaattatcgactagtggtacgtcgtcggccgaccgacggccgtacgggaggggtacggtggtgggtacggtcgggtactcggtagttacgttgggttgggttgggtggtaggtacgggtggacgtactaacgtacgttaccgtcgtaccgacggtaccggttacgggacggtacccgggtaccgttaccgtaccgtcttacccgtacgaacgtaccgtaaactaccgtaaacccgaaacgtaaccctaaccgttaatacgtaacgtacgtaacaacgtacgtaacccgacggtaccgtaacggacgtaaccggaacgtaacgaccggtaaccggtactaacgtcgtcggtaggacggaggacgtgagtacgtacgagtacgtcgtagtcg

SEQ ID NO: 96680 - DNA, 760 bp, Homo sapiens
  misc_feature: GYAE6OF01BW7BP.22.52.E08.1.454.CMB.1.raw
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (393)..(393): a, c, t, g, unknown or other
  misc_feature (393)..(393): n is a, c, g, or t
tcagacatacgcgtcacgaccggtgctcgatttagtcgagctctcagagagaaaggggctgagagaggagcccagcccgtgggtattttctggttgttttcatttggtgatcaggactgaacagagagaacgtcaccagtggtagtttgggctggagtcgtggttctttttacgtggtcggtactttaaagttttaaaaggtgtccgtaggtggtggaggtgcgtggtcggtgggtggtaggtggggtggggtcggtcgttacggtaacgtccggtcggggttaccgggtccgagtacgtctccgtcggtgtacgcgcgtcgtcgtagtactacttacgtanatagtntcgctagtcgcgtcgtcggccacgtcgcgtagggacggaggtggnggtcggtcgatcggtgtggttaggtggtgggtgagtcgggtcgtaggtactaacgtacgtcaaacggtctaacggtcgggtacccgggtacggtcccgggttcctaccgtaacctccgtaaccgaaccgtaagaaaccgttaacgtaacccgtaacgtaaacctaacccgtttaacaaacggtttaaagaacgtaacgtaaacgtaaacgaaccgtacggtaacgtaccggaacggtaaccgaaccgggaaacccggaaacccggtacgtaacccggttaacctaacgttaacggcggttacgggaacgggttaaccgggaagggtacaaaggtacccgtaacggacacggttaacggtaccgttcg

SEQ ID NO: 96681 - DNA, 813 bp, Homo sapiens
  misc_feature: GYAE6OF01BUEUE.22.52.E08.1.454.CMB.1.raw
  modified_base (529)..(529): a, c, t, g, unknown or other
  misc_feature (529)..(529): n is a, c, g, or t
  modified_base (792)..(792): a, c, t, g, unknown or other
  misc_feature (792)..(792): n is a, c, g, or t
  modified_base (800)..(800): a, c, t, g, unknown or other
  misc_feature (800)..(800): n is a, c, g, or t
tcagacatacgcgtcacgaccggtgctcgatttagtcgagctctcagagagaaaggggctgagagaggacgcccagcccgtggtattttcgaggttgttttcatttggtgatcgaggactagaacagagagaactcactagtggtaggttggctgcgtcgttggtttctttttcgttggtcggtactttaagttttaaaaggtcgtccgtaggttggtagacggttcgcgtggtcggttgggtaggaggttcgggtagggggtagttccgttaggtaccgcggttcccggttaggggttccgggtaccctaggaccttaccgttccgtttccgtaggccgaccgtcgtcccgttaggtaccttcgttacccgttaacctttaagtaacgtttaattcggtcccgaacgtagtacgggtccggtccgggttaccccggggaccccgtggtacccgggtaacccgggtcgggggaaaggggtacggggtaccggttgggtttacggggtccgttacgtctaacgggggttntttagggggttaggtgggttaggtctagggtcggtactacaaccgtactacggtccggaaactacccggggtacggtaccggttaccggtaccgggtacctaccgtacgtacccgtacgtaacccgaagtactaacccgtaacgtaaccaaaccgtaaccttacgttaactacgtaacgagtaactaacgtacgaacgtccaacgtgacgaccgaacgacgaccgaccgtactacgtagtcggtaaggccggtaggcgagtanacggaacngtagtacgtacgg

SEQ ID NO: 96682 - DNA, 843 bp, Homo sapiens
  misc_feature: GYAE6OF01B8SZW.22.52.E08.1.454.CMB.1.raw
tcagacatacgcgtcacgaccggtgctcgatttagtcgagctctcagagagaaagggctgagagaggagcccagccctgggattttcaggtgttttcatttggtgatcaggactgaacagagagaagtcaccagtggtagtttggctggagtctggttctttttcgtggtggtacttaagttttaaaaggtgtaccaggttgtaggtaggtgcgagtcgtgggtggtacggttcggtaggggggtaggtcgtttacgggtaccgacgggtcccgggttcggggggtccctaggacggtaccttccgtcgtggtacgccgtacgtcccgttcggtaggttacctttaccgttaaccgttttaaggacctttaaattcgtacgtacccgtaagttacggtacggtccggttccggggtccccggaccgtaaccgggtacccggttaccgggaaacggggggaacggggtccgggttagggaccgggtttgggttaccgtacggtacggttccggttttagggtttaaggggttggggttgggtagttaggtttcggggtaggtaacctaacgtaacgttaccgtaacggaccaacgggttacccgtaccgggtacggtaacccgggtacccggttaccaacttacgttaccctaacgaacgtaaccgaacttacctaaacggaaacctaaacccgtaccttaagtactaacgtacgaaactaacgtacgaaccgtacgtacgtaacggaagaacccggaacgtacggaaacccggtacgtaccgtaattacggtcgttaaggaccggtaggaccgggatacgaacgtatacgagcgtagtaccgg

SEQ ID NO: 96683 - DNA, 687 bp, Homo sapiens
  misc_feature: GYAE6OF01BIHL7.22.52.E08.1.454.CMB.1.raw
  modified_base (668)..(668): a, c, t, g, unknown or other
  misc_feature (668)..(668): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttggctgagcgtgtcgttttctggtgttaatttaaaggtgtcagtgtgaggtgcagcgtggtggtacgtcggtagggggagtccgttaggtacaggtccggtagggggtccctggacgtactcgtcgtgtcgctacgccgttcgtagggacttttccgaccgttttagaccgtaaagtttatccggacctaagttcgaacgtccgtagggtcccgacggcgtactacggaagggtacggcgtggtacggtcggtactcgtagtcgttaggtacgtggtcggtagtcgtggtcggtactactaacgtaacgtaccgacgtaccgtaaccgtaccgggtaggtaacgggttacccggtacgaccgtacgtaccgtacgaacgaacgtaacgaacgttaccaaagtaacctaccgtaactatagtacaactaataacgacacggtacgaggaacacggtaacgacgtaaaccggcgtacgttactaaggtaacgtacgggtacgtacgggacgtagtacgtagtaccgganaggtacacgttcgttaccg

SEQ ID NO: 96684 - DNA, 701 bp, Homo sapiens
  misc_feature: GYAE6OF01BQTJC.22.52.E08.1.454.CMB.1.raw
  modified_base (498)..(498): a, c, t, g, unknown or other
  misc_feature (498)..(498): n is a, c, g, or t
  modified_base (565)..(565): a, c, t, g, unknown or other
  misc_feature (565)..(565): n is a, c, g, or t
  modified_base (601)..(601): a, c, t, g, unknown or other
  misc_feature (601)..(601): n is a, c, g, or t
  modified_base (608)..(608): a, c, t, g, unknown or other
  misc_feature (608)..(608): n is a, c, g, or t
  modified_base (641)..(641): a, c, t, g, unknown or other
  misc_feature (641)..(641): n is a, c, g, or t
  modified_base (667)..(667): a, c, t, g, unknown or other
  misc_feature (667)..(667): n is a, c, g, or t
  modified_base (684)..(684): a, c, t, g, unknown or other
  misc_feature (684)..(684): n is a, c, g, or t
  modified_base (692)..(692): a, c, t, g, unknown or other
  misc_feature (692)..(692): n is a, c, g, or t
tcagacatacgcgtcacgaccggtgctcgatttagtcgagctctcagagagaaaggggctgagagaggagcccagccctgggatttttcaggttgtttttcattttggtgatcaggactgaacagagagaagtcaccagtggtagtttggctgagcgtgtcgtttcgtaggtgtacttaagtttaaaggtgtctagtgtgtaggtgcagtcgtggtgggtagtcggtggggggtagtcgtttcgggtacgacggtccggttcggggggtccctggtacggtcctccgttccgtggtccgacgtaccgtccgttcgtacggtcttaccgttaacgtttaataccgtaatttacgtcgacgttagcggtacggtacggtccgggtcccgtaccgcgggtacccgttacgggaacggggtaggccgggttagggtacgggttcggtacgtacgtggttacgttggttagggttggtacggttggaacgtttgggaccgtanaacgtacgtacgtaacgccgtacgacgtcggtacggtaccgggttcctacgactacgttcaacgtanaacggtacttaactaacaacgtaccacgtatacganacgtaanacgtaacagacctaagacgagtaccgaacgtanaaccgtagtacctatcgtacgtacgnggtcggagtcgatacgnaccggtancgtcgtacg

SEQ ID NO: 96685 - DNA, 871 bp, Homo sapiens
  misc_feature: GYAE6OF01E0AP3.22.52.E08.1.454.CMB.1.raw
  modified_base (240)..(240): a, c, t, g, unknown or other
  misc_feature (240)..(240): n is a, c, g, or t
  modified_base (865)..(865): a, c, t, g, unknown or other
  misc_feature (865)..(865): n is a, c, g, or t
tcagacatacgcgtcacgaccggtgctcgatttagtcgagctctcagagagaaaggggctgagagaggagcccagcccgtgggtatttttcaggttgtttttcattttggtgatcaggactgaacagagagaacgtcaccagtggtaggtttgggctgagcgttggtctttttcgtgtgtacttaagttttaaaggtgtccgagtgtgtaggtgcagcgtggtggtaggtcgggtggggnggtcgtttggacgacggtcccggttcggggggttccctaggacgtaccgttccgttccgtcggttcgaccgtacgtcccgttcgttaggtaacctttacccgttaaccgttttaacgaccttaagtttaacgtcgtacccgttagtacggtaccgggtccggtaccggggttcccgacccggacggttaccccggtaccggggaacggggtaacggggtcgtacgggggtacgggtttccggtacgtacggtacgggttccgtttgggtttagggtggggtttacgggtaggtaagggtttcgggtacggttacccgtaaacgttaacgttaaacccggtaaccccggaacggttaccgtaacccgggtttacccgggttaacgggtaaccccggggtccccgtttaaccacccggttaaccttacccgtaaccgaacggttaaccgaaaccttaaccgtaacccgtaaaaccgtaaacctaacccgttaaagttaactaacgtacgaaactaaaccgttagaaccgtacgtactacggaatacggacccgaagaacccggacggtacttaaacgtaccgtacgtaggacggacgggtacggtacgtagacgtacgagtcgacgngttacg

SEQ ID NO: 96686 - DNA, 537 bp, Homo sapiens
  misc_feature: GYAE6OF02HSCQ1.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtgcttttcttgtggctatttaaaaggtgtccagtgtgaggtgcagctggtggagtctgggggaggcttggtacagcctggggggtccctgagactctcctgtgcagcctctggattcacctttagcaattatgccatgagctgggtccgccaggctccgagggaaggggctggagtgggtctcgagctgttagtggtggtgagtggtggcacatactacgcagactccgtagaacgggccggttcaccatcctaccagacgacaattccaaagaaccaccctaataatatagacaaaatgaaacagccctagagacgaccgaaagaccgaccggccgtaataccgtaacgtgtgacggaagggcgttagagtagccgagcagtcg

SEQ ID NO: 96687 - DNA, 511 bp, Homo sapiens
  misc_feature: GYAE6OF02FRNOW.22.52.E08.1.454.CMB.1.raw
  modified_base (383)..(383): a, c, t, g, unknown or other
  misc_feature (383)..(383): n is a, c, g, or t
  modified_base (434)..(434): a, c, t, g, unknown or other
  misc_feature (434)..(434): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggcttttcttgtggctatttaaaaggtgtccagtgtgaggtgcagctggtggagtctgggggaggcttgggtacagcctggggggtccctgagactctcctgtgcagcctctggattcaccttttagcaattatgccatgagctgggtccgccaggctccgagggaggggctggagtgggtctcagctgttagtggtggtgagtgggtggcacatactacgcagactccgngaagggccgttcaccatctccagagacaattccaaagacaccctatatatnacaaatgaacagcctgagagaccgaagacacggcctatactacgtgtcgacgaagggcgtagacgtagcgagcagtc

SEQ ID NO: 96688 - DNA, 535 bp, Homo sapiens
  misc_feature: GYAE6OF02HQE6K.22.52.E08.1.454.CMB.1.raw
  modified_base (304)..(304): a, c, t, g, unknown or other
  misc_feature (304)..(304): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtgcgttttctagtggctattttaaaaggtgtccagtgtgaggtgcagctggtggagtctgggggaggcttgggtacagcctggggggtccctgagactctcctgtgcagcctctggattcacctttagcaattatgccatgagctgggtccnccgaggctccgagggaaggggctgggagtgggtctgagctgttagtggtggtgagtggtggcacatactacgcagactccgtgaacgggccgttacacctatcctccagagacaattaccaaagaaccaaccctaataactatacgactaaagtacgaacagccctagagacggaccgaaagaccacggcctaatactactgtcgacggaagggctagatagcagcgatcg

SEQ ID NO: 96689 - DNA, 538 bp, Homo sapiens
  misc_feature: GYAE6OF02IZ7HI.22.52.E08.1.454.CMB.1.raw
  modified_base (362)..(362): a, c, t, g, unknown or other
  misc_feature (362)..(362): n is a, c, g, or t
  modified_base (516)..(516): a, c, t, g, unknown or other
  misc_feature (516)..(516): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtggcttttcttgtggctattttaaaaggtgtccagtgtgaggtgcagctggtggagtctgggggaggcttggtacagcctggggggtcccctgagactctcctgtgcagcctctggattcacctttagcaattatgccatgagcgtgggtccgccaggctccgagggagggctggagtgggtctcagctgttagtggtggtgagtggtgnacatactacggcagaccgtccgtaggaacgggcccggttcaccatccgtaccaggagaccaattaccaaacgaaccaccctatatactcgacaaatcgaacacgcctagagacgccgaaagaccacggcctataccgtgtcgtggacgaagggntagagtagcgacgacgtagtcg

SEQ ID NO: 96690 - DNA, 656 bp, Homo sapiens
  misc_feature: GYAE6OF02IRM99.22.52.E08.1.454.CMB.1.raw
  modified_base (265)..(265): a, c, t, g, unknown or other
  misc_feature (265)..(265): n is a, c, g, or t
  modified_base (285)..(285): a, c, t, g, unknown or other
  misc_feature (285)..(285): n is a, c, g, or t
tcagacatacgcgtcacgaccggtgctcgatttagtcgagctctcgagagagaaaggggctgagagaggagcccagccctgggattttcaggtgttttcatttggtgatcaggactgaacagagagaagtcaccatggagtttgggctgagctggctttttcttgtggctattttaaaaggtgtccagtgtgaggtgcagctggtggagtcgtgggggagcttggtacagccgtgggggtccctgagactctcctgtgcagcctntggattcacttagcaattangccatgagctgggtccgcgaggcctccgagggacgggcgtgggagtgggtactcgagtcgtgttaggtggtggtgtagtggtgcactagtacctacgctacgtactccggtaggaacgggtcccggtttacaacccgtagtcccgtaccgaaggacgaacctaacttcccgaaaaggtaacccacccttaattaatacgtagaaccaaaagttcgaaaaccgtacgtacccttaaggaacgggaacgtaacccggaaaacggtacccgaaccggggtaccgttaacgttaacccgtaacgtttcggtaggaacccgggttaaagggggcccttagggaacgttacggacccgaaggtcccgaaggttaccg

SEQ ID NO: 96691 - DNA, 598 bp, Homo sapiens
  misc_feature: GYAE6OF02I0F5S.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtggcttttcttgtggctattttaaaggtgtcagtgtgaggtgcagctggtggagtcgtgggggaggcttgggtacagccgtggggggtccctgagactctcctgtgcagcctcgtggattcacctttagctaattatgccatgagtcgtgggtccgccgaggcctccgaggggagggcgtggaggtggtctcgagtctgtagtggtggtgagtggtgcactatacacgcagacctccggaggaaccgggtcccgttacacccgtatccctaccgaagaacgaacctaacgttaacccaaaagtaaccctaacccttaataacgtactaggaactaaaagtacgaaaccgacgtcccgtaagaacggaacgacccggaaacgaccgacggtacctaagtacctacgtggtacgcggtaagggtcgtagacgtaggacagacagttcg

SEQ ID NO: 96692 - DNA, 552 bp, Homo sapiens
  misc_feature: GYAE6OF02HPTXG.22.52.E08.1.454.CMB.1.raw
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
  modified_base (456)..(456): a, c, t, g, unknown or other
  misc_feature (456)..(456): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtggcgttttctagtggctatttaaaaggtgtccagtgtgaggtgcagctggtggagtctgggggaggcttggtacagccgtggggggtccctggagactctcctgtgcagcctctggattcacctttagcaattatgccatgagctgggtccgccgaggctccgaggggaacgggctggagtgggtctcagctgttagtgggtggtgagtgggtggcacaatactacgcagactccgtgaacgggtccgttcacntctcaagngacatccaaagtaccacctatactatcgactaaatgaaacngtcctgaagacggaccgaaagccgaaccgggtaccgtattaaccgtcgttggtacggacggaacgggtcgttagactaggcgaagtccgagtaccg

SEQ ID NO: 96693 - DNA, 520 bp, Homo sapiens
  misc_feature: GYAE6OF02I2Z2I.22.52.E08.1.454.CMB.1.raw
  modified_base (451)..(451): a, c, t, g, unknown or other
  misc_feature (451)..(451): n is a, c, g, or t
  modified_base (493)..(493): a, c, t, g, unknown or other
  misc_feature (493)..(493): n is a, c, g, or t
tcagacatacgcgtcacgaccggtgctcgatttagtcgagctctcagagagaaaggggctgagagaggagcccagccctgggattttcaggtgtttcatttggtgatcaggactgaacagagagaagtcaccatggagtttgggctgagctggcttttcttgtggctatttaaaaggtgtccagtgtgaggtgcagctggtggagtctgggggaggcttggtacagcctggggggtccctgagactctcctgtgcagcctctggattcacctttagcaattatgccatgagcgtggtccgcaggctccgaggggaagggctgggagtgggtctcgagctgttagtggtggtgagtgggtggcacgatacgacgcagacctccggtagaacgggtcccggttacaccatctccagagacaacttccaagaacaccctatatatagacaatanaacagcctgagacgaccgaagacgacgcgtaatactactagnggacggaaggcgtagatagcagcagtc

SEQ ID NO: 96694 - DNA, 680 bp, Homo sapiens
  misc_feature: GYAE6OF02IBUYH.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggctttttcttgtggctattttaaaaggtgtccagtgtgaggtgcagctggtggagtctgggggaggcttggtacagcctggggggtccctgagactctcctgtgcagcctctggattcacctttagctaattatgccatgagctgggtccgcaggctccgagggagggctggagtgggtctcgagctgttagtggttggtgagtggtggcacatacgtacgcagtacctccggtaggaacggggtcccggtttacaacccgtacttccgtaccgaaggaacggaacctaaactttaccccgaaaaggtaaacccctaaccccgttattaaactaactacggaacctaaaaagttacggaaaccaacggtccccgttaagggaaacggaccggaacccggaaaacggtaacccgaaccggggtaccccgttaaagtttaacccgttaaccgttagggtacggacccgggtaaaagggggtccgtttaaggaacgttaaccggaccgaacggtacccgtaggttacccg

SEQ ID NO: 96695 - DNA, 637 bp, Homo sapiens
  misc_feature: GYAE6OF02IXJ53.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggcttttcttgtggctattttaaaaggtgtccagtgtgaggtgcagctggtggagtcgtgggggaggcttggtacagccgtggggggtccctgagactctcctgtgcagcctctggattcacctttagcaattatgccatgagcgtgggtccgccgaggcctccgaggggaaggggctgggagtgggtctcgagcgttggttaggtgggtgggtgtagttgggtggcactagtacgtacgcacgaccgttcggtaggaacggggtcccggttacacctatccctaccgaaggacgtaaccaaacttacccgaaacgtaaccacccttaataactactacggaacaaaacttagaaacctaggcctagaacggaacgacccggaaaggaacccgtaccgggacccgttaactaaccgttacgttacggtacggtacgggaacggggtcgtaaggacgttacggaccgaacggtacgacggttaccg

SEQ ID NO: 96696 - DNA, 534 bp, Homo sapiens
  misc_feature: GYAE6OF02JFWI2.22.52.E08.1.454.CMB.1.raw
  modified_base (434)..(434): a, c, t, g, unknown or other
  misc_feature (434)..(434): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtggcttttctgtggctatttaaaaggtgtccagtgtgaggtgcagctggtggagtctgggggagcttgggtacagcctggggggtccctgagactctcctgtgcagcctctggattcacctttagctaattatgccatgagctggtccgcaggctccgagggagggctggagtgggtctcgagctgttagtggtgtgagtggtggcacatactacgcagacctcgtgaacgggcccgttcaccatctccgagagacaattccaaagaaccaccctataatangactaaagtagaacagcctagaagaggacccaaagtaccaacgggcccgtaataccgtaactcggtagaccggaagggtctaggactagcaggcaggtcg

SEQ ID NO: 96697 - DNA, 620 bp, Homo sapiens
  misc_feature: GYAE6OF02F48OH.22.52.E08.1.454.CMB.1.raw
  modified_base (156)..(156): a, c, t, g, unknown or other
  misc_feature (156)..(156): n is a, c, g, or t
  modified_base (323)..(323): a, c, t, g, unknown or other
  misc_feature (323)..(323): n is a, c, g, or t
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcggtgngtttctaggtggctatttaaaggtgtcagtgtgaggtgcagctggtggagtctgggggaggcttggtacagcctggggggtccctgagctctcctgtgcagcctctggattcacctttagctaattatgccatgagctgggccgcaggctccgagggagggctaggngtgggtctcagctgttagtggtgtgngtggtcggcagattacgacgnacgtaccgtcggtacgtaacgggtcccggtttacaccctaagtccttacccgaggaaacgacctaaacgtttaaccccaaaaggtaacccaaccccttaaagtaacttaattacggaaccgaaattaacgtaacgtaaccgacccgttagaacggaacggaccgaacgaaccgaccggtacgtaacgtaaccttacgtacgttacggacggaaggtacggtacgtagtacggacgacgtacgtagtacgg

SEQ ID NO: 96698 - DNA, 567 bp, Homo sapiens
  misc_feature: GYAE6OF02GSKPX.22.52.E08.1.454.CMB.1.raw
  modified_base (468)..(468): a, c, t, g, unknown or other
  misc_feature (468)..(468): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggctttttcttgtggctattttaaaaggtgtccagtgtgaggtgcagctggtggagtcgtgggggaggcttggtacagccgtggggggtccctgagactctcctgtgcagcctctggattcacctttagctaattatgccatgagcgtcgggtccgccgaggcctccgaggggaacggggctgggaggtgggtctcgagtcgttggtttaggtgggtggtgagttgggtggcacatactacgcagacctccggtaggaacgggtccgttacacctatcctccgagagactaacttccaaagaaccacctatatatnaactaaatcgaacacgtacctaggaacgacggaccgaaagaccgacggcctaataccgtctaggtggacggaagggtcgtagacgtagccgagcacgtc

SEQ ID NO: 96699 - DNA, 676 bp, Homo sapiens
  misc_feature: GYAE6OF02J1UNG.22.52.E08.1.454.CMB.1.raw
tcagacatacgcgtcacgaccggtgctcgatttagtcgagctctcagagagaaagggacgtgagagaggagcccagccctgggatttctaggtgtttctatttggtgatcaggactgaacagagagaagtacaccatggagtttgggctgagctggtcttttcttgtgctatttaaaggtgtcagtgtgaggtgcagctggtggagtcgtgggggaggcttagggtacaggccgtgggggggtcccctggacgactcgtcctggtgcagcctcgtggtacttcacctttaagctaaactttagtgaccatggagctggggtcccgcaggcctccgagggacggggtctagggagtgggtactcgaggtcctggttaggtggtggtgtacgtgggtcggctaactacgtctacggctaagaccgtccgtacgggaacgggtccggttacctaccgattccgtacctaggaacgtactaaaccgtacgtaaacgacccgtaacctagtactaaactcgaaacctaaaacttggaaaacctacggtaccctacggtaacggaccggaaccgaaacggtacgacccgggtacccgttaacgttaaccgtccggtagggtcggtaacccgggaaaggggtcctacgggtaagtaacggtccacgggtaccgattaacccgg

SEQ ID NO: 96700 - DNA, 633 bp, Homo sapiens
  misc_feature: GYAE6OF02FPISG.22.52.E08.1.454.CMB.1.raw
  modified_base (503)..(503): a, c, t, g, unknown or other
  misc_feature (503)..(503): n is a, c, g, or t
  modified_base (622)..(622): a, c, t, g, unknown or other
  misc_feature (622)..(622): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtgcgttttctaggtggctattttaaaaggtgtccagtgtgaggtgcagctggtggagtctgggggaggcttggtacagcctggggggtccctgagactctcctgtgcacgcctctggattcacctttagcaattatgccatgagcgtgggtccgccgaggcctccgaaggggtaacggggctagggagtcgggtctcagtctgttagtgggtggtgagtggtgctacgatacgtacgcacgacgtccgtaggaacgggtccggttacaccgtactcctaaccaggaacgaaccaacttaccgaaacgaaccctaacccgttataactaatacgaataaacgtagtaaaccncgaaccttgaaacgacgaaccgaaacgtaccgaacccggtccgttaaatacccgttaaggtggtaccggtaacgggtaacggggtacgttacgaacgttaccgggaactaccgggtacncgtttaaccgg

SEQ ID NO: 96701 - DNA, 571 bp, Homo sapiens
  misc_feature: GYAE6OF02FHX6Q.22.52.E08.1.454.CMB.1.raw
  modified_base (183)..(183): a, c, t, g, unknown or other
  misc_feature (183)..(183): n is a, c, g, or t
  modified_base (288)..(288): a, c, t, g, unknown or other
  misc_feature (288)..(288): n is a, c, g, or t
  modified_base (307)..(307): a, c, t, g, unknown or other
  misc_feature (307)..(307): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtgtcgtttctaggtcggctaatttaaaaggngtcagtgtgaggtgcagctggtggagtctgggggagcttggacagccgtggggggtccctgagctctcctgtgcagcctctggattcaccttttagctaatttancgccatgacgcttgggccnccagctccgaggggaacgggctgggagtgggtctcgaggtctggttgtggtgtcgagtggtgcagatactacgcagctccgagacgggcccgttcacctatcaccgagacactaattccaaagacctaaccctataactagtcgaacctaaatacgaaacacggtaccagaagaccgaaccgtaagccgaaccgggtactaactaccttaacgtggaccgtcgggaaagggtccggtagtacgaacggccaaggccgagtccgg

SEQ ID NO: 96702 - DNA, 652 bp, Homo sapiens
  misc_feature: GYAE6OF02IWP0A.22.52.E08.1.454.CMB.1.raw
  modified_base (302)..(302): a, c, t, g, unknown or other
  misc_feature (302)..(302): n is a, c, g, or t
  modified_base (634)..(634): a, c, t, g, unknown or other
  misc_feature (634)..(634): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtctttttcttgtggcttattttaaaaggtgtccagtgtgaggtgcagctggtggagtcgtgggggaggtcttgggtacaggccgttgggggggtcccctggaggactcgtcctgtcgcacgcctctggattcacctttagctaattangccatgagtctgggtccgcctacggctccgagggaagggctaggagtgggtctcgagcgtgtaggtggtggtgagtggtggcacgtatacgtaacgctagacgtcggaggaacgggtccggtaccaacgtacgtccaccgtaagacgaacgtaactttaaccaaacggtaaaccctaacccgttaatacgtaactacggtaaactaaaacttacgaaacgtaccgtaccgtaaggaaacgaccgaaccggaaacgtacgacccggttaccgattaacccgtacggtacgtacggaaccgggaaacgggtgttacggtaacgtacggaaccgngtacccggaagtttccgg

SEQ ID NO: 96703 - DNA, 658 bp, Homo sapiens
  misc_feature: GYAE6OF02GQ5NY.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggctttttcttgtggctattttaaaaggtgtccagtgtgaggtgcagctggtggagtcgtgggggaggcgttggtacagccgtggggggtccctgagactctcctgtgcagcctctggtattccacctttagctaattatcgccatgagctcgggtccgccgaggcctcgaggggaaggggccgtgggaggtgggtctcgagcgttggttaggtggttggtggagttgggtcggacacgtaattaaccgtacgacgtacggaaccgttccggtaggaaaccggggtcccggttacacccgtatccctaccgaagacgaacctaacttaccaaagtaacccacccgttaataacgtacgtacgtaacaaaagttcgaaaccgagtacccgtagaaacggtaaccgaacccggaaaacgacccggtaaccggtacccgtaacgttacgttaaccggtggtacggacggaacggggtcgtagacggtacgacgacggtacgacgttacg

SEQ ID NO: 96704 - DNA, 693 bp, Homo sapiens
  misc_feature: GYAE6OF02JYKBX.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtcttttcttgtggctatttaaaggtgtccagtgtgaggtgcagctggtggagtcgtgggggaggtcttggtacagccgtgggggtccctgagactctcctgtcgcagcctcgtggtattcctacctttagactaattatcgaccatgagcgtcgggtccgccgaggcctccgaaggggacggggtctgggaggttcgggtctcgacgtgttggttaggtgggtggttggagtgggtcgcacgtatacgtacgcgagtacgtccggtaggaacgggtcccggtttcacccgtaacgttcctaccgaagtacggtaactaaccttaccgaaaacgtaccctaaacccgttattaaacgtaactacgtaacctaaaataccggaaacctacggtacccgtaaggtaacgaaccgggtaaacccgaaaacgggaaccgtaacccgggtccttaaacgttacccgtaacgttcgggtaacgggacccgggtaaggggttccctaaggggtaactaaccggtacggacggtacgtacgggtaccg

SEQ ID NO: 96705 - DNA, 577 bp, Homo sapiens
  misc_feature: GYAE6OF02IFQRA.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggctttttcttgtggctattttaaaaggtgtccagtgtgaggtgcagctggtggagtcgtgggggaggcttggtacagccgtgggggtccctgagactctctgtgcagcctctggattcacctttagcaattatgccatgagctgggtcccgcaggctccgagggaagggctggagtggtctcagcgtgttagtggtggtgtagtggtggacacatactacgcacgcgtacgtaggaacgggtcccgttacaccactcctaccagacgacaattaccaaagaaccaccctaatatatagaccaaatacgaacacgtccgagaacgtacgaccgaaacgaaccaccggtaccgtaacttaaccgtacgttcgggacgaacgggtacgggtacgtacggtacgtaaggacgacggacgaggttaccg

SEQ ID NO: 96706 - DNA, 588 bp, Homo sapiens
  misc_feature: GYAE6OF02JHRL9.22.52.E08.1.454.CMB.1.raw
  modified_base (178)..(178): a, c, t, g, unknown or other
  misc_feature (178)..(178): n is a, c, g, or t
  modified_base (306)..(306): a, c, t, g, unknown or other
  misc_feature (306)..(306): n is a, c, g, or t
  modified_base (363)..(363): a, c, t, g, unknown or other
  misc_feature (363)..(363): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtgcgtttctagtggctatttaaaggngtcagtgtgaggtgcagctggtggagtctgggggagcttggtacagcctgggggtccctgagactctcctgtcgcagcctcgtggacttcaccgtttagcctaagttatcgccattgagctgggtccncaggctccgagggaagggctaggagtgggctcgagcgtgtacgtggtggtgagtggngtacacgtatactacgcagaccgtcgagaacgggtccgttacacgtactcgtacagacacacgttaccaagtaaccacccgtaatacgtatggaactaagacgaacgtacgcgtagacgtacgacccgtaaagaccgtaaccgggtaccgttaacgacgttaacgtcgtacggtaccggtaagggtccgtacggtacgaacgtacgacggtaccgaggttaccgg

SEQ ID NO: 96707 - DNA, 619 bp, Homo sapiens
  misc_feature: GYAE6OF02GANP5.22.52.E08.1.454.CMB.1.raw
  modified_base (269)..(269): a, c, t, g, unknown or other
  misc_feature (269)..(269): n is a, c, g, or t
  modified_base (349)..(349): a, c, t, g, unknown or other
  misc_feature (349)..(349): n is a, c, g, or t
  modified_base (566)..(566): a, c, t, g, unknown or other
  misc_feature (566)..(566): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtggcttttcttgtggctattttaaaaggtgtccagtgtgaggtgcagctggtggagtcgtgggggaggcttggtacagccgtggggggtccctggagactctccgtgtgcagcctcnggtattccacctttagcctaattatgccatgagctgggtccgccgaggctaccgaggggaacgggctgggagttgggtcncgtagcgttagttaggtggtggtgagttgggtgcactagtaccgtacgctaacgacgttccggaggaacgggtcccggtacaacccgtagtcctaccgaagacggtaacctaacgttacccaaagtaacccaaccttaagtaactatcgaactaaagtacgaacacgtaccgtagaacggacgacgaaacgacgaccggtacgtaacgtactaacgngttacggacccggtaagggccgttaaggactaggacccaggtccaaggttccg

SEQ ID NO: 96708 - DNA, 609 bp, Homo sapiens
  misc_feature: GYAE6OF02HBANW.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtgtcgtttctaggtggctatttaaaggtgtccagtgtgaggtgcagctggtggagtcgtgggggagtcgttggtacaggccgtggggggtccctgacgactcgtcctgtgcagcctctggacttcgacctttagctaattatgccatgagcgtggtcccgccgaggcctccgagggagggcgtggacgtgggtctcgagtcttaggtaggtggtggtgagttggtggcatatacgtacgacacgacgtccgtaggaaccgggtccgttccgaacctacgttccctcgaacgagtaacctaacgttaccgaaacgtaacctaacccttaattaacttagtacaactaaagtacgaacgagtaccgtagacgagtacccgaaagaccgacggtaccgtagtaccgtgtacggtacgacggaacgggtcgtacggtacgtacgacgtacgcgaagttccg

SEQ ID NO: 96709 - DNA, 774 bp, Homo sapiens
  misc_feature: GYAE6OF02F2DAI.22.52.E08.1.454.CMB.1.raw
tcagacatacgcgtcacgaccggtgctcgatttagtcgagctctcagagagaaaggggctgagagaggagcccagcccctgggattttcaggtgttttcatttggtgatcaggactgaacagagagaagtcaccatggagtttgggctgagctggcttttcttgtggctatttaaaaggtgtccagtgtgaggtgcagctggtggagtcgtggggggaggtcgttggtacgaggccgtgggggggtccctggagacctctcccgtgtcgcacgcctcgtggacttcctaccttttagctaaattatcgccagtgacgcgtcggggtcccgccgacggccgtaccgaaggggacggggcgtgggacggtcgggtctcgagtcgttaggttacggtgggtgggtaggtagttggggtcggtactaacgtacgtaaccgtacggcgtaacgtacccgttaccgggtagggaaaccggggttccccgttaccgaacccgttactaccgtccgaaacggtacgtaaaccctaaacgtttaaccccgaaaacggtaaaccccttaaaccccgttaaataacgttaacgaccgtaaactaaaacgttccggaaacctacggtaccgtaagggaacgtaacccgggaaaccgtaaacggaacccgaacccgggttaccgttaaacgtttacccgtaacggttcgggtaaccgggtaacccggggttaaggggtacccgttaggtaaccggaacggtccgaacggtaccggtaacggttcccg

SEQ ID NO: 96710 - DNA, 736 bp, Homo sapiens
  misc_feature: GYAE6OF02H606W.22.52.E08.1.454.CMB.1.raw
  modified_base (433)..(433): a, c, t, g, unknown or other
  misc_feature (433)..(433): n is a, c, g, or t
tcagacatacgcgtcacgaccggtgctcgatttagtcgagctctcaggagagaaaggggctgagagaggagcccagccctgggtattttcaggtgttttcgactttggtgatcaggacgtgaacagagagaagtcacctagtggtagtttgggctgagctggtctttttcttgtggtcttaattttaaaaggtgtccagtcgtgaggtgcagtcgtgggtggagtcgtgggggagtcgttggtacaggtccgtggggggtccctggacgactcgtccgtgtgacgtagtccttgtaggtacttcctacctttagactaattagtacacctatgacgtcggtcgggtccgaccgaggtcctaccggaggggtaacggggttcgtagggtaggttcggggtacctcgacgtcgttaggttaggtgggttggtagnggttagggtacgtacgtacgtaagttacgtaccgcgtaacgtacccgtccggtaaggaccgggtcccgttaccgaaccgtcgttacccgtacgtacgtacgtaactaacgttaaccgaacgtaaacccgtaccttaataatacgtacgtaacgtaaacgtacgtaacgtacgtaccgtagaacgtacggaaccgtaacgaaccgtaccggtacgttacgttacgttacgtaggttacgtaggtaacgtacgtaaccgtaaacgtcccgtaaccggtacgggtacccgggtaccttaaacccgg

SEQ ID NO: 96711 - DNA, 764 bp, Homo sapiens
  misc_feature: GYAE6OF02IQ6XG.22.52.E08.1.454.CMB.1.raw
  modified_base (232)..(232): a, c, t, g, unknown or other
  misc_feature (232)..(232): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtcttttcttgtggctattttaaaggtgtccagtgtgaggtgcagctggtggaggtcgttgggggaggcgttggtacgnggccgtggggggtccctgagtacctctccgtgtgcacgtccgttcgtggacttccgtaaccttttagactaatttactcggacctatgaggtcgtcgggttcccgaccgtacggcctaccggaacggggtaacggggtcgtaggggtacggttcgggtcctacgacgtcgttaggtttaggtggggttgggttaggtacggttgggttacgggaccgtaaccgtaacgtttaacccgtaccggtaccgtaacggtaccgttaccgggttaacgggaaccgggggtacccggttttacccgaaaccctacgtttcccgaccgaacgggaacgtaaccgtaaaccttaaccgaaaaccgtaaaccctaaccccgtattaaacttacgtacgaacctaaaagtacgtaacgacgtaccctaggaaaccgtacggaacccggaaataacccgaccgggtaccttaactaaccgttacgtacggtacggtaccggaaacgggtcgtacgaacgtccggaacgacgacgtagtaccgg

SEQ ID NO: 96712 - DNA, 618 bp, Homo sapiens
  misc_feature: GYAE6OF02F6E3G.22.52.E08.1.454.CMB.1.raw
  modified_base (388)..(388): a, c, t, g, unknown or other
  misc_feature (388)..(388): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtctttttcttgtggcttaattttaaaaggtgtccagtgtgaggtgcagctggtggagtcgtgggggaggcgttggtacagccgtggggggtccctgagactctcctgtcgcacgcctcgtggtacttcgaccttttagctaattatgccatgagcgtgggtcccgccgaggcctaccgaggggaacgggtctgggagtgggtactcgagcgtgttaggtggtggtgatgggtgnacataaccgtacgacacgactccggtaggaaccggggtccgttaccgaaccgtactccgtaccgaacgagaacctaaacttacccaaagaaaccctaacccgtataactatacgaactaaaagtcgaaacacgtccctagaacgacgaaccgaagtacccgagtaccctagtaccgtaacgtacgtcggaacggtacggcgtaggacttaacggacgacgtacgagtacg

SEQ ID NO: 96713 - DNA, 738 bp, Homo sapiens
  misc_feature: GYAE6OF02I4TJ9.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggctttttctgtggctattttaaaaggtgtccagtgtgaggtgcagctggtggagtcgtgggggagcttggtacagccgtggggggtccctggagactctcctgtgcagcctctggattcctacctttagctaattatgcctatgagcgtgggtccgccgaggcctccgaaggggaaggggcgtgggaggtgggtcctacgaggtcgtggttaggtggggttgggtgtagtgggtggaccaacgtagtaccgtacggacctaacgtaccgtccgggtagggaaaccgggggttcccggtttaccaaaccccgtagttacccgttacccgaaaggtacgaaacccttaaacgtttaaccccgaaaacgtaaaccccttaaacccttaagttaacttaacgtaccggaaacctaaaaagtccggaaaaccacggtcccttaggggaaagtaaccggaccccggaaaagtacccggaacccggggtccttaaacgttacccgttaacgtcgggttaacgggaaccgggtaaagggggtccttaagggtaacgttaaccggcccgtaagggacccgtaaggttaccccgg

SEQ ID NO: 96714 - DNA, 749 bp, Homo sapiens
  misc_feature: GYAE6OF02F57W1.22.52.E08.1.454.CMB.1.raw
  modified_base (387)..(387): a, c, t, g, unknown or other
  misc_feature (387)..(387): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagttgggctgagcgtggtcttttcttgtggctatttaaaggtgtccagtgtgaggtgcagctggttggagtcgtgggggaggcttgggtacaggccgtggggggtccctggagtactcgtcctggtcgcacgtcctcgtggtcttcacctttaggcctaaattagtcgacctagtacgagtccggtcggggtcccgcccggaggccgtccgaaggggaacggggtctaggggaggttcgggtacgtacgngtacgtggttacgggtgggttcgggtggacgtgggtaggccaagtacgtaccgtacgaccgtacgacgttccgtgggaaaccggggtcccgttacaaccctattcccgactacggacgaacctaacttaacccgaaacgaaaccctacccttaattaactacgttagaaacctaaacgtagtaaacccgaacggtccttaacgggaaagaaccggaacccggtaaaacgaacccgggtaaacccgggttcccgttaaacctaacgggttaaccggttaccggttaacggggtacccggtaaacggggttcccgggtaagtaacggttaaccggccggaaaccgttaccggaccggtttaacg

SEQ ID NO: 96715 - DNA, 802 bp, Homo sapiens
  misc_feature: GYAE6OF02JDO7C.22.52.E08.1.454.CMB.1.raw
  modified_base (252)..(252): a, c, t, g, unknown or other
  misc_feature (252)..(252): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtctttttcttgcggcttaattttaaaaggtgtccagtgtgaggtgcagcgtgggtggagtcgtgggggagtcgttggtacaggccgtggggggtcccngacgactctcctgtcgcacgcctcgtggtacttccgtacctttagactaaatttatcgacctagtcgacgtacggtcgggtcccgaccgtacgggcctacccggaagggggacggggtccgtggggaggtcgggtcctcgaggtcgttggtttacggtggggttggtaggtaggttgggtacggacctaacgtaacgttaacccgtaaccggaccgtaacggtacccgttcccggggtagggtaaaccggggttccccggttaccaaacccgtacgttcccgtacccgtaaggaaccggtaaaccctaaacgtttaacccgaaaacgtaaaccccctaaccctttaagtaaccttaacgtacggtaaacctaaaagttaccggaaaacctacgtacccgttaagggaaccgaaccggtaaacccggaaacgaaccgtacccgggtaccttaacgtaaccggttaccggtaggtaacccgggtaacgggtaaacggggtccgttaacgggtaacgtaaccggacgtaaccgggtacctaacggttacccgg

SEQ ID NO: 96716 - DNA, 616 bp, Homo sapiens
  misc_feature: GYAE6OF02FSHNO.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggctttttcttgtggctattttaaaaggtgtccagtgtgaggtgcagctggtggagtcgtggggggaggcttgggtacagccgtggggggtccctggagactctcctgtgcagcctctggattcaccttttagctaattatgccatgagctgggtcccgccgaggcctccgaggggaaggggctgggaggtgggtctcgagtctggttaggtgggtggtgagtggtcggcacgtatactacgcagaccgtccggtgaacggggcccggttacaccgtatcctaccgagaacgacaacttaccaaagaacctaccctaatactatacgactaaagtacgaaacgacgtaccgtaggaacgaacggtacccggaaagaacccgtaccggtaccgttaactaaccgtacgtaggtacgggacggtaacggggtcgttaaggacgttacggacacggacgaggtaccg

SEQ ID NO: 96717 - DNA, 761 bp, Homo sapiens
  misc_feature: GYAE6OF02I0XPL.22.52.E08.1.454.CMB.1.raw
  modified_base (182)..(182): a, c, t, g, unknown or other
  misc_feature (182)..(182): n is a, c, g, or t
  modified_base (333)..(333): a, c, t, g, unknown or other
  misc_feature (333)..(333): n is a, c, g, or t
  modified_base (355)..(355): a, c, t, g, unknown or other
  misc_feature (355)..(355): n is a, c, g, or t
tcagacatacgcgtcacgaccggtgctcgatttagtcgagctctcagagagaaaggggctgagagaggagcccagccctgggattttcaggttgttttcatttggtgatcaggactgaacagagagaagtcaccatggtagtttgggctgagcgtgtcgtttctgtgtctaagtttaaagtntcagtgtgaggtgcagtcgtggaggtggtcggtgggggacgtcgttggtacgacggtccgtgggttcggggtcccgtggaacggtacctccgtccgtggtacgccgtacggtcccttcgtaggtacttccgtaaccttagtacttaattcncgacagtcgcgtcgtcgggccncggtacgtccggtacggaaggggtacgggtcgtgggtcggtcggtacgacgtcggtcgttggttagggtggtggtacgtggtggtcgacgacgtcgtaaccaccgtagtaccggaccgtaccggtagggaccggttaccgttaccgaccgtacttaccgaccggtacgaaccggaaccttaccaacggtaaactaaccccgtaccttagtaacgttaaccgaacgtaaacaaacggttacaaaccgtcggttaaccgagtaaaccggcgtaaaaccccggtaaagcccggtaaccgggttaaccggttaacccttaaccggtaaaccggttgggaacccggggtaccggggttaaacggttaccggtggttaaaccgcgggtaaacgtcccggagtttacccgggg

SEQ ID NO: 96718 - DNA, 712 bp, Homo sapiens
  misc_feature: GYAE6OF02HHOB0.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcgtgtcgttttctagtcggctaattttaaaaggtgtccagtgtgaggtgcagctggtggacgtcgtgggggagcgttggtacaggtccgtggggggtcccctggacgaccgttctccgtgtcgaccgacgcccttccgtggtaacttcctaaccgttttacggactaactttagtcgcctagtgacggtcgttacggggttccgtagacggccgttaccggaagggggaacgggtcgtacgggtaggttcgggtccttagacggttcgttaggttaggttggggtcggtagtagtgggtacgtctaacgtagtaaccgtacgacacgtacctcgggtaacgggaaccgggtccggtaccaccgtacgttccgacgtagacgtactaacgttaaccgaaaccgtacctaacccgttagtaactcgaacgtaacaaacgtacggtaaacacggtacctaggaacgacgtaaccgaaacgacccgtaccgggtaccgttaacgtaccgttaacggcggtacgaacgggtaacgtcggacgttgaaccgtcacgtacgagttacgg

SEQ ID NO: 96719 - DNA, 849 bp, Homo sapiens
  misc_feature: GYAE6OF02FNA22.22.52.E08.1.454.CMB.1.raw
tcagacatacgcgtcacgaccggtgctcgatttagtcgagctctcagagagaaaggggctgagagaggagcccagcccctgggattttcaggtgttttcatttggtgatcaggactgaacagagagaagtcaccatggagtttgggctgagctggtctttttctgtggtcttattttaaaaggtgtccagtgtgaggtgcagctgggtggagtcgtgggggaggtcgtttgggtacgagtcccggtcggggggtcccctggacgtaccttccgtcctggtcgcacgccgtcgtggtacttcctaccgttttagctaatttacgtcgtacctagttacggaacgtcggttccgggtcccgtacccgtagggtcccgtacccgggaagggggaaaccgggggtcggttacggggtacgggttcggggttccttaaccggtcggttccgttaaggtttagggttcggggttagggttaggtaacgggtttcgggtaacgggtacctaaacgtaaccgttaaccgttaaccgggtaccctaacgggtaacccggtaccgggttaacggggtaaaccggggtcccggtttacccgaaacccgtaaccgttaccgtaacccggtaaacggtaactaaaacccgtaaaccgtttaacccgaaaaaccggttaaacccctaaccgtttaagtaaccgttaacgtacgtaaaccgtaaaacggtacgtaaacccgagtaccgtaggaaccgtacggaacccggaaacgtaccgtacgggtaccttagtaacccggttgtaaccgtacggaacgggtaacgggtgttaaccggaagtcgacgaggtaccgtagttaccg

SEQ ID NO: 96720 - DNA, 693 bp, Homo sapiens
  misc_feature: GYAE6OF02I3B8B.22.52.E08.1.454.CMB.1.raw
  modified_base (156)..(156): a, c, t, g, unknown or other
  misc_feature (156)..(156): n is a, c, g, or t
  modified_base (165)..(165): a, c, t, g, unknown or other
  misc_feature (165)..(165): n is a, c, g, or t
  modified_base (178)..(178): a, c, t, g, unknown or other
  misc_feature (178)..(178): n is a, c, g, or t
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (358)..(358): a, c, t, g, unknown or other
  misc_feature (358)..(358): n is a, c, g, or t
  modified_base (418)..(418): a, c, t, g, unknown or other
  misc_feature (418)..(418): n is a, c, g, or t
tcagacatacgcgtcacgaccggtgctcgatttagtcgagctctcagagagaaaggggctgagagaggagcccagcccctgggattttcgaggtgttttcatttggtgatcaggactgaacagagagaagtcaccatggagtttggctgagcgtgngttctaggngtctatttaaggngtcagtgtgagtgcagcgtggcggagtcgtagggggagtcgttaggtacaggtccgtgggggtccctgganaccttcnccgtgtcgacacggtccctgtacggtattacaacccttttagacttaatttaagtcgaccagttacggaggtccttccggggtcccgaacgtcgggtacccncggaacgggaacgggccgttggaggtcgggtctacgacgtcgttggttacgtggtggttnacggttggcggactacaccgtacgtacgcgaacggtacttccggtaggaacgtaccgtacaaccgtcacccgtaagcgaaacgtaccaacgttaccgaaaacgacttacccaagttacgtaagtaccgaactaaagtccgtaaacgtaccgtccgaaaggtcgaaccgtaaaccggaaacgtaccgtaccggacgttaacgttaccgggtacctttaggacgggacccggtaaggtcgttcggagttaaggcccgaaacggtcggaacgttacgg

SEQ ID NO: 96721 - DNA, 605 bp, Homo sapiens
  misc_feature: GYAE6OF02HSSGC.22.52.E08.1.454.CMB.1.raw
  modified_base (178)..(178): a, c, t, g, unknown or other
  misc_feature (178)..(178): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (285)..(285): a, c, t, g, unknown or other
  misc_feature (285)..(285): n is a, c, g, or t
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
  modified_base (322)..(323): a, c, t, g, unknown or other
  misc_feature (322)..(323): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagcggtgtgttctaggtgctatttaaaggngtcagtgtgagtgcagtctggtgagtcgtggggagtcttggcagccgtgggggtcctagcnctctctgncgagcctntgattcaccttgntattatnacgagtgcgngttcggacgccagctcgaaggacggntagggngtgcnngtgtagtgtgtgtagtgtgtacgacacgtacgtaacgcgacgtacgtaccgtcggtacggtacggtcgtaccgacgtacgtccacgtaacgtacgtaactaacgtaccgaaacgtaccctaaacttagtaaccgtataacgtaacgtaacgtaacgtaacgtacgtaacgtaacgtacgtaacggaacgaaccgaaccgtaccggtaccgtaacgtaacgtacgtacggtacggtaacggtacggtacggtacgtacgtaacgacggacgtacgtacgtacg

SEQ ID NO: 96722 - DNA, 742 bp, Homo sapiens
  misc_feature: GYAE6OF02F765S.22.52.E08.1.454.CMB.1.raw
  modified_base (588)..(588): a, c, t, g, unknown or other
  misc_feature (588)..(588): n is a, c, g, or t
  modified_base (598)..(598): a, c, t, g, unknown or other
  misc_feature (598)..(598): n is a, c, g, or t
tcagacatacgcgtcacgaccggtgctcgatttagtcgagctctcagagagaaaggggctgagagaggagcccagccctgggattttcaggtgtttcatttggtgatcaggactgaacagagagaagtcaccatggagttggctgagctggtctttttctgtgcttaatttaaaggtgtccagtgtgaggtgcagctggtggagtcgtgggggacggcttggtacaggccgtcgggggtccctggacgactcctccgtgtgcgacgtcctctggatttccaaccttttagacctaatttagtcgacctagtggaacgtcgtacggggttccccgccgaacggcccgttaccggaagggggtaacggggcgttaggggtacgggttacggggttcctacggaaccgttccgttagggtttaaccgggtggggttacgggtacggtacggtttggggttcggaccgaacgtaagtttaacccgtaacggaccgtaacgtacccgttacggtacggaaacgggtccccgtttaacacccgtatcccgtacgaagacgaactactaccgaaacgtaacccacttaagatagngaactaaagngaaaccgtgaacccgtagaacgacggtaccgaaacgtacccgtaccgggtcccttaaagtaccgttaaccgtaggttaccggaaccgggtaacggtacccgttaaggacgttaaccggaccgtaaggtaccgtaccggttaccg

SEQ ID NO: 96723 - DNA, 809 bp, Homo sapiens
  misc_feature: GYAE6OF02JBBZC.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagttgggctgagctggctttttctgtggctattataaaggtgtccagtgtcaggtgcagctggtggcgtcgtgggggaggtcttggtcaagccgtgggacgggtccctgacgactcctcctgtgcacgtcctcgtggtaccttccccttactagtgtaccttcgtaactatacggtaattggacttcccgaccgacggtccgtaccggacgggggaacggggtcgtagggtcgggttaggggtttacgaacgttactaaggtttacgggtagggtttaacggttagggttttaaatttttaaaacgtaacggtacgtaaccgttaacgttccggttagggttaacggggtaaccggggtaccgtaacgtttacccgtaaccccgtaacgtttccccggtacccgggtaaacggggtaaacccctaaaacccggggaaacccgtaaaacgggtaaacccttacccgaaaccgtttaggtaaccttaccgttacggaaactaaacgtaacgtaaaccgacggttacccgtaaggacggttaaccggtaccggaagggacccggtaccggtccgttagtaaccgtttgtaggtcgggtaacgggaggacggtacggtacgggacgttaggttacgtccgttaccgtttaccccggacccgggttgggaaccccgg

SEQ ID NO: 96724 - DNA, 684 bp, Homo sapiens
  misc_feature: GYAE6OF02H0GGP.22.52.E08.1.454.CMB.1.raw
tcagacatacgcgtcacgaccggtgctcgatttagtcgagctctcagagagaaaggggctgagagaggagcccagcccctgggattttcaggtgttttcatttggtgatcaggactgaacagagaagaagtcaccatggagtttgggctgagcctggctttttcttgtggtctattttaaaaggtgtccagtgtgaggtgcagctggtggagtcgtgggggaggtcgttggtacacgtccgtggggggtccctggagactctcctgtgcagtcctcgtggacttctaccttgactaattatcgacctagtgtacgccgttgggtcccaccgaggtccctaccggacggggacgggtcgtacgggacggtgggtcctagacgtccgttggttaggtcgggtggtaggagtgggtacggacacgtaactacctacggaccgtaggtacccttaccggtagggaacgggtcccgtaccgaacccgtcttcccacgaacgacgtaactaacttaccgaaacgtaaccaacccttaattaactacgtacgaaactaaaggtaccgaaacgtaccgtacccgtaaggaaacgtacgaacccggtaaacgacgtacccgggtacgtactacgtagtcgtacggtaccggaaggtcgtaacggacgtaccgaacgtacgaccgtattaccgg

SEQ ID NO: 96725 - DNA, 759 bp, Homo sapiens
  misc_feature: GYAE6OF02I6M14.22.52.E08.1.454.CMB.1.raw
  modified_base (171)..(171): a, c, t, g, unknown or other
  misc_feature (171)..(171): n is a, c, g, or t
tcagacatacgcgtcacgaccggtgctcgatttagtcgagctctcagagagaaaggggctgagagaggagcccagcccgtgggattttcaggttgttttcatttggtgatcagtactgaacagagagaagtcaccatggagtttggctgagctggtctttttcttgtggtntattttaaaaggtgtcagtgtgaggtgcagcgtggtggagtcgtgggggaggcttggtacgagtccggtcgggggtccctggacgtactctccgtgtcgcacgtccgtctcggtacttcctacctttagactaagttatacgtccagtcgagtcgtcgggtccgccgaggtcctaccggaaggggtacggcgtgggtacggtacgggtcctacgcgtcgttacggtttaggtggggtacggttggtaggttgggtcggtacctaacgtaacgttaccgtaacggacgtacgtaaccggtcccggtaagggtaaacccgggtcccgggttaaccaacccgtacgttaccgtacgaaggtacgtaacctaacgttaaccgaaacgtaaccctaaaccgtaattacgtaacgtacgtaaactaaaagttaccgaaaaccgccgtaaccgttaacggacgtaaacccggtaacccggaaaacggaacccggtacccgtaaccgttaaacctacggttaaccggtacgggtacggaaaccgggtaaccggtagttaacgggataacggtaacccggattaccggagttaccgg

SEQ ID NO: 96726 - DNA, 738 bp, Homo sapiens
  misc_feature: GYAE6OF02H226G.22.52.E08.1.454.CMB.1.raw
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (411)..(411): a, c, t, g, unknown or other
  misc_feature (411)..(411): n is a, c, g, or t
  modified_base (603)..(603): a, c, t, g, unknown or other
  misc_feature (603)..(603): n is a, c, g, or t
tcagacatacgcgtcacgaccggtgctcgatttagtcgagctctcagagagaaaggggctgagagaggagcccagccctgggattttcaggtgtttttcatttggtgatcaggactgaacagagagaagtcaccatggagtttgggctgagctggtctttttcttggtgcttaattttaaaaggtgtccagtgtgaggtgcanctggnggagtcggtgggggaggcttaggtacgacgtccggttgggggggtccctggacggacttcctccgttagcgcacgtcctcgtcggtacttccgtaacctttagactaaatttagtcggtcctaatgagtaccgttcggggtcccgaccgacggtcctaaccggacgggggaagggtccgttaggggagttcggggtctaccgnggtacgttggtttaggtcgggttgggttagtggttcggtacggtaccgactaacgttaaccgtacgtaacgaactaaccggttcccggtagggtaaccggggtacccggttccaacccgtacttacccgaccgaacgtaacctaactaaaccgttaaccaaacgaaccctaaccgttaacttaatacgtaanaaccttaaagacgaaaccgtacgaccgtacgaacggacgaacggaacgaaccgacggtaccgttaagtaccgtaagttacggtacgaacggggtaacgtggttagaacgttcgaacgtaacggtcaagggttacc

SEQ ID NO: 96727 - DNA, 1011 bp, Homo sapiens
  misc_feature: GYAE6OF02JWOUA.22.52.E08.1.454.CMB.1.raw
  modified_base (552)..(552): a, c, t, g, unknown or other
  misc_feature (552)..(552): n is a, c, g, or t
tcagacatacgcgtcacgaccggtgctcgatttagtcgagctctcagagagaaagggctgagagaggagcccagccctgggatttcaggtgttttcatttggtgatcaggactgaacagagagaagtcaccatggagtttgggctgtagcgtggtctttttcgttgtgtacttagtttaaaggtgttcagtgtgaggtgcagcgtggtggacgtggtgggggtacgggtcgttagggtaccaggtccggttggggggttcccctagggacgtaccgtccgttaccgtggttcggaaccgcggttccttaccggttggtaactttcccgtaccgtttttaacggcctaaatttcgtcggacccctaagttagggacgttaccggtcggggtttcccccggaaccgttacggggtcccgtaacccgggtagggggggaaacgggttaccgtttggggaggggttacggggtccttaaccgtagggtacccggttggttttaaccgggggtagggtttcggggtacgtaagggttttcccggggtggacccggtnttaaacgggttaacctaaccggtcaaaaccggttcgtcccgggtaacggggtaaaccgggtcccggtttaaaccgacccctcggtttaccggtaccctaaaggggaaccgtaaccgttaaaaacctttccgaaaaaccggttacccccttaaaacccttgggttaaaacccctttacgggacgttaaaaaccccgggttaaaactcccgggtaaaaccgttttaccccggggaaaagttaccgggaaaaaccggttaaacccgggtaacccggaaaaacccggtaacccggggttaaaaccggttaccccggtaaacgttttaacccgttaacccgggttaaggggtttaccgggtaaaccccggggggtaaaggggttccccggttttaaaacggtacggggtttaaaaccccgcccgggaaaaaccgggggtccctttttaaaccggggggtcccgg

SEQ ID NO: 96728 - DNA, 784 bp, Homo sapiens
  misc_feature: GYAE6OF02G4BV7.22.52.E08.1.454.CMB.1.raw
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtctttttcttgtggctattttaaaaggtgtccagtgtgaggtgcagctggtggagtcgtggggggagcgttggtacagtccgtgggggtccctggagctctcctgtgcacgtcctcgtggtacttctaaccttttagactaatttatcggccagtgacgtcgtcgggtccgccgaggtcctcggaggggaacggggcgtgggagggttcgggtctcgacgtcgttaggttaggtgggtgggtgtaggtgggtcggtacaacgtacgtaaccgttaaccggacgtaaccggtaccgttaccggggtaagggtaaccgggggtccccggtttaccaaccccgttacgttcccgtaacccggaagggtaaccgaaaccttaaacccgttaaccgaaaaccggtaaaccctaaccccttaataacgttaacgtacgaaacgtaaacgtaacggtaaaccgaccgtacccgtaagggaaccggaaccggaaaccccgggtaaaacgaaccgtaacccgggtacccgttaacgttaaaccccgtacgggttacgggtaccggtaacccggggtaaacgggggttccggtaacgtaaccggttaacggacccgaaggtacccggtaaacggtcccgg

SEQ ID NO: 96729 - DNA, 738 bp, Homo sapiens
  misc_feature: GYAE6OF02IB8O4.22.52.E08.1.454.CMB.1.raw
  modified_base (234)..(234): a, c, t, g, unknown or other
  misc_feature (234)..(234): n is a, c, g, or t
  modified_base (313)..(313): a, c, t, g, unknown or other
  misc_feature (313)..(313): n is a, c, g, or t
  modified_base (528)..(528): a, c, t, g, unknown or other
  misc_feature (528)..(528): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtctttttcttgtggcttaattttaaaggtgtccagtgtgaggtgcagcgtggtggagtcggtgggggagtcgttggtacncggtccggtcggggggtccctagacgacttcctccgtgtcgcacgtcctcgtggtacttcctacctttgactaattacncgacagtgacgtcgtcgggtacccgccgacggccgtaccggagggggtacggggtcgtaggggtacggttccgggtctacggtacggtcgttagggtttacgggtggggtttcggtggtaggttcgggtacggaccgtaacgtacgttaccgtaccggaccgtaacggtacccgttaccgggtaggggaacccgggtttcccgtaccaacccgtnttacccggaacgacggtaaacgacccttaaaccgtacccgaaaaccgtacccttaaccttaatacgtacgtacaaacgttaataaccgacgacgtccgtaggaccgaacgaccgaaacgtcccgaccgttcgttaaccgtcgtacggtcggaacggtaccggggtaacggtctaagggtaccgacggtacacggttaccgtaggttaccc

SEQ ID NO: 96730 - DNA, 721 bp, Homo sapiens
  misc_feature: GYAE6OF02H97QZ.22.52.E08.1.454.CMB.1.raw
  modified_base (170)..(170): a, c, t, g, unknown or other
  misc_feature (170)..(170): n is a, c, g, or t
  modified_base (186)..(186): a, c, t, g, unknown or other
  misc_feature (186)..(186): n is a, c, g, or t
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
  modified_base (372)..(372): a, c, t, g, unknown or other
  misc_feature (372)..(372): n is a, c, g, or t
  modified_base (408)..(408): a, c, t, g, unknown or other
  misc_feature (408)..(408): n is a, c, g, or t
  modified_base (700)..(700): a, c, t, g, unknown or other
  misc_feature (700)..(700): n is a, c, g, or t
tcagacatacgcgtcacgaccggtgctcgatttagtcgagctctcagagagaaaggggctgagagaggagcccagcccctgggatttttcagggttgtttttcattttggtgatcaggactgaacagagagaagtcaccatggagtttgggctgagcgtgtcttttctgnggcttaatttaaaggntcagtgtgaggtgcacgtgtgggtgacgtggtagggggagtgttaggacaggtccggttgggggtccctgaacgctcgtcgtgtgacngtcctgtgtacttctaacgtttnacttaattacgcacctatgacgtccgtcgggtccacgtgtccgcggaagggaccggttgagggcggttcgacctntacggtcttaggtggtgggtacgttgagtggtaacnctaagacttacgtaagccgtacgtaccggttacggtaggtaccgggttacccgttaacaccgtacgtttaccgaccgtaaacggtaacgaacccttaacgttaaacccgaaaccggtaacttaaaccccgttatttaaacggcttaacgaaacttaaagaccggttaaacgacgtaacgttaccggaacggaaccgttaccgggaaaacgtcccgtaaccggtaacctttaaccggactttaacggaacccggttagggaccggtacgtaggttaacgcggttaaacccggngtaacgtaccgtacgttaacc

SEQ ID NO: 96731 - DNA, 795 bp, Homo sapiens
  misc_feature: GYAE6OF02IYBMX.22.52.E08.1.454.CMB.1.raw
  modified_base (268)..(268): a, c, t, g, unknown or other
  misc_feature (268)..(268): n is a, c, g, or t
tcagacatacgcgtcacgaccggtgctcgatttagtcgagctctcagagagaaaggggctgagagaggagcccagccctgggattttcaggtgttttcatttggtgatcaggactgaacagagagaagtcaccatggagtttgggctgagctggtcttttctgtggcttattttaaaggtgtccagtgtgaggtgcagctggtggagtcgtgggggaggtcttggtacaggccgtgggggtccctgagactctcctgtcgcacgcctntggtacttctaccttttagcctaattactcgcctagtgacgtccgtcgggtcccgaccgtaggcctaccggaagggggacggggtcctaggggacggttcggggtcctacgagtcgttaggtttacggtgggttggtaggtagttgggtacggtacgaacgtacttaacccgtacggacgtaacggtacccttaccggggtaagggtaaacccgggggtccccgtttaacgaacccttacgttccccgtaaccgaacggtaaacgtaaccttaaaccgttacccgaaaaacgtaaccccttaacccgtttaataacgttaacgtaccgaaacgtaaaacgttaccggaaacgtaaccgggtaccgtaagggaaaccggtaacgggaaaccccggtaaaggtaacccgggtaaccgggtacccgtttaaacttaacccggttaacccggtgggttaacccggaaccggggttaaaggggtcccttaaggaaccgttacggaccccgaagggtaccctaggttacccgg

SEQ ID NO: 96732 - DNA, 666 bp, Homo sapiens
  misc_feature: GYAE6OF02GBGUO.22.52.E08.1.454.CMB.1.raw
  modified_base (182)..(182): a, c, t, g, unknown or other
  misc_feature (182)..(182): n is a, c, g, or t
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (232)..(232): a, c, t, g, unknown or other
  misc_feature (232)..(232): n is a, c, g, or t
  modified_base (276)..(276): a, c, t, g, unknown or other
  misc_feature (276)..(276): n is a, c, g, or t
  modified_base (314)..(314): a, c, t, g, unknown or other
  misc_feature (314)..(314): n is a, c, g, or t
  modified_base (320)..(320): a, c, t, g, unknown or other
  misc_feature (320)..(320): n is a, c, g, or t
tcagacatacgcgtcacgaccggtgctcgatttagtcgagctctcagagagaaaggggctgagagaggagcccagccctgggattttcaggttgttttcatttggtgatcaggactgaacagagagaagtcaccatggagtttgggctgagcgtgtcgtttctagtcgcttagttaaaggtntcagtgtagagtgcagtgtggnggtagtcggnggggtacgcttaggtacngtccggtacgggggttccctagacgctcttccgtggtcacgacnccgttcgtggtacttactaccgtttaatctaaactttncgtcangtacgcgtcggtccgcgacgtcgcggagggacggcgtaggtacgtcggtatacgtgtggttaggttaggtcggtggtagttaggcggtctaactacgtaactacgtaccggtacgtacggtaacccgttccggtagggacccgggtaccgtaccgtacgtacctactaccggtaagtaactaacgtaaccttacgaaactaaccttagtaactacgtataccaagtaacacgtagacgtagacgaccgaacggtaacgaacgaaccgttaccgtacttacgtaaccgtcgtacggtacggaacgttacggagttacgggtacctacgacttacgaccgtcggtacg

SEQ ID NO: 96733 - DNA, 508 bp, Homo sapiens
  misc_feature: GYAE6OF01DBQD9.37.45.E01.1.454.CMB.1.raw
  modified_base (495)..(495): a, c, t, g, unknown or other
  misc_feature (495)..(495): n is a, c, g, or t
tcagtagtgtagatcacgaccggtgctcgatttagtgagtcagtaagggaaaggggaggaactgctcagttaggacccagagggaaccatggaagccccagctcagcttctcttcctcctgctactctggctcccagataccaccgcagaaattgtgttgacacagtctccagccaccctgtctttgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtgcagtgggtctgggacagagttcactctcaccatcagcagcctgcagtctgaagtattttgctactttattactgtcagcagtataataactggcccgagttcgcaagggaccaggtaggaaatacaaacgaactagtggctgcaccatctgtacttnactcttcccgtcc

SEQ ID NO: 96734 - DNA, 558 bp, Homo sapiens
  misc_feature: GYAE6OF01C0WKD.37.45.E01.1.454.CMB.1.raw
  modified_base (200)..(200): a, c, t, g, unknown or other
  misc_feature (200)..(200): n is a, c, g, or t
  modified_base (387)..(387): a, c, t, g, unknown or other
  misc_feature (387)..(387): n is a, c, g, or t
  modified_base (427)..(427): a, c, t, g, unknown or other
  misc_feature (427)..(427): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccagggganagagccaccctctcctgcagggccagtcagaatgttagcagtcacttagcctggtaccaacagagacctggccaggccccaggctcctcatctatgctgcttccctcacgggccactggcatcccagccaggttcagtggcagtgggtctgagacagacttcactctcaccatcagcagtctagacnccttagaagtattttgactaacttttatatctgtacaacngcgtcaactaccgttggtcggaccttcgggacccgtaagggacccaaagggttcggacttttacccgaacggtaaacgttggttcggctcggcctaacccgtattaccttggttccttcgacgtttccccg

SEQ ID NO: 96735 - DNA, 521 bp, Homo sapiens
  misc_feature: GYAE6OF01BFONP.37.45.E01.1.454.CMB.1.raw
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccaggggagagagccaccctctcctgcagggccagtcagaatgtagcagtcattagcctggtaccaacagagacctggccaggcccccaggctcctcatctatggtgcatccaccagggccactggtactcccagccaggttcagtggcagtgggtctgggacagagttcactctcaccatcagcagcctgcagtctgaagtattttgctagttttatttctgtcagctagtataattacgtggtccctcgtacgtggtacgttcggaccgaagggaccgaaggtaggaaatacgaaacgtatggtcgctgactaccatctgtctcgtac

SEQ ID NO: 96736 - DNA, 553 bp, Homo sapiens
  misc_feature: GYAE6OF01EIJ6P.37.45.E01.1.454.CMB.1.raw
  modified_base (200)..(200): a, c, t, g, unknown or other
  misc_feature (200)..(200): n is a, c, g, or t
  modified_base (547)..(547): a, c, t, g, unknown or other
  misc_feature (547)..(547): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccagggganagagccaccctctcctgcagggccagtcagaatgttagcagtcacttagcctggtaccaacagagacctggccaggccccaggctcctcatctatgctgcttccctcagggccactggcatcccagccaggttcagtgcagtggtctgagacagacttcactctcaccatcagcagtctagacgtccctaggaagtattttcgacttaacttttaatattctagttacaacagtcgtcaaccaccgttgggtacgtacccgttcgggaccgaaacggggaccctaaagggtcggtaactttcccgtaacgtacgttggtacggctggccacctattcctagtcttcnttcccg

SEQ ID NO: 96737 - DNA, 577 bp, Homo sapiens
  misc_feature: GYAE6OF01DMXGA.37.45.E01.1.454.CMB.1.raw
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
  modified_base (449)..(449): a, c, t, g, unknown or other
  misc_feature (449)..(449): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccgaggggagagagccaccctctcctgcagggccagtcagaatgttagcagtcacttagcctaggtaccaacagagacctggccaggcccccaggcctcctcatctatcgctcgtccttccctcgacgggccactcggccactcccagccaggttcagtggcagtgggtctgagacagacttcactctcaccatcagcagtctagacnccttagaagtnttttgaccttattttatatctagtcaacagtcgtcaacnccgtgggtacggtacccgttcggacccgtaaacggggtacccaaagggttcggaaccttttaccgtaaccgtaacgttggtacggtccttaggaccaccctattccgtgtttcccttgtacttccccg

SEQ ID NO: 96738 - DNA, 754 bp, Homo sapiens
  misc_feature: GYAE6OF01B172C.37.45.E01.1.454.CMB.1.raw
  modified_base (164)..(164): a, c, t, g, unknown or other
  misc_feature (164)..(164): n is a, c, g, or t
  modified_base (211)..(211): a, c, t, g, unknown or other
  misc_feature (211)..(211): n is a, c, g, or t
  modified_base (281)..(281): a, c, t, g, unknown or other
  misc_feature (281)..(281): n is a, c, g, or t
tcagtagtgtagatcacgaccggtgctcgatttagtgagtcagtaagggaaagggggaggaactgctcagttaggacccacgagggaacccatggaacgcccagtctctagcttctcttcctcctgctactctggctcccagactaccaccggctaggaattgngttgacgtacagttctcctagcctacctgtctttgctccgagggganagacgccacctctccgtggcagggtccagtcagaagtggttacgcagtctacttacgcctggtaccaacncgacgacctcggacctacggaccccaggcctccgcatctatggctcggtccttccgtcgacggtccacggtcgggcctacgtcccgaggtccgtacggttacaacggtacggacgtacgggttacgggtacttaggaacggtaacaaggtaccttacggacctcttaccgacgtacgtacgaggttccaacgttacgtacgacgtaccgttaaggtaacgttaagtttttccgaaccgttaaactttttactaactttaccgttacgtttaacccgaacgtaccgtaacggttaaccctaacccggtacccgttaggggttacccggtaaacccggtttaacccgggaacccgggtaaaccggggtaacccgttaacggggtgttaaccttttaaccggtaaccggtaaacgtcgggtaacggtaccgtcgtaccgtacgttagttccgttaggttccttcgtagttaccccg

SEQ ID NO: 96739 - DNA, 592 bp, Homo sapiens
  misc_feature: GYAE6OF01A8NLR.37.45.E01.1.454.CMB.1.raw
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccgaggggagagacgccaccctctcctgcagggccagtcagaatgttagcagtcacttagcctaggtaccaacagagacctggccacggccccaggcctcctcatctatgctcgccttccctcgacgggccacgtcggcactcccacgcctaggttcaggtcggcgtaggtgggtctgagacgagtacttcactctacaccatcagctagtctagacgtcctagaagttatttcgacttacgttttatattcgtagtacaactacgtcgtactaccgaccgttagggtacggtaccgttcgggaaccgtaacgggaccgtaagggtgttaccgtttaccgtaacggtaccgttggtacggtcgtacgacctacgtacgttcttagtccttctcgttccccg

SEQ ID NO: 96740 - DNA, 530 bp, Homo sapiens
  misc_feature: GYAE6OF01CQN39.37.45.E01.1.454.CMB.1.raw
  modified_base (404)..(404): a, c, t, g, unknown or other
  misc_feature (404)..(404): n is a, c, g, or t
  modified_base (431)..(431): a, c, t, g, unknown or other
  misc_feature (431)..(431): n is a, c, g, or t
  modified_base (521)..(521): a, c, t, g, unknown or other
  misc_feature (521)..(521): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccaggggagagagccaccctctcctgcagggccagtcagaatgttagcagtcacttagcctggtaccaacagagacctggccaggcccccaggcctcctcatctatgctgccttccctcacgggccacgtggcactcccagccaggttcagtggcaggtgggtctgacgacagacttcactctcaccatcagcagtctagacgcctagaagtntttcgcttactttatatctgtacaacngctcacacgtggtcgtaccttcggaccgagggaccaagggtcgtactttaccgacgtacgtggtacggctcgacactattctgttccttnacgttcccg

SEQ ID NO: 96741 - DNA, 584 bp, Homo sapiens
  misc_feature: GYAE6OF01ARJFJ.37.45.E01.1.454.CMB.1.raw
  modified_base (203)..(203): a, c, t, g, unknown or other
  misc_feature (203)..(203): n is a, c, g, or t
  modified_base (424)..(424): a, c, t, g, unknown or other
  misc_feature (424)..(424): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctggtaccagcagaaacctggccaggcctcccgaggcctcctcatctagtggtgcatcccaccgagggccacgtggtactcccgagccgtaggttcaggtcggctaggtcgggtactgggacaggtacgttcacctctccaacctatcagcacgcctgcagtcgtagaagttnttttcgacttagttttacttcgtgtcagtactaagttaattaacgttacgtcggtcccttaccgttacggttacggtaccgttccggaccgaacgggtaccgtaaggtacggaaactaccgaaacgtcgtaggtgaccgtgaccaacctatccgtgtccc

SEQ ID NO: 96742 - DNA, 591 bp, Homo sapiens
  misc_feature: GYAE6OF01DCQJZ.37.45.E01.1.454.CMB.1.raw
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccgaggggagagacgcccacccctctcctgcgagggccagtcagaatgtagcagtcactagcctaggtaaccaacagacgaccgtcggaccacggccccaggcctcctcactctatcgctcgtccttcccgtcgacgggcctacgtcggctacctcccagcctaggttcgaggtcggcgtaggtcgggtctaggacgactagtacttcactctacacatcagcagtctagagtctagaacgttgtttgacttatttatcttctagtacaagtacgtcgtacacctacgtcgggtacgtaccgttcggaccgtaacgggaccgtaagggtcgtaacttaccgtaacgtacgtgggtacgtcgtcgacctactacgttcttcgttcttacgtccgttacccg

SEQ ID NO: 96743 - DNA, 705 bp, Homo sapiens
  misc_feature: GYAE6OF01CIDC4.37.45.E01.1.454.CMB.1.raw
  modified_base (148)..(148): a, c, t, g, unknown or other
  misc_feature (148)..(148): n is a, c, g, or t
  modified_base (171)..(171): a, c, t, g, unknown or other
  misc_feature (171)..(171): n is a, c, g, or t
  modified_base (198)..(198): a, c, t, g, unknown or other
  misc_feature (198)..(198): n is a, c, g, or t
  modified_base (425)..(425): a, c, t, g, unknown or other
  misc_feature (425)..(425): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgnaagaaattgtgttgacacagtcnccagccacctgtcttgctcgaggggangacgccaccctctcctgcagggccagtcagaagtgtagcagtcacttagccttggaaccaacgagacgaccgtcggccgaacggcccccaggcctcctctagtctatcgctcgtccttcccgtcgacgggtccacgtcggaccaccgtcccacggccgtaggttacgaggttcggacgtacgggtcgggtctaggacgaacacgtaccttacactctccaaaccgtntacgacgtactagtacgtacgtacgtaccgtagtaacgttacgtttacgacttaattttaacttacgttacgttacgtacccgtaagtaccggtaccgttaaccgtaccgtaaccggttcgggtaaccggttacccgtttaccgggaaccggtaaccggggtaaccggtaacggggttacggttaacccgtttaccggtaaaccggttaacgtcgggttcgtacggtaccgtaccgttaccgtagttccgttaccgtttaccttacgtacccttaccccg

SEQ ID NO: 96744 - DNA, 679 bp, Homo sapiens
  misc_feature: GYAE6OF01DIW1N.37.45.E01.1.454.CMB.1.raw
  modified_base (201)..(201): a, c, t, g, unknown or other
  misc_feature (201)..(201): n is a, c, g, or t
  modified_base (372)..(372): a, c, t, g, unknown or other
  misc_feature (372)..(372): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccgagggganagacgcccaccctctcctgcagggccagtcagaatgttagcagtcacttagcctggaccagcaagaacctggccaggctccaggcctcctcatctagtggtgctactccaccgagggcccatggtactcccgagcctaggttcaggtggcgtaggtcgggtcgtgggaacnggtagttcacttctaccaccatcgacgctacgcctgctacgttctgaagttagttttgacttagtttttactttcgtcgttacgacggttactaaggtttaactttaaacgtttaccgtacggttacccctttaccggttaaccgggtttcgggttaacccgggtttacccgggaaccgggtaaaaccggggtaaccggtaaaaggggttaacggtaaaaccgttaaaccggaaaaccgggttaacgttacgggtacgggttacctacggtaccgaaccctagttacccgtttgttcccgtttaacc

SEQ ID NO: 96745 - DNA, 550 bp, Homo sapiens
  misc_feature: GYAE6OF01BFU06.37.45.E01.1.454.CMB.1.raw
  modified_base (200)..(200): a, c, t, g, unknown or other
  misc_feature (200)..(200): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccagggganagagccaccctctcctgcagggccagtcagaatgtagcagtcacttagcctggtaccaacagagacctggccaggcccccaggctcctcatctatgctgcttccctcagggccactggcatcccagccaggttcagtggcagtgggtctgagacagacttcactctcaccatcagcagtctagagcctagaagtattttgctaacttttatactctagtacaactacgtcgtaccactaccgtgggtacggtaccgttcggaccgtaacgggaccgtaagggtcgtactttacgaagtaccggtaatggtcgtcgtcgaccgtacctacttcttcgttccttcgtacccg

SEQ ID NO: 96746 - DNA, 654 bp, Homo sapiens
  misc_feature: GYAE6OF01B3A11.37.45.E01.1.454.CMB.1.raw
  modified_base (491)..(491): a, c, t, g, unknown or other
  misc_feature (491)..(491): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccacccttgttctttgtctccgaggggagagacgcccaccctctcctgcgaggccagtcagaatgttagcagtctacttacgccgttaggtaacccaaactaggacgacccgtcggcccaacggcccccgaggtcctccgtcactctatgcctcgtccttccctcgacgggcccacgtcggacactcccgaagccgtaggtttcgaggttcggacgtaggtcggggtctaggacgacgacgtacttaccgacttccgtaccaaccgtactcaacggacctacggtttacgaaggtacgtacccgttaggaaacgttntttttacgactttaactttaatatttcgtagtacgtaacacgtcgtacctacgaccggttggtcgtacccgttcggaacggaacgaccgtaggttacgtactttaccgacgtacgttcggtacgtcgtacgactaccagtttcacgtttcctgtaccttcccg

SEQ ID NO: 96747 - DNA, 703 bp, Homo sapiens
  misc_feature: GYAE6OF01A7H34.37.45.E01.1.454.CMB.1.raw
  modified_base (202)..(202): a, c, t, g, unknown or other
  misc_feature (202)..(202): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagactaccaccgcagaaattgtgttgacacagtctccagccaccctgtctttgtctccgagggganagacgcccaccctctcctgcaggccagtcaagaatgttagcagtctacttagcctaggtaaccaacgagacgtaccgtggtaccaccggcccccaggcctccgtcatcttatcgctcgtccttcccgtcgacggcccacgtcggacctacgtccccagtccgtaggttcaaggtcggaccgtaggttcgggtctaggacgaacgtagtaccttcgtactcccgtaccacctactcagtcctacgtcgtaacgacgtccgtaagtaagttacgttttacgacttaacgtttacttacttacgttacgtaacgtaaccgacgttaccgtcctaaccgtaccggttcggtaccgggtacccgtttcccgggaaacccgtaaggggaacccgttaaggggttacgttaacccgtttaacccggtaacggtaccgttacggtacggtcccgtacgtaccctaacccgttacgttcttaccggtactttaccggtcctttacccccg

SEQ ID NO: 96748 - DNA, 715 bp, Homo sapiens
  misc_feature: GYAE6OF01B21AR.37.45.E01.1.454.CMB.1.raw
tcagtagtgtagatcacgaccggtgctcgatttagtgagtcagtaagggaaagggggaggaactgctcagttaggacccagagggaaccatggaagccccagctcagcttctcttcctcctgctactctggcctcccagataccaccgcaagaaattgtgttgacacagtcctccagcccaccctgtctttgtctccgaggggagagacgcccaccctctcctgcacgggcagtcagaatgttagcagtcacgttacgccgtaggtaccaacgagacgaccgtcggaccacggcccccgaggtacctccgtacactcgtagtcgtctcggtcctttcccgacgtaccgggcctacgcggtaccacgtcccgaccggtccgtagggttaccgacggttggacggtaggtggggtccgtagacgacgagtacgttcacttccgtacaccatacacgcacgccgtgctacgtacgtagtaagtttacgtttagtactttacgttttacgtttcgttacgtacgtacgtacttaaggttaactttaagtttaccggtcggttaccccttacggttaccggttaccggttacggtcccgggtaaaccggtaaacgggtaaacccggtaagggttaacggaaaacggttaaacccgaaaacgggtccgtacggttacggaccgttaacggaccgtaacctacgttcgttacggtttacccg

SEQ ID NO: 96749 - DNA, 665 bp, Homo sapiens
  misc_feature: GYAE6OF01CJ4PM.37.45.E01.1.454.CMB.1.raw
  modified_base (202)..(202): a, c, t, g, unknown or other
  misc_feature (202)..(202): n is a, c, g, or t
  modified_base (222)..(222): a, c, t, g, unknown or other
  misc_feature (222)..(222): n is a, c, g, or t
  modified_base (271)..(271): a, c, t, g, unknown or other
  misc_feature (271)..(271): n is a, c, g, or t
  modified_base (313)..(313): a, c, t, g, unknown or other
  misc_feature (313)..(313): n is a, c, g, or t
tcagtagtgtagatcacgaccggtgctcgatttagtgagtcagtaaggggaaagggggggaggaactgctcagttagggacccaggagggaacctatggaagccccagctcagcttctcttcctctgctactctggctccagataccaccgcagtaattgtgttgacacagtctccagccacctgtctttgctcgagggganagacgccacctctcctgccnggggccagtcagatgttagctagtacacgttagccgtaggtaacccaanagacgaccgtggcccacggccccaggcctccgtcagtctagnggtctgcctttaccgtcgacgggtaccaaggtcgcatcccagtaccgtaaggttcgacgtggaccaagggttcgggtactaggaagaccaggtactttcaaccttctaccgaccctaattaccgaacgtaccgtagttaccgttaagaacggacccttaagaagttacgttttacgtaccttaaactttacttaaacgtttcttacggtaactaacctaacgtccgttaaccaaccgtaccggttacggtacgtaccgttacggacgtaacgggactaaggttacggtactttaccgtacgtacgttggtacggtctacgtacaccgtactcgtcgttacttacgccttccg

SEQ ID NO: 96750 - DNA, 820 bp, Homo sapiens
  misc_feature: GYAE6OF01AK8GE.37.45.E01.1.454.CMB.1.raw
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccgaggggagagacgcccaccctctccgtgaccgacggggccaggtccaagtaattggttagcacgttcctactttacgccttagggtaacccaacgacggacgaccgtcggacccaccgggcccccaggcctcctctactctatcgtcctcgtccttcccgacgaccgggtaccctacgtcggacctacctccccggacgtcccgtagggttccgaggttcgggtacgtacgggttcggggtacccgttaggaacgtaaccgtacgtaacccgtttaccgaacccgttccgtaccaacccgtaacttccgaagtaccgaaggtttccgtaacggtaccttacggttaacgtaaacggtttacctttttacgggaaccttttaacgtttttataaccgtttacctacggtaaccctaacggtacgttccgtaacccgtaccggttaaccggttcggggtaacccggttaaccggttacccgggaaccggtaaacggggttaacccggtaagggtttacccggttaaacggttttacccgaacggttaacggttcggttacggcctaccggtaccccttaccgtacgttttaccgttaccgttcccttttaaagccccgttttacccccg

SEQ ID NO: 96751 - DNA, 610 bp, Homo sapiens
  misc_feature: GYAE6OF01BRRGQ.37.45.E01.1.454.CMB.1.raw
  modified_base (202)..(202): a, c, t, g, unknown or other
  misc_feature (202)..(202): n is a, c, g, or t
  modified_base (269)..(269): a, c, t, g, unknown or other
  misc_feature (269)..(269): n is a, c, g, or t
  modified_base (312)..(312): a, c, t, g, unknown or other
  misc_feature (312)..(312): n is a, c, g, or t
  modified_base (592)..(592): a, c, t, g, unknown or other
  misc_feature (592)..(592): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccttgttctttgtctccgagggganagacgcccaccctctcctgcgacgggccagtcagaatgtagcatactacttagcctaggaaccaacngacgccgtcggccacggccccaggctcatcagtctagtggtcncactccgacgtacggcctacgtggtactccgacgtccttaaccgtttggtcggtacgtacggttcggggtaccgtaggggaacctaggtaccgttctaaccgtctaccgaccacgtcgtacgctaccgtcctaggacctaggttcaagtacgttagtttacgacgttttatttacgtattacgtaccagtactaacgaagtcgacttcgcctactcgtacggttacgcggacggaccggagtcggagtaagtaccgaaacgtagtgcgtcctgacctacncgttatcctcttgtaccc

SEQ ID NO: 96752 - DNA, 786 bp, Homo sapiens
  misc_feature: GYAE6OF01A87QI.37.45.E01.1.454.CMB.1.raw
tcagtagtgtagatcacgaccggtgctcgatttagtgagtcagtaagggaaagggggaggaactgctcagttaggacccagagggaaccatggaagccccagctcagcttctcttcctcctgctactctggcctcccagactaccaccgcaagaaattgtgttgacacagtctccagcccacccttgttctttgtcctccgaggggagagacgccctaccctctccgtgcgaggccagtcaagtaatgttagctacgtctaacgtttcgccgtaggtaaccaacagacgaccgtggacccacggcccccgaggcctcctcacttctatcgctcgtccctttcccgacggacgggcctacgtcggacctacctccccgaagtccccgtaggttacgacggtcggacgtagggttcgggtcctaggacgacgtaacggttaccttaccgaccttacctacccaacctaactccgaacgaccgttaacggttaccgaaggtacgttacccgtaaaggtaagttttaacttttcggaacctttaacgttttaattaccttacgttacgtaacctaaacgttccgtaaccgtccctaaccgtacccggtttacgggttacccggtacccgttaacccgggaaccgggtaaaccggtaaccggtaacgggttaccggttaaccttttaacccggtaaccggtaaccggttcgggttaccggtccgttacccgaccgttaaccgttacgttaccgttttaccggtttccttaccgttaacccgtttcccccgg

SEQ ID NO: 96753 - DNA, 877 bp, Homo sapiens
  misc_feature: GYAE6OF01ATI2Z.37.45.E01.1.454.CMB.1.raw
  modified_base (215)..(215): a, c, t, g, unknown or other
  misc_feature (215)..(215): n is a, c, g, or t
  modified_base (372)..(372): a, c, t, g, unknown or other
  misc_feature (372)..(372): n is a, c, g, or t
  modified_base (415)..(415): a, c, t, g, unknown or other
  misc_feature (415)..(415): n is a, c, g, or t
  modified_base (570)..(570): a, c, t, g, unknown or other
  misc_feature (570)..(570): n is a, c, g, or t
  modified_base (860)..(860): a, c, t, g, unknown or other
  misc_feature (860)..(860): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagactaccactggaagaaatagtgaatgacgacagtcctaccacgcccaccctgtctgtgtcctaccggaagggaaacncgcccaccctctccgtgccgacgggccagttacgagtagttgtacggacagtacctaaacgttcggccgtacggtaaccgagaaccgtaacgaaacccggtcggaaccctaggacccgtacccaggtccctacctacgtacttcgtagtcggttacncctaccgtacccgaccggtacgacccgtaagttcggttaaccncccgacggtacgtacggttaccgaggttcggacggtacgggttcgggttaccggacgggtaacgtaacggttaccgtttacccgtaccgtttaccgacccctaaacgtacgttaccgtaacccggcttaacgtccccggttagaacccgggtttnaacccggttagggtaaacgtttacttttaccggaacttttaaacgttttcgtaactacccgggttacaaagttccgttaaaccgttaattaacccggttaaccggggtcccggttaaccccggggttaaccgtaccgggttaaacccggaccgggtaaaacgtaccgggttaaacggtaaacccggttaaaaccgtaacgggtaaaccccggttagggttaacccggaaccttaaccggtaaacccgtccggtttaaaaccgtcctttaaaccggttacccggtttaccnccccgggtttaaacccc

SEQ ID NO: 96754 - DNA, 746 bp, Homo sapiens
  misc_feature: GYAE6OF01E31K4.37.45.E01.1.454.CMB.1.raw
  modified_base (204)..(204): a, c, t, g, unknown or other
  misc_feature (204)..(204): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagactaccaccgcagtaaattgtgttgacacagtctccagccacctgttctttgtctccgaggggganagacgcccaccctctcctgcagggccagtcagtatgtagcagtcacttacgccgtgtaaccaacgagacgaccgtcggcccgacggccccaggtcctcctacactctagtgccttcgcctttcccgcggaccgggcctacgtcggaccacctcccgacgccgtagggtttcacgggttcggaccggtagggtcgggtacgtacggacgaaccgtaacggttaccttacctacccgttccgtacccaaacccgttactacgtaaccggaccttacggtacccgttaggttacggtaacgtttaaggtaacggttttaactttcgggtaaccttttagttttacgttacgtttcggtaccgtaagtaccttaagttaactttaagttaccgttaccggtccttaacccgttacgggttacgggttacccggtaccgggtaaacccgacgggggtaaaccgttacggggtaaagtaaccggtaacgtaaacgtaacggtcgggaggtaccgtacgaccgttactagttccgttgtcgtttacccg

SEQ ID NO: 96755 - DNA, 772 bp, Homo sapiens
  misc_feature: GYAE6OF01DD19S.37.45.E01.1.454.CMB.1.raw
  modified_base (150)..(150): a, c, t, g, unknown or other
  misc_feature (150)..(150): n is a, c, g, or t
  modified_base (218)..(218): a, c, t, g, unknown or other
  misc_feature (218)..(218): n is a, c, g, or t
  modified_base (273)..(273): a, c, t, g, unknown or other
  misc_feature (273)..(273): n is a, c, g, or t
  modified_base (358)..(358): a, c, t, g, unknown or other
  misc_feature (358)..(358): n is a, c, g, or t
tcagtagtgtagatcacgaccggtgctcgatttagtgagtcagtaagggaaagggggaggaactgctcagttaggacccagaggaaccatggaacgccccagctcagcttctcttcctctagctactctggcctccagactaccaccganagtaattgtgttagacacagtcctccagccctaccttgttctttgtccgacggaggggacacggaccnccctacccttctacccgtggaccgacgggacctagtacgaagtaaattggtaacncgtacgttacctaacgttacgccgttacggaaccaacgaacggacgtacccgtggaccccgaccggtcccccgaggtcctacctntactactacgtcggtacctccttcccttccgacggaccggcctacgtacgacctccaccgtacgtcgtacggtcgaggtcgtacggtaggttcggactacgggaacacgtaacttacctacttacccgtacaacctacgacgttcaacgtaccgtagtacgaacgtcgtacgttaaggtacttacggtttactacctttaatttacgtcgttaccgttcgaaaccgttacgtcgttaccccgtaacgttacccggtttacgggtcccgggtaaccgttttaacccgggaccggtaaccggtaaacgggtaaccgggtttaacgttaccgttaccccgtttaaggaacccgtgttacgggctcgtaacgtaccctagttacgtttccgtacgtttacctcctcccgtttaccccg

SEQ ID NO: 96756 - DNA, 494 bp, Homo sapiens
  misc_feature: GYAE6OF02GBMTN.37.45.E01.1.454.CMB.1.raw
  modified_base (393)..(393): a, c, t, g, unknown or other
  misc_feature (393)..(393): n is a, c, g, or t
tcagtagtgtagatcacgaccggtgctcgatttagtgagtcagtaagggaaaggggaggaactgctcagttaggacccagagggaaccatggaagccccagctcagcttctcttcctcctgctactctggctcccagataccaccgcagaaattgtgttgacacagtctccagccaccctgtctttgtctccaggggagagagccaccctctcctgcagggccagtcagaatgttagcagtcacttagcctggtaccaacagagacctggccaggcccccaggctcctcatctatgctgcttccctcagggccactggcatcccagccaggttcagtggcagtgggtctgagacagacttcactctcaccatcagcagtctagagcctgaagnttttgctactttatattctgtcaacagcgtcacacctggtgaccttcggccaagggaccaaggtgatttccacgaactgtgctgcacatctgtcttcatcc

SEQ ID NO: 96757 - DNA, 498 bp, Homo sapiens
  misc_feature: GYAE6OF02H9HMM.37.45.E01.1.454.CMB.1.raw
  modified_base (426)..(426): a, c, t, g, unknown or other
  misc_feature (426)..(426): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccaggggagagagccaccctctcctgcagggccagtcagaatgttagcagtcacttagcctggtaccaacagagacctggccaggcccccaggctcctcatctatgctgcttcctcaggccactggcatcccagccaggttcagtggcagtgggtctgagacagacttcactctcaccatcagcagtctagagcctgaagattttgctaactttatatctgtcaacagcgtcacncctgggtgaccttcggccaagggaccaaggtgaaatcaaacgactgtggctgcaccatctgtcttcattccc

SEQ ID NO: 96758 - DNA, 502 bp, Homo sapiens
  misc_feature: GYAE6OF02F9L4K.37.45.E01.1.454.CMB.1.raw
  modified_base (200)..(200): a, c, t, g, unknown or other
  misc_feature (200)..(200): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccagggganagagccaccctctcctgcagggccagtcagaatgttagcagtcacttagcctggtaccaacagagacctggccaggcccccaggctcctcatctatgctgcttccctcagggccactggcatcccagccaggttcagtggcagtgggtctgagacagacttcactctcaccatcagcagtctagagcctagaagtattttgctactttatattctgtcaacagcgtcactacctggtgaccttcggccaagggaccaaggtggatttccgacgaactgtggctgcacatctgtcttcattcc

SEQ ID NO: 96759 - DNA, 537 bp, Homo sapiens
  misc_feature: GYAE6OF02IRRHW.37.45.E01.1.454.CMB.1.raw
  modified_base (200)..(200): a, c, t, g, unknown or other
  misc_feature (200)..(200): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccagggganagagccaccctctcctgcagggccagtcagaatgttagcagtcacttagcctggtaccaacagagacctggccaggcccccaggcctcctcatctatgctgcttccctcacggaccactggcactcccagccaggttcagtcggcaggtgggtctggagacgagacttcactctcaccatcagcagtctagagcctagaagtattttgctactttatattcttagtacaactgcgtacaccacctggtcggaccttccgggaccaaacgggaaccagggttcggtatttaccgtacggtaactggtcggtctgacacctattctgtcttcattcccg

SEQ ID NO: 96760 - DNA, 589 bp, Homo sapiens
  misc_feature: GYAE6OF02G954O.37.45.E01.1.454.CMB.1.raw
  modified_base (200)..(200): a, c, t, g, unknown or other
  misc_feature (200)..(200): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccagggganagagccaccctctcctgcagggccagtcagaatgttagcagtcacttagcctggtaccaacagagacctggccaggcccccaggctcctcatctatgctgcttccctcagggccactggcatccagccaggttcagtggcagtggtctgagacagactcactctcaccatcagcagtctagacgcctgaagtatttgactaactttatacttctgtacaacagtcgtacaacaccgtgggtacgtacccgtttcgggaccctaaaggggaccctaaaggggttcggtacgttttacccgtaccggtaaacttcgggttacggcccgttacggacccgttaacccgtacgttcccgttacggtttaccctttacgaaccttttcccccgg

SEQ ID NO: 96761 - DNA, 569 bp, Homo sapiens
  misc_feature: GYAE6OF02I9VFF.37.45.E01.1.454.CMB.1.raw
  modified_base (201)..(201): a, c, t, g, unknown or other
  misc_feature (201)..(201): n is a, c, g, or t
  modified_base (430)..(430): a, c, t, g, unknown or other
  misc_feature (430)..(430): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccaggggganagagccaccctctcctgcagggccagtcagaatgttagcagtcacttagcctggtaccaacagacgacctggccacggcccccaggcctcctcatctatgctgcttccctcgacgggccactggcactcccagccagttcagtggcagtgggtctgagacagacttcactctcaccatcagcagtctagcgctagaagtattttgactactttatacttctgtacaacncgtacgtcactaccgttggtcggtacccgtttccgggaccgaaacgggtaccgaagggttcggtactttaccgtaacggtaacgttggttcggcttacggacctaaccgtacttccgttgttcctttaccgattccccg

SEQ ID NO: 96762 - DNA, 633 bp, Homo sapiens
  misc_feature: GYAE6OF02IBQL8.37.45.E01.1.454.CMB.1.raw
  modified_base (156)..(156): a, c, t, g, unknown or other
  misc_feature (156)..(156): n is a, c, g, or t
  modified_base (199)..(199): a, c, t, g, unknown or other
  misc_feature (199)..(199): n is a, c, g, or t
  modified_base (289)..(289): a, c, t, g, unknown or other
  misc_feature (289)..(289): n is a, c, g, or t
  modified_base (463)..(463): a, c, t, g, unknown or other
  misc_feature (463)..(463): n is a, c, g, or t
tcagtagtgtagatcacgaccggtgctcgatttagtgagtcagtaagggaaagggggaggaactgctcagttaggacccagagggaaccatggaagcccagctcagcttctcttcctcctgctactctggctcccagataccaccgcagaaattgngttgacacagtctccagccaccctgtctttgtctccagggganagacgccaccctctcctgcagggccagtcagatgttagcagtcacttagcctggtaccaacagacgacctggccaggcccccaggctccncatcctatgctgccttccctgacgggcctacgtcggccactcccagcctagggttacaggtcggactaggtcgggtctgacgacaggtacttcacgttccacacattcagactagtactagacgtctagtaacgttagtttcgacttaactttatacttcttacgtacctaaancgtaccgtactaacctaccgttgggtacccgtacccggtttacggacccggaaaacggggtaacccctaaggggttccgggtaacgttttacccggtacggtaaacccgttgggttacggtaccgtcgtaccaccgttacttccgttagttcccttctaacgtttccccg

SEQ ID NO: 96763 - DNA, 595 bp, Homo sapiens
  misc_feature: GYAE6OF02HB832.37.45.E01.1.454.CMB.1.raw
  modified_base (201)..(201): a, c, t, g, unknown or other
  misc_feature (201)..(201): n is a, c, g, or t
  modified_base (333)..(333): a, c, t, g, unknown or other
  misc_feature (333)..(333): n is a, c, g, or t
  modified_base (404)..(404): a, c, t, g, unknown or other
  misc_feature (404)..(404): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccaggggganagagcccaccctctcctgcagggccagtcagaatgtagcagtcacttagcctggtaccaacagagacctggccacggcccccaggcctcctcatctatggtcatcctcgaagggccactggcactccccganaggttcaggtggcaggtgggtctggagacagtaattcactctcaccatcggcagcctgcagtctagaagtnttttgcttagtttatttctgtccagctagtactcttagttcggccttacgacttcctacccgtttccgggaccgaaacgggtacctaacgggtaccgtagggaacgttaacgttaaacggaccggtaaacgttcgggtacggtaccgttacggacctaaacccgtagttcccgtttaggttcccttaaccg

SEQ ID NO: 96764 - DNA, 770 bp, Homo sapiens
  misc_feature: GYAE6OF02JF4VY.37.45.E01.1.454.CMB.1.raw
  modified_base (201)..(201): a, c, t, g, unknown or other
  misc_feature (201)..(201): n is a, c, g, or t
tcagtagtgtagatcacgaccggtgctcgatttagtgagtcagtaagggaaagggggagggaacgtgctcagttaggacccagagggaaccatggaagcccagctcagcttctcttcctcctgctactctggctcccagataccaccgcagaaattgtgttgacacagtctccagccaccctgtctttgtctccagggganagagccaccctctcctgcagggccagtcagaatgttagcagtcacttagcctggtaccaacagagacctggccaggcccccaggcctcctcacttcatcgctcgccttaccctcacgggccacgtggccactcccagccgtacggttcacggtcggcgaggttcgggtctacgggtacgacgaaggtaccttcgaccttccgtaccgaacctacttccgacggtaccaagttaccgttaacgacggtaccctaggtaaacggttcttttacggaccctttaagttttaacgttaacgtttccttaacgttaaccgtaaacgttacgggtaccttaaaccgtaaccgtaacccgttgggggttaaccggttaaccccgttttaccgggtaaacccgttaaaccgggggaaacccggttaaaggggttaccgtttaaccgtttttcccgggtaaaacccggtttaaaccggtttaggggttacggttaccccggtttaagaccccggttaaacccgtttcgttacccggtttaccggttttaccctttacccgtaacgttttcccccccgg

SEQ ID NO: 96765 - DNA, 593 bp, Homo sapiens
  misc_feature: GYAE6OF02FUV88.37.45.E01.1.454.CMB.1.raw
  modified_base (200)..(200): a, c, t, g, unknown or other
  misc_feature (200)..(200): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccagggganagagcccaccctctcctgcagggccagtcagaatgttagcagtcacttagcctggtaccaacagacgacctggccaggcccccaggctcctcatctatgctgtcttccctcacgggccacgtggccactcccagccagttcagtggcagtggtctgagacagacttcacttcacaccactcacgctagtctagcgtcctagaagtacttttgacttaacttttatacttcttacgtactaaccgtagccgttacaactacccgtgggtacggtacccgttcggaccgtaacgggaaccgtaaggtcggtaacgttcctaaccggaaccgttggtacggaccttacgggtccctaaccgtacttacgttacggttcctttacgacctttccccg

SEQ ID NO: 96766 - DNA, 583 bp, Homo sapiens
  misc_feature: GYAE6OF02FR1Z0.37.45.E01.1.454.CMB.1.raw
  modified_base (200)..(200): a, c, t, g, unknown or other
  misc_feature (200)..(200): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccagggganagacgccaccctctcctgcagggccagtcagaatgttagcagtcacttagcctggtaccaacagagacctggccacggcccccaggcctcctcactctatgctgccttccctcacgggccacgtggcactcccagccaggttcagtggcaggtggtctgganacagtacttcacttcnccaccatcagcagactggacgctagaagtatttgacttagtttatacttgtacaacgtacgtaacattacgacgttcggtccttctacgttacgtttcggacgggtaacggtaaccgtagggtacggtaacgtaacgtaaccgaaaaccggtacgtagggtacgtacgttacgaccgtaaccgtattccgttacgttccttaccg

SEQ ID NO: 96767 - DNA, 608 bp, Homo sapiens
  misc_feature: GYAE6OF02IBBHM.37.45.E01.1.454.CMB.1.raw
  modified_base (237)..(237): a, c, t, g, unknown or other
  misc_feature (237)..(237): n is a, c, g, or t
  modified_base (260)..(260): a, c, t, g, unknown or other
  misc_feature (260)..(260): n is a, c, g, or t
tcagtagtgtagatcacgaccggtgctcgatttagtgagtcagtaagggaaagggggaggaactgctcagttaggaccagagggaaccatggaagccccagctcagcttctcttcctcctgctactctggctcccagataccaccgcagaaattgtgttgacacagtctccagccaccctgtcttttgtctccaggggagagagccaccctctcctgcagggccagtcagatgttancagtcacttagcctggtaccaanagagacctggccaggcccccaggcctcctcatctatcgctgccttcctcgacgggtccacgtcggcactcccagcccaggttcaggtcggcaggtcgggtctgagacagtctcactctacactactcagcagtctaagacgctagaagtattttcgacttaacgtttattatctcgttacaaacgtgtcgttaccactacccgtgggttacggtaccgtttcgggacccgaaaggggaaccctaagggttacgtacgttttacccgtaacggtaaacgttggtacgggtccgttacggacctaacccgtacgttccgtttacgtttccgtttaccagttttacccccg

SEQ ID NO: 96768 - DNA, 645 bp, Homo sapiens
  misc_feature: GYAE6OF02IE0FZ.37.45.E01.1.454.CMB.1.raw
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtcttttgtctccgaggggagagagcccaccctctcctgcagggccagtcagaatgttagcagtcacttagcctggtaaccacagagacctggccacggccccaggctcctcatctatgctgtccttcctcgacggaccacgtcggccactccccagcccgtaggttcagtcggcgtaggtcgggtcgtgagacagtaccttcactctacacctactcacgctacgtctaacgacgctagtaagtattttgacttaactttatatcttacgtacaaacgtacgtcgtaccacgtaccgtagggtacggtaaccgttacgttcccgggaaccgtaaaccggggtaaaccgtaaggggtttacggttaaccgtttttacccggtaaacggttaaaccggtttgggtaaccggtccgttacggaccctaccgtaacgtttccgttacggtttcctttaccgtacccg

SEQ ID NO: 96769 - DNA, 650 bp, Homo sapiens
  misc_feature: GYAE6OF02GQA9P.37.45.E01.1.454.CMB.1.raw
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccaggggagagagccaccctctcctgcagggccagtcagaatgttagcagtcacttagcctggtaccaacagagacctggccacggcccccaggcctcctcatctatgctgccttccctcgacgggccacgtcggcactcccagccaggttcaggtcggcaggtgggtctggagacgagacttcactctcaccatcagcagtctagacgtcctagaagttattttgacttaacgttttatacttcgtagtaccaaacgtagtaccgttaccaaccgtaccgttcgggttaccgggttaacccgttaccggggaacccgtaaacgggggtaaccgttaacggggttacgggtaacgttttacccgtaaccgggtaaacgtttcggttaccgggtaccgttacggtaccctaacccgttacgttccgtttaccgtttacctttacccgtacgtttcccccg

SEQ ID NO: 96770 - DNA, 719 bp, Homo sapiens
  misc_feature: GYAE6OF02IRP1J.37.45.E01.1.454.CMB.1.raw
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcaagaaattgtgttgacacagtctccagcccaccctgtctttgctccgagggganagacgcccaccctctccctgccgacgggccagtcagaatgttagcagtcacttagcctggtaccagctaagaacctggaccaggcctacccgaggcctccgtnactctagtcggtcncctactcccacggacgggccctaacggttggtaacctcccccgaggtacccgtaggtttaccgaacgggtcggtaccgttaggggttcggggtacgtacggggtactaacggtacggtttcccacgttcccgtaaccgaaccctagtcccgtagaccgtccggtacccgtggacctacggttcgttaacggtaaaggtttacttttcggacctttagttttaactttcgttacgtacgagtactaaggttattaaaccgttcgttacgtcccttacgtacggttcggtaccggttccgaaccggtaaagggtcctaaggggtacgtaaacgtaaccggtaaacgtcgttaggtaccggtataccggtactaacccgatttacccgttcgttaccttcccg

SEQ ID NO: 96771 - DNA, 644 bp, Homo sapiens
  misc_feature: GYAE6OF02JX104.37.45.E01.1.454.CMB.1.raw
  modified_base (204)..(204): a, c, t, g, unknown or other
  misc_feature (204)..(204): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
  modified_base (391)..(391): a, c, t, g, unknown or other
  misc_feature (391)..(391): n is a, c, g, or t
tcagtagtgtagatcacgaccggtgctcgatttagtgagtcagtaagggaaagggggaggaactgctcagttaggaccagagggaaccatggaagccccagctcagcttctcttcctcctgctactctggctcccagataccaccgcagaaattgtgttgacacagtctccagccaccctgtctttgtctccaggggacagacnccacctctcctgccagggcctagtcagatgttagcagtcacttagcctaggaccaacagagacctgccacggccccaggcctccncntctatgctcgcttcccncgtcggccacgtggcctactcccgacgtcccgtacggttcacggtcggtcaggttcgggtcttagacgtacacgtaccttacncttccacctaccagtcctgaccagttaccgtagtacaccgtagtaacgttactttcggacttacgtttacgtcttacgttacggttacaaacgtaccgtacgtacctaccgtaccggttcggttaaccgggtcccttaccggggtacaaaccgggaaccgttaacgggttccgtagtttacccgtaacgtacgttacggtacggtcctacggacaccgttgtccgttcggtttccttaccgtcgtttaccccg

SEQ ID NO: 96772 - DNA, 637 bp, Homo sapiens
  misc_feature: GYAE6OF02GNG5I.37.45.E01.1.454.CMB.1.raw
  modified_base (198)..(198): a, c, t, g, unknown or other
  misc_feature (198)..(198): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccacctgtctttgctcgagggganagagccaccctctcctgcagggccagtcagatgtagcagtcattagcctaggtaccaacagagacctggaccacggcccccaggcctcctcactctatgctcgccttccctcgacgggccacgtggccactcccgagccgtaggttccaggtcggctacggtcgggttactgacgacacgtactccacgtctacaccatcagcagtctaagcgtaccgtagtaaagttctttacgactttaacgtttatacttacgttacgtactaaacgtcgtaccttacaaccgtaccgttcgggtaccggtaccgtttccgggaaccgaaacgggtaaccgtaacgggttacggttacctttaccggtaaccggtaacgttcgggtacggtccgtacggtacctaaccgttagttcccgtttaggtccttaccgtagtttcccccg

SEQ ID NO: 96773 - DNA, 676 bp, Homo sapiens
  misc_feature: GYAE6OF02GCOEW.37.45.E01.1.454.CMB.1.raw
  modified_base (668)..(668): a, c, t, g, unknown or other
  misc_feature (668)..(668): n is a, c, g, or t
tcagtagtgtagatcacgaccggtgctcgatttagtgagtcagtaagggaaagggggagggaactgctcagttaggacccagagggaaccatggaagccccagctcagcttctcttcctcctgctactctggctcccagataccaccgcagaaattgtgttgacacagtctcagccacctgtcttgtctccgaggggagagagccaccctcgtccgtgcaggccagtcagaatgtagcagtcattagcctggtaccaacagacgacctcggccgacggcccccaggtcctccgtacactctatcgcgttcgtccttcccgtcgacgggcctacgtcggactacgtcccgacggccgtaggttacgacggtcggacgtagggttcgggtcgtaggaacggacgtaagtacctttacgtaccgttacctaccaacctactaccgacgtaccgtacgttaccgtaacggtaccgtacccggttaggtacgttacgttttacggactttaaccttttaatacttacgttacggttaacaacggttagtccgtaccaccgttaccgtgggtaccggtaccgttacggaaccgtaaacgggaacgtagggtacggtactttaccgacggtaacgtggtcgcgttacgactaccgtacgttcgttcgtacttacncgttcccg

SEQ ID NO: 96774 - DNA, 755 bp, Homo sapiens
  misc_feature: GYAE6OF02HWDMX.37.45.E01.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (328)..(328): a, c, t, g, unknown or other
  misc_feature (328)..(328): n is a, c, g, or t
tcagtagtgtagatcacgaccggtgctcgatttagtgagtcagtaagggaaaggggaggaactgctcagttaggacccagagggaaccagtggaagccccagctcagcttctcttcctcctgctactctggctcccagataccaccgcagaaattgtgttgacacagtctccagccacctgtctttgacctccgagggganagacgtcccacccgtctcccgtgccncgggccagtccaggtaatgttaacgcagtcacttagcctggtaaccacgagacgtaccgtggacccgacggcccccgacggacctccgtcactctaagtcncgtgtccctacctcgaccggtccacgtcggtcctacctccgcgaccgtggtcctacggtcggacgtaggttcgggtcttacgggaacgtaccgacgttaccgttgaccgttacttcccgacctaactaccgtacgtcccgacgtttaacgacgacccggtccgttaacggtaacgtttacgtttccgtaacgtttactttaaacgtttcttacggttaccgttaaacaacgtacggttacaacccgttaacgtaccgggttcgttaacccgtccggttaaccggacccggttaaaccggggtaacctacgggtttaccgggttacgtttacccggttaaccggtacgttacggtcggtaaccttccggtaacccgttacttaccggtccgttttaaccggtcctttacggtacccgtttacccccgg

SEQ ID NO: 96775 - DNA, 609 bp, Homo sapiens
  misc_feature: GYAE6OF02GC08U.37.45.E01.1.454.CMB.1.raw
  modified_base (200)..(200): a, c, t, g, unknown or other
  misc_feature (200)..(200): n is a, c, g, or t
  modified_base (291)..(291): a, c, t, g, unknown or other
  misc_feature (291)..(291): n is a, c, g, or t
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccagggganagagccacctctcctgcagggccagtcagaatgttagcagtcacttagccgtggtaccacagacgacctggccacggcccccaggcctccnactctagtgctgtccttcccctcgacgggcctacgtcggcctactccccacggtccctaggttccgaggttcggacgtagggtcgggtctggacgacgagtaccttcactcctacacctataccgagctacgtctaggacgtcctaggaattagtttcgacttacttatctcgttctactaacncggtacctanacccgtacgtcggtaccggtacctaccgggcgaaacgggtacgtaagggtccgttacgtttaccgaacggtacttggtacggtctacgaccgtacgtctacgttctttccgtctacccttcccg

SEQ ID NO: 96776 - DNA, 681 bp, Homo sapiens
  misc_feature: GYAE6OF02GY5OQ.37.45.E01.1.454.CMB.1.raw
  modified_base (298)..(298): a, c, t, g, unknown or other
  misc_feature (298)..(298): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccgaggggagaggagcccaccctctcctgcagggccagtcagaatgttagcagtcacttagcctaggtaccaacagagacctggccacggcccccaggcctccgtcntctatcgctcgtccttcccgtcgacgggccctacgtcggccactcccacgtccgaggtttccgaggtcggcgtagggtgggtctaggacgtacgtacgtacttccgaccttctaccacctaactcgacgactacggtactaacggacgtaccgttaggtaaacgtttacgttttcgacctttaacttttatacgttcttacgtaacaacgtacggtcctaccgtaccgtaccgtcggggttacgtacccgttaccggggaaccgtaaacggggtaaccctaggggttacgtttacgtttacccgtaaaccggtacgttagggtccggtacgtacgtacctacccgttcttccgtttacggttcctttacgtaccctttccccg

SEQ ID NO: 96777 - DNA, 917 bp, Homo sapiens
  misc_feature: GYAE6OF02JMMG1.37.45.E01.1.454.CMB.1.raw
  modified_base (203)..(203): a, c, t, g, unknown or other
  misc_feature (203)..(203): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcaagaaattgtgttgacacagtcctccagccaccctgtctttgtctccgagggganagacgcccacctctcctgcgacgggccagtcaagaacgtgttacggctacgtcctacgttacgccgtacggtaaccaaacgaacggaacggtacccgtacgggaccccgaacccgggacccccccgaagggtccccttacccggtacctaacgttaccgttaacgtcggtcccgttccggttcccctttaccccggttaccggaaccggggtacccctaaccggtccggtacccgtaacccgttacccccgaaccggtcccgtaaacggggttccgtaacgggtcggtacggtacgggttccggggtagtacgggacgtaacggttacgtaccttacttacccgtaccgtaccctaaaccgtcgtaccacgggtacctaaccgtacgtacggaccgttacggtacggttaaaacgttcgtttaaccgtacctttaacgttttaacgttaacgttaccgtttacgttaaaccgtaaaccgtacggtcccggtaaccttaacccgggttacccggttacgggtttacccggtaccccgggtttaccgggaacccgggtaaaccggtaccggggttaaacgggttaccgtttaccgggtttaacccttaaccggggtaacccggtttacgggtttccggtaaccgttaccgggtacccttaccggtttaaccgttccgtttaccggtttaccctttaccgttaccccgtttccccgg

SEQ ID NO: 96778 - DNA, 635 bp, Homo sapiens
  misc_feature: GYAE6OF02JCG17.37.45.E01.1.454.CMB.1.raw
  modified_base (377)..(377): a, c, t, g, unknown or other
  misc_feature (377)..(377): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccgagggggagagacgcccaccctctcctgcagggccagtcagaatgttagcagtcacttgcctaggtaaccaacagacgaccgtcggaccacggcccccaggcctcctcatctatgctcgtccttcccgtcgacgggccacgtcggcactcccagcctaggttcaggtcggcgtaggtcgggtcngagacacgtacttcacttcacacactcagctagtactagacgtctagtaagttattttacgacttacgtttaatcttctagtaaccaactacggtccgttacaaccgtccggttacgggttacggtacccgtttacggaccggtaaacgggtaaccgtaagggttaccggtacttttaccggaacggttaacgttcggtaacggtccgtacgtcccgtaacctcgttccgttacgtttcccttccgtacctttccccg

SEQ ID NO: 96779 - DNA, 589 bp, Homo sapiens
  misc_feature: GYAE6OF02JDM2R.37.45.E01.1.454.CMB.1.raw
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (376)..(376): a, c, t, g, unknown or other
  misc_feature (376)..(376): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
  modified_base (454)..(454): a, c, t, g, unknown or other
  misc_feature (454)..(454): n is a, c, g, or t
  modified_base (512)..(512): a, c, t, g, unknown or other
  misc_feature (512)..(512): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaattgtgttgacacagtctccagccacctgtcttgcctccgaggggagagagtcccaccctctcctgacgacgggcccagtcaagactgttagcagtcacttgctggtaccangngaccngcacgcccngcctcctnctctatcgctcgtcctcctcgacggccacgtcggcactcccgagccgtagttcgagtcggcgtagtcgggctagacgacgagtacctcnctcctaccgaccatccgacacgagttccaaggacgtcctaggacttatttcgactacttntacgtntacgtactaagngtacgtccaccgtcgcgttacgggtaccctacggccgtaaacgggtacgaacggggtnttaccgttccaacggttacctagggtccggccgtactaccgactaccttacgtccgttattaccggtaccttacccg

SEQ ID NO: 96780 - DNA, 700 bp, Homo sapiens
  misc_feature: GYAE6OF02G2IH8.37.45.E01.1.454.CMB.1.raw
  modified_base (196)..(196): a, c, t, g, unknown or other
  misc_feature (196)..(196): n is a, c, g, or t
  modified_base (236)..(236): a, c, t, g, unknown or other
  misc_feature (236)..(236): n is a, c, g, or t
tcagtagtgtagatcacgaccggtgctcgatttagtgagtcagtaagggaaagggggaggaactgctcagttaggacccagagggaaccatggaagccccagctcagcttctcttcctctgctactctggctccagataccaccgcagaaattgtgttgacacagtctccagccaccctgtctttgctccaggggnagagccacctctcctgcgagggccagtcagtaagtgttancagtcctacgttagcctaggtaaccaacgtacgacgtaccgtcggtacccgacggccccccaaggcccttccgactattcctatcgctcggtccttccgtcgacggtcctacgtcggctacgtcccagtccctacggttgacggttggcgtagtcgggtcgtcgacggtacgaggtacgttaccagttacctaccgaccgtagtacacgtccgacgtccgtcggccgtaacgtcgtaggtaagttacttttggaactttaacgtttacgttacgttcgtaactaaacgtacgtaacgtaagttacgtaccgttcggtcccttaacttccgtaccggttttcgggaccggtaaccgggttaacgtaagggttacggaacgttaccgtaaacggtaaaacccgttacgttaccgggtacgttacggtacccgaccgttaaccacgttttacggtacccgttttacc

SEQ ID NO: 96781 - DNA, 642 bp, Homo sapiens
  misc_feature: GYAE6OF02IZ20N.37.45.E01.1.454.CMB.1.raw
  modified_base (417)..(417): a, c, t, g, unknown or other
  misc_feature (417)..(417): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccaccctgtctttgtctccaggggagagagcccaccctctcctgcagggccagtcagaatgttacgcagtcacttacgccgtggtaccaacagacgacctggaccacggcccccgaggcctccctacacgtcctatcgctcgtccttcccctacgacggccaccgtcggcctactaccccagccgtaggttcaggtcggcaggtcgggtctaggacgacgacgacttccacgttctctacctntacacgactagtacgtacgacgcctagaagtacttttgacctactttaactattctagttacaacgtcgtaccgtcaaccgtaccgtcggtacgtaccttacgggaccgtaaacgggaacccttaagggtacgttactttaaccgaccggtaaacgtcggttacggtaccgttacggtacccgtaaccgtcttaccgtcgtttacccttccgtctttacccccgg

SEQ ID NO: 96782 - DNA, 705 bp, Homo sapiens
  misc_feature: GYAE6OF02IW9AC.37.45.E01.1.454.CMB.1.raw
  modified_base (202)..(202): a, c, t, g, unknown or other
  misc_feature (202)..(202): n is a, c, g, or t
tcagtagtgtagatcacgaccggtgctcgatttagtgagtcagtaagggaaagggggaggaactgctcagttaggacccagagggaaccatggaagccccagctcagcttctcttcctctgctactctggctccagactaccacgcagaaattgtgttgacacagtcctccagcccacccttgtctttgtcctccgaggggngagcgccacccttctccgtcgcgacggcctagtcgagattggttacgcaggtcctacgttagcctcggtaaccaacacgacgaccgtcgaccgaccgggccccagtcctcctctatccttagtcgtctcgtccctttaccgaccggacggcctacgtccgtcgaccctacccgacggtccggtacgttcgacggtcggcgttacggtcgggtctacggacgacgtaccggtaaccttcaccgttcctacccgacgtactacgctacccgtactacgcgtactcgtaacgtaacttgtcctagttaactttacgtactaccggttataccgtaactcggcccttagcccgttacgggttcggttaccggtcccgttacgggaaccctaacgggtaactttcggggttaaccttacccggttaaccgttaagggtcgtccgggttacttacccgacggtaccaccgtttcgtaaccgtttccgttcctacgttcccgttaacccg

SEQ ID NO: 96783 - DNA, 741 bp, Homo sapiens
  misc_feature: GYAE6OF02FTCYL.37.45.E01.1.454.CMB.1.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
tcagtagtgtagatcacgaccggtgctcgatttagtgagtcagtaagggaaagggggaggaactgctcagttaggacccagagggaaccatggaagccccagctcagcttctcttcctcctgctactctggctcccagataccaccgcagaaattgtgttgacacagtctccagccacctgtctttgctccgaggggnagacgcccacctctcctgcagggccagtcagatgtanctagtcacttagcctaggtaaccanagacaccgtcggccacggcccccaggtcctccgtcactctatcggcctcgtccttccctcgacgggccacgtcggaccacgtcccagccgtaggttcacggtcgacgtagggttcgggtctaggaacgacgtacgtaccgttcaccgttacctccaaacccgtactacgtacgtaccgtaacggttaccgtaacggtaccgttaccgttaaggtaacgtttaacgttttaccggaaccttttaaacgttttactaagttcccgttaacgtaaccgttaaacgtcgggttacccttaccgaacccggttacggttccggggtaaccggttacccgttaccggggaaccgtaaaccggggtacccgttaaggggttcggttaaccctttaccggtaaaccggtaacggttacgggttacccgggtcttacggaccccgttaaccgtcgtttacgttcccgttacgttactaccgtttcccccg

SEQ ID NO: 96784 - DNA, 688 bp, Homo sapiens
  misc_feature: GYAE6OF02F0HXV.37.45.E01.1.454.CMB.1.raw
  modified_base (251)..(251): a, c, t, g, unknown or other
  misc_feature (251)..(251): n is a, c, g, or t
tcagtagtgtagatcacgaccggtgctcgatttagtgagtcagtaagggaaagggggaggaactgctccagttaggacccagagggaaccagtggaagccccagctcagcttctcttcctcctgcttactctggctcccagataccaccgcagaaattgtgttgacctacagtctccagccacccttggtctttgcctccgaggggagagacgccaccctctcctgcgacggccagtcaagactggttacncgtaagtcaacttcggcctaggtacccaagacggtacaccgtaggcccgacggcccccaggcctaccgtacacttctactcgtcgtcgtcccttccgcgaccggtcctaagtcggactaccgtcccacggtacctggttaccgaggcggacgtaggtcgggttctaggtacgactagacctttacaccttcgaccacctataccgagtacgtacgttcgtaacgtacgtcgtaagttaaattcgttttacgaccttagtttttacactttcgaacgttacaaacggtccttccgttaacaaccgttccggtcggtaccgtacccgttaccgggaaacctaaacgggtctaaccgggtcgttacccgttacgtaacggtcctccgggtcgtccttacgccgtaacgtcgttcctggtttccgacttcccggtaacccg

SEQ ID NO: 96785 - DNA, 516 bp, Homo sapiens
  misc_feature: GYAE6OF01D0SKU.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcggcggcagtggatcgtgggacagaattcactctcacatcagcagcctgcagcctgatgattttgctaactttatactgaccaacagttattaattagttttccgtaggtaccgttcggaccgaaagggacctaaggtcggacagtaccgaaacgtaacgtagtggctagctacgatccg

SEQ ID NO: 96786 - DNA, 496 bp, Homo sapiens
  misc_feature: GYAE6OF01A6RAJ.29.59.F04.1.454.CMB.1.raw
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcggcggcagtggatctgggacagaattcactctcaccatcagcagcctgcagcctgatgattttgctaacttattactgaccaacagttataattagttttccgtggtacgttcggaccaagggaccaaggtcgacatcaaacgactgtggctgcncntc

SEQ ID NO: 96787 - DNA, 660 bp, Homo sapiens
  misc_feature: GYAE6OF01AEPMH.29.59.F04.1.454.CMB.1.raw
  modified_base (102)..(102): a, c, t, g, unknown or other
  misc_feature (102)..(102): n is a, c, g, or t
  modified_base (193)..(193): a, c, t, g, unknown or other
  misc_feature (193)..(193): n is a, c, g, or t
tcagatagagtactcacgaccggtgctcgatttagtacacacacttagggattggggcaggagtcagacccagtcaggacacagcatggacatgaggtcccntcagctcctgggctcctgctgctctggctccaggtgccaaatgtgacatccagatgacccagtctccttcactgtgtctgcatctgtagtnacagacgtcacatcacgttgccggcagtcagtagtatagtagcgtggtcgcctaggtactcgagctaaggaacctagggaacgtcccgtaagtctaccgtgactcgtaagtacggctacgtagttagaagtcgacgtccagtacgaaggttcggacgtacgtaggtcggtactcgtagggtactacggttaacgttccgtaccgttaccgtaccgtaccgtagttaccgacgtaccgtaacggtcccgttacggaccttacggtcccgtttaggtaaaccgttcggttaacgttttcggaaccgtttaaacgttacgttaaccgtcgtaaccctaacgtacgttaacttaacgttcggtttacccgaggtaccggttcgaccgtaagggtacccgtaaacgggtctaaccgtacgttaacgaaccggtacgttcggtacggaccttaggaccctacgttgttaccgg

SEQ ID NO: 96788 - DNA, 488 bp, Homo sapiens
  misc_feature: GYAE6OF01D65U9.29.59.F04.1.454.CMB.1.raw
  modified_base (486)..(486): a, c, t, g, unknown or other
  misc_feature (486)..(486): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtcccatcaaggttcggcggcagtggatctgggacagaattcactctcaccatcagcagcctgcagcctgatgattttgctaacttattactgccaacagtataatagtttcgtgacgttcgcaagggaccaaggtgacatcaaacgaactgtggactgcacntc

SEQ ID NO: 96789 - DNA, 490 bp, Homo sapiens
  misc_feature: GYAE6OF01D3AIZ.29.59.F04.1.454.CMB.1.raw
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcggcggcagtggatctgggacagaattcactctcaccatcagcagcctgcagcctgatgattttgctaacttatactgaccaacagtataattagtttccgtggtacgttcggccaagggaccaaggtgacatcaaacgatgtgctgcncntcg

SEQ ID NO: 96790 - DNA, 508 bp, Homo sapiens
  misc_feature: GYAE6OF01BILPN.29.59.F04.1.454.CMB.1.raw
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcgaaggttcggcggcagtggatcgtgggacagaattcactctcaccatcagcagcctgcagcctgatgtattttgctaacttattactgaccaactagtaattaattagttttccgtggtacgttcggaccgaagggaccaaggtggacagtacaaacgtactgtggctgcncgtntcg

SEQ ID NO: 96791 - DNA, 494 bp, Homo sapiens
  misc_feature: GYAE6OF01CXK7W.29.59.F04.1.454.CMB.1.raw
  modified_base (492)..(492): a, c, t, g, unknown or other
  misc_feature (492)..(492): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcggcggcagtggatctgggacagaattcactctcaccatcagcagcctgcagcctgatgattttgctaacttattactgccaacagtataatagttttccgtggtacgttcggccaagggaccaaggtggacatcaaacgaactgtggctgcaccntc

SEQ ID NO: 96792 - DNA, 512 bp, Homo sapiens
  misc_feature: GYAE6OF01B3RMY.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaagtgaggtccatcaaggttcggcggcagtggatctgggacagaattcactctcaccatcagcagcctgcagcctgatgattttgctaacttattactgaccaacagtaattaattagttttccgtggtacgttcggaccgaaagggaccgaagggtggaacagtcaaacgtaacgtggtcggctagctaccattcg

SEQ ID NO: 96793 - DNA, 541 bp, Homo sapiens
  misc_feature: GYAE6OF01DIM6D.29.59.F04.1.454.CMB.1.raw
  modified_base (537)..(537): a, c, t, g, unknown or other
  misc_feature (537)..(537): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggcagtcagagtattagtagctggttggcctggtatcagcagaaaccagggaagcccctaagctcctgatctataaggcttctagtttagaaagtgagtccagtcgaagggttcggcggcaggtggatcgtgggacagtaattcactctcaccatcagcagcctgcagcctagtatgtattttgactaactttacttactcgacctaaatagttaattaagttagttttaccgtaggtaccggttcggacgaaacggggtacgaagggtcgaactagtacgaaaacgtacgtaggtacggactagacgtaactnttcg

SEQ ID NO: 96794 - DNA, 547 bp, Homo sapiens
  misc_feature: GYAE6OF01CJX06.29.59.F04.1.454.CMB.1.raw
  modified_base (278)..(278): a, c, t, g, unknown or other
  misc_feature (278)..(278): n is a, c, g, or t
  modified_base (352)..(352): a, c, t, g, unknown or other
  misc_feature (352)..(352): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggcagtcagagtattagtagctggttggcctggtatcagcagaaacagggaaacnccctaagctcctgatctaataaggcgtactagtttagaaagtgaggtccatcaaggttcggcgcagtggatcgnggacagtaattcactctacacatcagcagcctagcagcctagatgtattttagcttaacttattactcgacctaataagttattaattacgttttaccgaggttacgttaccgggaccgtaaaggggacctaagggtacgacgtaactaccgaaaccgtaacgttggtacgggtctacggccaccgtagttaccg

SEQ ID NO: 96795 - DNA, 560 bp, Homo sapiens
  misc_feature: GYAE6OF01DSY55.29.59.F04.1.454.CMB.1.raw
  modified_base (279)..(279): a, c, t, g, unknown or other
  misc_feature (279)..(279): n is a, c, g, or t
  modified_base (389)..(389): a, c, t, g, unknown or other
  misc_feature (389)..(389): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttcggccggccagtcagagtatagtagctggttggcctggtatcagcagaaaccagggaacnccctaagctcctgatctataaggcgttactagtttagaagtgaggtccatcaaggttcggcgacagtggatcgtgggacagtattcactctcaccatcagcagcctgcanccgtgatgtatttgactaacttattactcgacctaacagttaactaaagtttgttttacccggtaggtaaccgtttcggacccgtaaacggggaacctaaaggggttcggaacaagttaacccgaaaacgtaaccgttaggtcgggtactagacctaaccgtagttacccg

SEQ ID NO: 96796 - DNA, 526 bp, Homo sapiens
  misc_feature: GYAE6OF01BQ74V.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggcagtcagagtattagtagctggttggctggtatcagcagaaaccagggaaagcccctaagctcctgatctataaggcgtatagtttagaaagtgaggtccatcgaaggttcgcggcagtggatcgtgggacagaattcactctcacatcagcagctgcagcctgatgtattttgactaacttattactgaccaacaagttaattaattacgttttaccgtaggtacgttcggtaccgaaagggaccgaagggtacggacagtaacgaaacgtaacgtacgtacggactagcaccgtatccg

SEQ ID NO: 96797 - DNA, 557 bp, Homo sapiens
  misc_feature: GYAE6OF01E2OF3.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcggcggcagtggatcgtgggacagaattcactctcaccatcagcagcctgcagcctgactgtattttgctaactttattactcgtaccaaactagttaacttaaagttacggtttttacccggtaggtaaccggtttcgggacccgtaaaggggaccctaaagggtcggaactacgtacgaaaacggtaacgtggttacggctaggccctaccgtattccg

SEQ ID NO: 96798 - DNA, 507 bp, Homo sapiens
  misc_feature: GYAE6OF01BVH1D.29.59.F04.1.454.CMB.1.raw
  modified_base (505)..(505): a, c, t, g, unknown or other
  misc_feature (505)..(505): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcggcggcagtggatcgtgggacagaattcactctcaccatcagcagcctgcagcctgatgtattttgctaactttattactgaccaactagtaattaattaggttttccgtgggtaccgtttcggacctaagggaccaaggtggacatcaaacgactgtggctagcacntc

SEQ ID NO: 96799 - DNA, 527 bp, Homo sapiens
  misc_feature: GYAE6OF01CGTEV.29.59.F04.1.454.CMB.1.raw
  modified_base (520)..(520): a, c, t, g, unknown or other
  misc_feature (520)..(520): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaacgcccctaagcctcctgatctataaggcgtctagtttagaagtgaggtccatcaaggttcggcggcagtggatcgtgggacagaattcactctcaccatcagcagcctgcagcctgatgtattttgactaacttattactgaccaactagttattaaagttagttttaccgtggtaccggttcggaccgaaagggtaccaagggtcggaactagtaccaaacgtactggtacggctagaccncgtatcg

SEQ ID NO: 96800 - DNA, 509 bp, Homo sapiens
  misc_feature: GYAE6OF01EBKGW.29.59.F04.1.454.CMB.1.raw
  modified_base (506)..(506): a, c, t, g, unknown or other
  misc_feature (506)..(506): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaagcccctaagctcctgatctataaggcgtctagttagaaagtgaggtccatcaaggttcggcggcagtggatcgtgggacagaattcactctcaccatcagcagcctgcagcctgatgattttgctaactttattactgaccaactagttaattaattagttttccgtggtaccgttcggaccgaagggaccaaggtggaacatacaaacgactaggtcggactgacacntcg

SEQ ID NO: 96801 - DNA, 510 bp, Homo sapiens
  misc_feature: GYAE6OF01D0TWQ.29.59.F04.1.454.CMB.1.raw
  modified_base (483)..(483): a, c, t, g, unknown or other
  misc_feature (483)..(483): n is a, c, g, or t
  modified_base (505)..(505): a, c, t, g, unknown or other
  misc_feature (505)..(505): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtcccatcaaggttcggcggcaggtggatcgtgggacagaattcactctcaccatcagcagcctgcagcctgatgtattttgactaacttattactgaccaacagttattaagttacgttttaccgtggtacgttcggacctaagggaccaagggtcganactcaaacgactgtggactgcncatcg

SEQ ID NO: 96802 - DNA, 534 bp, Homo sapiens
  misc_feature: GYAE6OF01DHSZA.29.59.F04.1.454.CMB.1.raw
  modified_base (359)..(359): a, c, t, g, unknown or other
  misc_feature (359)..(359): n is a, c, g, or t
  modified_base (525)..(525): a, c, t, g, unknown or other
  misc_feature (525)..(525): n is a, c, g, or t
  modified_base (531)..(531): a, c, t, g, unknown or other
  misc_feature (531)..(531): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctgggttggcctggtatcagcaagaaaccgagggaaacgcccctaagctcctgatctataaggcgttctaagttagaaagtgaggtcccatcaaggttcgcggcaggtggatcgngggacagtattcactctacaccatcagcagcctgcaggcctgattgtattttcgactaactttattacctgtacccaaactagttaattaagtttacggttttaccgtgggtaccggttccggaccgaacgggaccaagggtcgacatacaaacgtactggtcgcngccacnttc

SEQ ID NO: 96803 - DNA, 541 bp, Homo sapiens
  misc_feature: GYAE6OF01CKG7M.29.59.F04.1.454.CMB.1.raw
  modified_base (275)..(275): a, c, t, g, unknown or other
  misc_feature (275)..(275): n is a, c, g, or t
  modified_base (535)..(535): a, c, t, g, unknown or other
  misc_feature (535)..(535): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcacatcacttgccgggcagtcagagtattagtagctggttgcctggtatcagcagaaacagggaacnccctaagctctagatactataacgctactagtttagaaagtgaggtccagtcgaagggttcggcggcaggtggatcgtggacagtaattcactctcacatcagcagcctgacagcctgactgtatttgactaacttattactgacctaactagtaacttaatttacgtttacgttacggtaaccgttcggtacgtaaacgggtaccgaaggtcggaactaacgtacgaaacggtaactacggtacggctagaccaccgtnttaccg

SEQ ID NO: 96804 - DNA, 548 bp, Homo sapiens
  misc_feature: GYAE6OF01EMC02.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctgggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaacgccctaagcctcctgatctataaggcgtctagttagaagtgagtccatcgaaggttcggcggcagtggatcgtagggacagaattcactctcacatcagcagcctgcagcctgatgtatttgacttaactttattactgacctaactagttaattaagttacgttttaccggtaggtaccggttccggaccgtaaaggggacccgtaagggtacggaactaagtaccgaaaacggtaacgtggtacggactagacctaccgtgttaccg

SEQ ID NO: 96805 - DNA, 524 bp, Homo sapiens
  misc_feature: GYAE6OF01CRZCP.29.59.F04.1.454.CMB.1.raw
  modified_base (520)..(520): a, c, t, g, unknown or other
  misc_feature (520)..(520): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaacgcccctaagctcctgatctataaggctctagttagaaagtgaggtccatcaaggttcggcggcagtggatcgtgggacagaattcactctcaccatcagcagcctgcagcctgatgtattttgactaacttattactgacctaactagttattaattagttttccgtaggtaccgttcggacctaaaggggacctaagggtcgacataccgaaacgtaactggtacggctagaccaccgtntccg

SEQ ID NO: 96806 - DNA, 498 bp, Homo sapiens
  misc_feature: GYAE6OF01EEZV4.29.59.F04.1.454.CMB.1.raw
  modified_base (279)..(279): a, c, t, g, unknown or other
  misc_feature (279)..(279): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaancccctaagctcctgatctataaggcgtctagtttagaagtgaggtccatcgaaggttcggcggcagtggatctgggacagaattcactctcacatcagcagcctgcagcctgatgattttgctaacttatactgaccaacagtattaattagttttccgtggacgttcggcctaaagggaccaagtgtaggacatcaaaacgactgtaggcctgcacta

SEQ ID NO: 96807 - DNA, 558 bp, Homo sapiens
  misc_feature: GYAE6OF01B1ZNJ.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaacgccctaagctcctgatctataaggcgtctagtttagaaagtgagtccatcgaagggttcggcggcaggtggatcgtgggacagtaattcactctcaccatcagcagcctgcagcctgatgtattttgactaatttattactcgaccctaatagttaattaacgttacgttttccggtaggtaccggttccgggaccgtaaacggggaaccgtaagggtcggaactacgtaccgaaaaccggtaacgttcggtacggacttaggcctaccgtagttaccg

SEQ ID NO: 96808 - DNA, 724 bp, Homo sapiens
  misc_feature: GYAE6OF01BBB49.29.59.F04.1.454.CMB.1.raw
tcagatagagtactcacgaccggtgctcgatttagtacacacacttagggagttggggcaggagtcagacccagtcaggacacagcatggacatgagggtccccgctcagctcctcgggctcctgctgctctggctcccaggtgccaaatgtgacatccagatgacccagtctccttccactgtcgtctgacatcgtgtaggtgacagagtcaacattcgacttgccggacagtcagtagtattagtagctggttggcctggtatcgacgcaagaaaccgagggaaacgcccctaaaggtcctacccgtaggaactactaacgtaaacggtcgttaaccgtaaggttttaacggaaagttggaacggtacccctaagttcgaaacgggttccggacggacctagtggaactcgtagggaccaggtaaacttccacttactacgaacgtacgtcgaacggtcgaacggtacctaggaccgtacgtacccgtagttaacgttggttaactttttacggaaccttaacgtttaactttaacgtcgttaacccctaaagtaacgttaagttaaacgtttacggtttaccggtacggtaaccgggttacggtaaccgggaaacgggttaacccggtaaacggtacgggtaaccgaacgttaaccgtaaaaccggtaaacgtacggttaccggacccggttagtaacccggtaaccctaccgtttaccgg

SEQ ID NO: 96809 - DNA, 543 bp, Homo sapiens
  misc_feature: GYAE6OF01BPQP9.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccgagggaaacgcccctaagctcctgatctataaggcgtctagtttagaaagtgaggtccatcgaaggttcggcggcaggtgatcgtgggacagaattcgactctcacatcagtcacgcctgcacgtcctagattgtattttgactaattattactgacctaagagtaattaattacgtttccgtaggtaccgttcggaccgtaacgggaccgtaagggtcgtactagtaaccaaacggtaactggtacggacttcggcctaaccgtgttaccg

SEQ ID NO: 96810 - DNA, 535 bp, Homo sapiens
  misc_feature: GYAE6OF01DRU4H.29.59.F04.1.454.CMB.1.raw
  modified_base (360)..(360): a, c, t, g, unknown or other
  misc_feature (360)..(360): n is a, c, g, or t
tcagatagagtactcacgaccggtgctcgatttagtacacacacttagggagttgggggcaggagtcagacccagtcaggacacagcatggacatgagggtccccgctcagctcctggggctcctgctgctctggctcccaggtgccaaatgtgacatccagatgacccagtctccttccactgtgtcctgcatctgtaggtgacagagtcaccatcacttgccgggccagtcagagtattagtagctggttcggcctggtatcgagcagaaaccgaggggaaacgcccctaagctcctgatctataaggcgtactagtttacgaaagtgaggtccatcgaaggttcgcgcagtgatcgngggacagattcgacttcacaccatcagcacgcctgcagcctgattgtattttcgactaactttatactgaccaagtagtaattaagttagtttccgtaggtacgttcggaccgaaacgggtaccgtaaggtcggacacgtacaaacgtactcgtaggcctgcccaccgtagttcg

SEQ ID NO: 96811 - DNA, 574 bp, Homo sapiens
  misc_feature: GYAE6OF01COMGG.29.59.F04.1.454.CMB.1.raw
  modified_base (354)..(354): a, c, t, g, unknown or other
  misc_feature (354)..(354): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggctctagttagaagtgagtccatcaaggttcggcggcagtggatcgtggganagaattcactctcaccatcagcagcctgcagcctgatgtattttcgactaactttattacgtgaccctaacgtaagttaacttaatttacggtttttcccggtagggtaaccgtttccggggaccgtaaacgggggtaccctaaaggggttacggaaccaacgttaccgaaaaccggtaacgttgggttacggaccttaggaccctaaccgtgttacccg

SEQ ID NO: 96812 - DNA, 549 bp, Homo sapiens
  misc_feature: GYAE6OF01EEPG0.29.59.F04.1.454.CMB.1.raw
  modified_base (543)..(543): a, c, t, g, unknown or other
  misc_feature (543)..(543): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaacgcccctaagctcctgatctataaggcgtctagttagaaagtgagtccatcaaggttcggcggcagtggatgtgggacagaattcactctcaccatcagcagcctgcagcctggtatgtattttcgactaactttactaactcgacctaactagttaattaagtttacgttttaccggtgggttaaccgttccgggaaccgtaaggggaacccgtaagggtacgactaataccgaaaacgtacgttagtcggtactgacctacgngttccg

SEQ ID NO: 96813 - DNA, 524 bp, Homo sapiens
  misc_feature: GYAE6OF01AZQK9.29.59.F04.1.454.CMB.1.raw
  modified_base (416)..(416): a, c, t, g, unknown or other
  misc_feature (416)..(416): n is a, c, g, or t
  modified_base (444)..(444): a, c, t, g, unknown or other
  misc_feature (444)..(444): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcggcggcaggtggatcgtgggacagaattcactctcacatcagcagcctgcagcctgatgattttgactaacttattacngaccaactagtaataattagttttccgnggtacgttcggaccaaagggaccaagggtcggaataagtaccaaaacgaacttggtagggcctagcctacctagttaccg

SEQ ID NO: 96814 - DNA, 567 bp, Homo sapiens
  misc_feature: GYAE6OF01BZ1G9.29.59.F04.1.454.CMB.1.raw
  modified_base (349)..(349): a, c, t, g, unknown or other
  misc_feature (349)..(349): n is a, c, g, or t
  modified_base (562)..(562): a, c, t, g, unknown or other
  misc_feature (562)..(562): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcaagaaaccagggaaacgcccctaagctcctgactctataaggcgtactagtttagaaagtgacggtccatcgaaggttcggcggnaggtggatcgtgggacagtaattcactctacactatcagcagctgcagcctagatgtattttgacttaactttattaacctcgaacctaacgtaagttaacttaaatttacggttttccggtacgggtacgtttcgggacccgtaaaggggtaacccgaaagggttcggaactataaccgaaacgtaacgtggtacggacgttagcctaccgnttacg

SEQ ID NO: 96815 - DNA, 505 bp, Homo sapiens
  misc_feature: GYAE6OF01CF55I.29.59.F04.1.454.CMB.1.raw
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
  modified_base (378)..(379): a, c, t, g, unknown or other
  misc_feature (378)..(379): n is a, c, g, or t
  modified_base (491)..(491): a, c, t, g, unknown or other
  misc_feature (491)..(491): n is a, c, g, or t
  modified_base (499)..(499): a, c, t, g, unknown or other
  misc_feature (499)..(499): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatctgtagtgacagagtcacatcacttgccggcagtcagagtattagtagctggttggcctggtatcagcagaaacagggaaacgccctaagctcctgatctanaggctctagtttaagaagtgaggtccagtcgaaggttcggngcagtgatcgtggacagatcactctcacatcagcagctgacnnctgatgtatttgactattatactgaccatagttataagttacgtttcgtcggtacgttacggacgaagggtaccgaagggtcgaatatacgaaacgtacgttgtacggtacngactacgnttaccg

SEQ ID NO: 96816 - DNA, 509 bp, Homo sapiens
  misc_feature: GYAE6OF01AXVF5.29.59.F04.1.454.CMB.1.raw
  modified_base (449)..(449): a, c, t, g, unknown or other
  misc_feature (449)..(449): n is a, c, g, or t
  modified_base (506)..(506): a, c, t, g, unknown or other
  misc_feature (506)..(506): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaacgcccctaagctcctgatctataaggcgtctagtttagaaagtgacggtccatcgaaggttcggcggcaggtggatcgtgggacagaattcactctcaccatcagcagctgcagcctgatgtattttgacttaacttatactgaccaatagttaataagttagttttccgnggtacgttcggaccgaaagggaccaaggtgacatacgaaacgatcgtgctgcacgtntcg

SEQ ID NO: 96817 - DNA, 537 bp, Homo sapiens
  misc_feature: GYAE6OF01ADU9C.29.59.F04.1.454.CMB.1.raw
  modified_base (531)..(531): a, c, t, g, unknown or other
  misc_feature (531)..(531): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggcagtcagagtattagtagctggttggcctggtatcagcagaaaccagggaaacgcccctaagctctgatctataagcgtactagttagaagtgagtccatcgaaggttcggcgcagtgatcgtggacagacttcactctcaccatcagcagcctgcagcctgtatgtatttgactaactttatactcgaccaagtagttaattaagttacggttttaccgtaggtaccggttaccggaccgtaaacgggaccgaagggttcggaactacgtaccgaaaacgtacttggtacggctacgactaccgnttaccg

SEQ ID NO: 96818 - DNA, 547 bp, Homo sapiens
  misc_feature: GYAE6OF01CJO3V.29.59.F04.1.454.CMB.1.raw
  modified_base (387)..(387): a, c, t, g, unknown or other
  misc_feature (387)..(387): n is a, c, g, or t
  modified_base (541)..(541): a, c, t, g, unknown or other
  misc_feature (541)..(541): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcacatcacttgccggcagtcagagtatagtagctggttgcctggtatcagcagaaaccgagggaaacgcccctaagcctcctgatctataaggctactagttagaagtgaggtccatcaaggttcggcggcagtggatcgtggacagtaattcactctacaccatcagcagtcctgacngcctagtatgtatttgactaactttacttactcgtaccaactaagttattaagtttacgttttaccgtcggtaaccggttcggaccgtaaacgggtaccgtaaagggtcgaataacgtacgaaaacgtagtacggtacggactagaccaccgtnttaccg

SEQ ID NO: 96819 - DNA, 645 bp, Homo sapiens
  misc_feature: GYAE6OF01CRF56.29.59.F04.1.454.CMB.1.raw
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatccacgttcgccgggccagtcagagtattagtagctggttggcctggtatcagcagaaaccgagggaacgcccctaagcctcctgactctataaggcgttcttaagtttagaaagtgacgtccagtacgaagggttcggcggcagtggatcgngggacagattcactctcacntcagcagcctgacagtcctagacttgtattttcgaccttaaattttacttacgtacgtaccctaaacgtaagtttaaattaaacggttttacgtttttacccgggtagggttaacccggttttccgggaacccgtaaaacgggggtaccccgtaaaggggttccgggaaaccttaacggttaaaccccgaaaaaccggttaacgttacgggttacgggtacccttacgggtaaaccccaaccgtttaacgtttacccgg

SEQ ID NO: 96820 - DNA, 590 bp, Homo sapiens
  misc_feature: GYAE6OF01E1O4U.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggcagtcagagtatagtagctggttggcctggtatcagcaagaaaccgagggaaacgcccctaagctcctgactctagtaaggtcgtacgtagttaagaagtgacggtccagtcgaagggttcggcggcgagtggatcgtgggacagtatcactctcacctatcgagcacgtcctgcacgcctgtagttgtattttcgacttaactttacttactcgtaacctaacgtagttaatttaacgtttacgggtttttccggtacgggttaccggtttccgggaacccgtaaacgggggaccctaaaggggtacggaactaacgtaaccgaaacgtaacgttggtacggactagaccctaaccgtgttccg

SEQ ID NO: 96821 - DNA, 532 bp, Homo sapiens
  misc_feature: GYAE6OF01A74W7.29.59.F04.1.454.CMB.1.raw
  modified_base (526)..(526): a, c, t, g, unknown or other
  misc_feature (526)..(526): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaacgcccctaagctcctgatctataaggcgtctagttagaaagtgaggtccatcgaaggttcggcggcaggtggatcgtgggacaggattcactctcacatcagcagcctgcagcctgatgtattttgactaacttattactgacctaactagtattaattacgttttaccgtacgggtacgttcggaccgtaaagggaccgtaagggtcggtacacgtacaaacgtacgtaggtcggactagcctaccgngttccg

SEQ ID NO: 96822 - DNA, 520 bp, Homo sapiens
  misc_feature: GYAE6OF01CFV0I.29.59.F04.1.454.CMB.1.raw
  modified_base (393)..(393): a, c, t, g, unknown or other
  misc_feature (393)..(393): n is a, c, g, or t
  modified_base (516)..(516): a, c, t, g, unknown or other
  misc_feature (516)..(516): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagtctggttggcctggtatcagcagaaaccaggggaaacgcccctaagctcctgatctataggctctagttagaagtgaggtccatcaaggttcggcggcagtggatcgtgggacagattcactctacaccatcagcagcctgcagcctgntgtatttgctaactttattactgacctaacagttaacttaagttacgttttaccgtggtaccgttcggaccgtaacgggacctaagggtcgaacatacaaacgtactgtacgctgaccacgtntccg

SEQ ID NO: 96823 - DNA, 525 bp, Homo sapiens
  misc_feature: GYAE6OF01BKCIG.29.59.F04.1.454.CMB.1.raw
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaacgcccctaagctcctgatctataaggcgtctagtttagaaagtgaggtccatcaagggttcggcggcaggtggatcgtgggacagaattcactctcaccatcagcagcctgcagcctgatgtattttcgacttaactttattactgacccaatagttaattaattacggttttccgagggtaccgttcggaccgtaaagggaccaagggtcggacagtacaaacgactggtcgctagcnccnttccg

SEQ ID NO: 96824 - DNA, 627 bp, Homo sapiens
  misc_feature: GYAE6OF01BO4SG.29.59.F04.1.454.CMB.1.raw
  modified_base (279)..(279): a, c, t, g, unknown or other
  misc_feature (279)..(279): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccggccagtcagagtattagtagctggttggcctggtatcagcagaaaccagggaaacncccctaagctcctgatctataaggcgtactagtttagaaagtgaggtcccagtcaagggttcggcggcaggtggatcgtagggacagtaacttcgactctacacctatcgagcagcctagcagcctgactgtattttgactaactttattacgtacgaccctaaactaaggttaattaaacgtttacggtttttacccggtagggttaacccggttttacgggacccgtaaaacgggggtaaacccgtaaaggggttacggtaaaccctaaggttaaccctaaaaacccgggtaaccgttacgggttacgggtacccttaccggtacctaaacccgtagtttacccgg

SEQ ID NO: 96825 - DNA, 534 bp, Homo sapiens
  misc_feature: GYAE6OF01BX18Y.29.59.F04.1.454.CMB.1.raw
  modified_base (411)..(411): a, c, t, g, unknown or other
  misc_feature (411)..(411): n is a, c, g, or t
  modified_base (529)..(529): a, c, t, g, unknown or other
  misc_feature (529)..(529): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaacgcccctaagcctcctgatctataaggcgtctagtttagaagtgaggtccatcgaaggttcggcggcagtggatcgtgggacaggattcactctcaccatcagcagcctgcacgctgatgtatttgctaacttnttactgacctaactagttaattaactttacggttttccgtagggtaccgtttccgggaccgtaaaggggtaccgaagggtggaacagtacgaaacgtacgtgtcggactgacctactnttccg

SEQ ID NO: 96826 - DNA, 517 bp, Homo sapiens
  misc_feature: GYAE6OF01EWL9C.29.59.F04.1.454.CMB.1.raw
  modified_base (510)..(510): a, c, t, g, unknown or other
  misc_feature (510)..(510): n is a, c, g, or t
  modified_base (513)..(513): a, c, t, g, unknown or other
  misc_feature (513)..(513): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcacaatcacttgccgggccagtcagagtattagtagctggttggcctggtatcagcagaaaccagggaaagcccctaagctcctgatctataaggcgtctagtttagaaagtgaggtccatcaaggttcggcggcagtggatcgtgggacagaattcactctcaccatcagcagcctgcagcctgatgtattttgactaactttattactgaccaactagtaattaattagtttccgtggtaccgttcggaccgtaagggacctaagggtcgacagtacgaaacgtactggtcggctagccncgnttcg

SEQ ID NO: 96827 - DNA, 536 bp, Homo sapiens
  misc_feature: GYAE6OF01D9IR6.29.59.F04.1.454.CMB.1.raw
  modified_base (530)..(530): a, c, t, g, unknown or other
  misc_feature (530)..(530): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccatcatccctgtctgcatctgtcggagacagaatcaccattatttgccggacaagtcacgacataaactacctttttaaattgtatcagcaacaaaccagggaacgccccaaagctcctgatcgatgctgcatccaatttagagtagtgggtccatccgtaggttcagtggcgagtggatcgtggaactaatttcactctcaccatcagcagtctgacaaccgtgaagtatttcgactaacttactattgtacaactagtagttactagttactttctttacctacgtttccggacccgttcgggtaccgtaagtacgtaattactacgaaacgtactgtacgtctacgaccactntcgtcg

SEQ ID NO: 96828 - DNA, 607 bp, Homo sapiens
  misc_feature: GYAE6OF01CNY21.29.59.F04.1.454.CMB.1.raw
  modified_base (294)..(294): a, c, t, g, unknown or other
  misc_feature (294)..(294): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggcagtcagagtattagtagcgtggttggcctggtatcagcaagaaaccagggaaacgcccctaagctccngatctataaggcgtactaagtttaagaaagtgacggtcccaagtacgaaagggttcggacggacgaaggtggatcggtagggacaagtaactcactctcacatcagcagctcgcagcctagtatgtattttacgacttaattattacctcgaaccctaaatagttaaattaacgtttacggttttaccggtgggtaaccgtttaccgggaccgtaaaacggggtaaccgtaaacgggtcgggtaacctaagtaaaccgaaaaccggttaacgttgggtaaccgggttctaacggccaaccggttacttacccg

SEQ ID NO: 96829 - DNA, 566 bp, Homo sapiens
  misc_feature: GYAE6OF01EU1ET.29.59.F04.1.454.CMB.1.raw
  modified_base (424)..(424): a, c, t, g, unknown or other
  misc_feature (424)..(424): n is a, c, g, or t
  modified_base (560)..(560): a, c, t, g, unknown or other
  misc_feature (560)..(560): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagcgtggttggcctggtatcagcaagaaaccagggaaacgccccgtaagctcctgatctagtaagcgtcttagttagaaagtgacgtccatcgaaggttcggcggcagtggatcgtgggacagtaatcactctcaccatcagcagcctgcagcctgatgtatttagactaactttatacttnacctaactagttaattaagtttacggttttaccggtaggttaccgttaccgggaacccgtaaaggggtaaccctaaaggggtcgaacgtaacggttaaccgaaaacggtaccgtggtacgggctagcccgaacgtnttaccg

SEQ ID NO: 96830 - DNA, 532 bp, Homo sapiens
  misc_feature: GYAE6OF01A4D2U.29.59.F04.1.454.CMB.1.raw
  modified_base (527)..(527): a, c, t, g, unknown or other
  misc_feature (527)..(527): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaagtgagtccatcaaggttcgcggcagtggatcgtgggacagaattcactctcaccatcagcagcctgcagcctgattgtattttgactaacttattactgaccaacgagttaataattacgttttaccggaggtaccgttcggaccgtaaacgggtaccgaagggtcggaactacgtacgaaaacgacgttggtacggactaggcaccgtnttccg

SEQ ID NO: 96831 - DNA, 578 bp, Homo sapiens
  misc_feature: GYAE6OF01BYOQP.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggcagtcagagtattagtagctggttggcctggtatcagcagaaaccgagggaaacgcccctaagctcctgatctataaggcgttactagtttagaaaagttgaggtacccaatcgaaaggttcggacggcaaggtggatcgtgggacagtaattcactctcaccatcagcagctgcagcctggatgtattttgctaactttattaactgacctaactagttaataatttagttttcccggtggtaccgttcggacccgtaaacggggaaccgtaaagggtacggaacgtaacgttaccgaaaacggtaaaccgttcgggttacggtacgttacgacctaacccgtagttacccg

SEQ ID NO: 96832 - DNA, 690 bp, Homo sapiens
  misc_feature: GYAE6OF01BCIEE.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatctgtaggtgacagagtcaccatcacttgccggcagtcagagtattagtagctggtgcctggtatcagcaagaaaccgagggaaacgcccctaagcctacctagtactctaagtaacggtcgttacgttaaggtttaacgaaaagttggaaccggtacccaacgttacggtaaacgggtttccgggaccggtaccgtaggtacgggtacgttcggtaggggaactaaggtaacttaccgacttccgtactaccactacgacgacctacgtcccgtagaccgacgtccgtaggtagtttaggttaattttacgggaccctttaaacgtttacgttaacgtcggtaaccctaaccgttaagtttaaacgttaaacgtttacgggttttacccggtaggttaacccggttccggaaccgtaacgggtaaccgtacgggtacgaactaacgtaacgtaaaccgtaacgttcggtacgacgttacgaccgaccgtcgttaccg

SEQ ID NO: 96833 - DNA, 606 bp, Homo sapiens
  misc_feature: GYAE6OF01E5Z9J.29.59.F04.1.454.CMB.1.raw
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (342)..(342): a, c, t, g, unknown or other
  misc_feature (342)..(342): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacgttgccgggccagtcagtagtatagtagcgtggtggcctggtatcagcaagaaaccagggaacncctaanctcngntactagtagtcgtacttagttagaagtgacgtccagtcgaggtcggcgngagtgatcgtggacagtactcactctcacatcagcacgtcctagctacgtccgtagtagttagttacttttacgaacttaactttacttacgtaccgtaaccctaaagtaggtttaaactttaacggtttacgggtttttaccggacggggttaaccggttaccgggaacccggtaaacggggtaacccgtaaagggttaccgaactaacgtaacgaaaccgtaacgttcggtacggtacctacgaccctaacgtcgtttaccg

SEQ ID NO: 96834 - DNA, 570 bp, Homo sapiens
  misc_feature: GYAE6OF01EXBYS.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaacgccctaagctcctgatctataaggctctagttagaagtgacggtccatcgaaggtcggcgtcagtgatctgggacagaattcactctcaccatcagcagcctgcagcctgatgtatttgactaactttacttactcgaccaacgtagtaattaacgtttacgttttaccggtaggtaccggttacgggacccgtaaacggggtaacccgtaaaggggtaccggaacgtaacgtaaccgaaaaccggtaacgttacgggtacgggactaggccctaaccgtacgtttacccg

SEQ ID NO: 96835 - DNA, 556 bp, Homo sapiens
  misc_feature: GYAE6OF01B5O6E.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcggcggcagtggatcgtgggacagaattcactctcacatcagcagcctgcagcctgatgtattttgactaactttattactgacctaactagttaattaagttacgtttttccggtagggtaaccgtttccgggaccgtaaaggggaacccgtaaagggtcggaacaacgtacgaaaaccggtaacgtggtacggacttaggcctacccgtaagttcccg

SEQ ID NO: 96836 - DNA, 658 bp, Homo sapiens
  misc_feature: GYAE6OF01B3DLW.29.59.F04.1.454.CMB.1.raw
  modified_base (286)..(286): a, c, t, g, unknown or other
  misc_feature (286)..(286): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatcgtgtaggtgacagagtcaccatcacttgccgggccagtcagagtattagtagcgtggttggcctggtactcgagcaagaaaccgagggaaacncccctaagcctccgtgatactagtaaggcgtacgtagtttagaaagtgacggtaccagtacgtaacgggttcgggacggtcgaggtacggattcgtaggggaaccaaggtaacttccgaccttcctaccgacctaagtaccacgacacgtccgtagccgagtcccgtagtacgttagttacttttacggaccttaacgtttaacttaccgtacgtaacccgtaaacggttaactttaaagtttaccggttttaccggtacgggtaccggttaccgggaaccgtaaacggggtaccgaaagggttacgaaaccgtaagtaaccgaaacggtacgttaggtccggtacgtaccgaactaaccgtcttcggttcg

SEQ ID NO: 96837 - DNA, 573 bp, Homo sapiens
  misc_feature: GYAE6OF01B3P89.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcaagaaaccagggaaacgccctaagctcctagactactaagtaaggcgttactaagttttaagaaagtgacggtcccatacgaaggttcggcggcaggtggatcgtgggacagattcactctacacatcagcagcctgcagcctagacttgtattttcggactaactttacttaacttcgaacctaaactagttaaacttaattagttttcgtacggtaccggttcggaccgaacgggtaaccgtaagggtacggtaactagtaccgaaaacgtaacgtacggttacggcgtagacctaacctagttccg

SEQ ID NO: 96838 - DNA, 592 bp, Homo sapiens
  misc_feature: GYAE6OF01BZ57X.29.59.F04.1.454.CMB.1.raw
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgaccccagtctccttccactgtgtctgcatctggtaggtgacagagtcaccatcacttggccggccagtcagagtattagtagctgggttggcctggtatcagcaagaaaccagggaacnccctaagctcctgatctataggctntagttagaagtgagtccagtcaaggttcggcgcagtggatcgtgggacagtaatcactcgtacaccatcgagcacgcctgccagtcctgtattgtattttacgacttaacgtttacttaccgtcgtaaccctaagtacgtttaaattaacggttttaacggttttaccggtacggttaaccggttccgggaaccgtaaacggggaacccgtaagggtacggtaactaacgtaaccgtaaaacggtagttacgggtacggtacgtacggacctaccgtattaccg

SEQ ID NO: 96839 - DNA, 609 bp, Homo sapiens
  misc_feature: GYAE6OF01DJPD2.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatctgtaggtgacagagtcacatcacttgcccggcagtcagagtatagtagcgtggtgcctggtatcagacaagaaaccgagggaacgacccctaagcctcctgactctaagtaacggcgttactagtttagaaagtgacgtccagtcgtaaggttcggcgcgtagtggatcgtgggacaagtacttcacttctacaccatacacgcacgctcgacacgtcctagtacttagttacttttacgacttaaactttatttaccgtacgtaacctaaacgttaagttaactttaagttttacggttttacccgggtagggttaccggttacccggtaaccggtaacgggtaaccgtaagggtacggtaacaacggtaaccgaaaccgtacgtaggtacggtcacgacctaccgtgttaccg

SEQ ID NO: 96840 - DNA, 584 bp, Homo sapiens
  misc_feature: GYAE6OF01ENBY0.29.59.F04.1.454.CMB.1.raw
  modified_base (279)..(279): a, c, t, g, unknown or other
  misc_feature (279)..(279): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttcactgtgtctgcatctgtaggtgacagagtcaccatcacttgccgggccagtcagagtattagtagcttggtttgccttggtatcagcagaaaccagggaanccctaagctcctgatctataaggctctagtttagaagtgacggtccatcgaagggttcggcggcagtggatcgtagggacagaattcaactctcaccatcagtcagcctgcagcctgatgtattttcgacttaactttacttactacgacctaaactaacgttaatttaaactttacggtttttaccggtagggttaccgttaccgggaaccgtaaacggggaacccgtaagggttacggaactaacgtaccgaaaacggtaaccgttaggtacggtacgtacggaccctaaccgtcgttacccg

SEQ ID NO: 96841 - DNA, 563 bp, Homo sapiens
  misc_feature: GYAE6OF01BHGT8.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttcactgtgtctgcatctgtaggtgacagagtcaccatcacttgccgggccagtcagagtattagtagctggttggctggtatcagcagaaaccagggaacgcccctaagctcctgatctataaggcgtctagtttagaagtgaggtccatcgaaggttcggacggcaggtggatcgtgggacagtaattcactctcaccatcagcagctgcagcctgatgtattttcgactaactttattacgtgtaccctaacagttaattaagtttacgtttttccggagggttaaccggttccgggacccgtaaacggggaaccctaaaggggtcggaacataaccgaaaaccgtaacgttcggtacgggacctaggaccctaccgtacttccg

SEQ ID NO: 96842 - DNA, 522 bp, Homo sapiens
  misc_feature: GYAE6OF01DE1RJ.29.59.F04.1.454.CMB.1.raw
  modified_base (318)..(318): a, c, t, g, unknown or other
  misc_feature (318)..(318): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaaccagggaaagcccctaaagctcctgatctaataaggcgtctagtttanaaaagtgaggtccatcaaaggttcggcggcaagtggatctgggacagaaattcaactctcaccatcagcagcctgcagcctgatgattttgcaactttattaactgccaaacaagtaataaattaagttttccgtggacgttcgccgaaacgggacaaacggtaggaacagtacaaaacgaaactagtggactggtcaccatcg

SEQ ID NO: 96843 - DNA, 598 bp, Homo sapiens
  misc_feature: GYAE6OF01DDU3Q.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctccaggtgccaaatgtgacatccagatgacccagtctccttccactgtgtctgcatctgtaggtgacagagtcaccatcacttgccggcagtcagagtattagtagctggttggcctggtatcagcaagaaaccgagggaacgcccctaagctcctgatctagtaagcgtctagttagaaagtgacggtccagtacaagggttcggcggctagtggtatcgtagggactagaacttcaacgtctcactactcacgctacgctgcacgccgtgtatgtattttgacttaactttattacgtacgacctaaacgtagttaattacgtttacgtttttaccggtacgggtacggttttcccgggaccgtaaacggggtaacccgtaaggggttacggtaactacgtaaaccgtaaaaccgaaccgttaggttacgggcttacggacccgtaacccgtagtttcccg

SEQ ID NO: 96844 - DNA, 549 bp, Homo sapiens
  misc_feature: GYAE6OF01EHLVA.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccgagggaaacgcccctaagcctcctgatctagtaaggctactagttagaagtgacggtccatcgaaggttcggcggcaggtggatcgtgggacagtaacttcactctcaccatcagcagcctgcagcctgatgtattttcgacttaacttatactgaccaatagttaattaagttcggttttccgagggtaccgttcggaccgtaaacggggaccgtaagggtcgaacaacgttaccgaaaacggtacgttcggtacggctagccctaaccgtcttccg

SEQ ID NO: 96845 - DNA, 639 bp, Homo sapiens
  misc_feature: GYAE6OF01BLBWZ.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatccacttcggccgggcagtcagagttattagtagtcgttggttggccgttggtatcgagacaacgaaaccgagggaaccgccctaagcctcctagactactaagtacggtcgtacttaaggttaagaagtgacgtcctatacgtaagggttcggcggcaggtggatcgtagggacagtattcactccacacatcgacgcacgtcctgacctacgtccgtagtagttgttatttcgacttaacctttacttacgtacgtaacctaactaagtttaacgtttaacgttttacggttttacccgggtacgggttaccggtttaccgggaaccggtaaacggggtacccggtaaagggtacggaaccttaacgtaaccggtaaaacgtacgtacggttcggtaccgtacgaccctaacccgtagttccgg

SEQ ID NO: 96846 - DNA, 580 bp, Homo sapiens
  misc_feature: GYAE6OF01CFOXW.29.59.F04.1.454.CMB.1.raw
  modified_base (339)..(340): a, c, t, g, unknown or other
  misc_feature (339)..(340): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttcactgtgtctgcatctgtaggtgacagagtcaccatcacttgccggcagtcagagtattagtagctggttggcctggtatcagcagaaaccagggaaacgccctaagctcctgatctataaggcgtctagttagaaagtgaggtccatcgaaggttcggcgnngtggatcgtgggacagtaattcactctcacatcagcagcctgcagcctgatgtattttgactaactttattaactgtaacccaaactacgttaattaactttacggttttacccggtagggtaaccggtttccgggaacccgtaaacggggaacccgtaaggggttacgggtaacctaacgtaccgaaaaccggtaacgttcgggtacggtacccgttagccctaaacccgtgttacccg

SEQ ID NO: 96847 - DNA, 521 bp, Homo sapiens
  misc_feature: GYAE6OF01DVGV4.29.59.F04.1.454.CMB.1.raw
  modified_base (277)..(277): a, c, t, g, unknown or other
  misc_feature (277)..(277): n is a, c, g, or t
  modified_base (310)..(310): a, c, t, g, unknown or other
  misc_feature (310)..(310): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccggccagtcagagtattagtagctggttggcctggtatcagcagaaccagggaaanccctaagctcctgatctataaggctctagttanaaagtgaggtccatcaaggttcgcggcagtggatcgtgggacagattcactctcacatcagcagcctgcagcctgatgtattttcgctaacttattactgacctaactagttaataatttagttttccggtaggtacggttacggaccgtaaaggggtacccaaagggtcggaacataaccgaaacgaactgtacggctagccactagtcg

SEQ ID NO: 96848 - DNA, 527 bp, Homo sapiens
  misc_feature: GYAE6OF01EUIUM.29.59.F04.1.454.CMB.1.raw
  modified_base (292)..(292): a, c, t, g, unknown or other
  misc_feature (292)..(292): n is a, c, g, or t
  modified_base (522)..(522): a, c, t, g, unknown or other
  misc_feature (522)..(522): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggcagtcagagtattagtagctggttggcctggtatcagcagaaaccagggaaacgcccctaagctccngatctataaggctctagtttagaaagtgaggtccatcgaaggttcggcggcaggtggatcgtagggacagaattcactctacaccatcagcagcctgcagcctgatgtattttgactaactttatactgaccaatagttaataatttacggttttccgaggttaccgttcgggacctaaagggaccctaagggtcgaactatacaaacggtaatggtcggactaggcacngttcg

SEQ ID NO: 96849 - DNA, 807 bp, Homo sapiens
  misc_feature: GYAE6OF01AUXSF.29.59.F04.1.454.CMB.1.raw
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatcgtgtaggtgacagacgtcacatcacgttcgccggcagtcagtagtattagtagcgttggtggccttggtacncgagacaacgaaaccgaggggaaaccncccctaagcctccgtagacttacgtaagtaacggtcgttacgttaaggttaagaaaggtggaaccggttcccaagttaccggtaaacggggtttcgggccggtacgtagggtaggtacgttacggtaggggaactaacggtaacgtttcccaaccttccgtactaaccctagttaccgacggtaccgtaacgtcccgtacgaccgtacggtcccgttaaggtaactttacggttaacgtttttaccggaactttaaccgtttaacgtttaacgtcccgtaaacccgtaaaacggtttaacggttttaaacgtttaaaccggttttacgggtttttacccggggtacgggtttaaacccgggtttaccggggaaaaccccggtaaagggggtaaaccccggttaaaggggtaaaccgggtaacctaaaccggttaaccggtaaaaacgggttaaccttcggggttaacgggttaccggtaaccgacccggttaacccggttaacgttttacccgg

SEQ ID NO: 96850 - DNA, 540 bp, Homo sapiens
  misc_feature: GYAE6OF01DD632.29.59.F04.1.454.CMB.1.raw
  modified_base (401)..(401): a, c, t, g, unknown or other
  misc_feature (401)..(401): n is a, c, g, or t
  modified_base (500)..(500): a, c, t, g, unknown or other
  misc_feature (500)..(500): n is a, c, g, or t
  modified_base (531)..(531): a, c, t, g, unknown or other
  misc_feature (531)..(531): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaaccatcacttgccgggccagtcagagtattagtagctggttgcctggtatcagcaagaaaccagggaaaacgcccctaaagctcctgatctataaggcttactaagttagaaaagtgagtccatcgaaaggttcggcggcagtggatcgtgggacagaaatttcaactctacaccatcagcagtccagcancctgatgtattttgactaactttattacagaccaaatagttataacgttacgttttccgaggtaccgttaccggacgaaagggaccgaagggtcggaanacttaacaaaacgactgtacggactgaaccnctaagttcc

SEQ ID NO: 96851 - DNA, 627 bp, Homo sapiens
  misc_feature: GYAE6OF01CU0NV.29.59.F04.1.454.CMB.1.raw
  modified_base (323)..(323): a, c, t, g, unknown or other
  misc_feature (323)..(323): n is a, c, g, or t
  modified_base (400)..(400): a, c, t, g, unknown or other
  misc_feature (400)..(400): n is a, c, g, or t
  modified_base (437)..(437): a, c, t, g, unknown or other
  misc_feature (437)..(437): n is a, c, g, or t
tcagatagagtactcacgaccggtgctcgatttagtacacacacttagggagttgggggcaggagtcagacccagtcaggacacagcatggacatgagggtccccgctcagctccgtggggctcctgctgctctggctcccaggtgaccaaatgtgacatccagatcgacccagtccttccctccacttgtcgtctgctatctggtaggtgacagactccaacctagtcacgttcggcccgggaccagtcgaagtagttaattaggtacgtcggtgggttcggccgttaggactcaggacaaggaaaaccgacgggtaaaccnccccgttaagcctccgtagacttacgtaagtacggtcttataaggtagaagtcgacgtccaagtcgagggtcgcggntaggtgactgaggatagtattcactcacacactcganccagtctagcagtctaggtattgttacttagactttaagtactttacgataccaagttagttaactaacgtttcggtttaccgcgggttaccgtaccggaaccgtaaaggggtaaccgtaaggtaccgtaactagttaaaccccgtaaggtaacgttggtaaccggttacaccgacaaccggttcttacg

SEQ ID NO: 96852 - DNA, 787 bp, Homo sapiens
  misc_feature: GYAE6OF01EN5KQ.29.59.F04.1.454.CMB.1.raw
tcagatagagtactcacgaccggtgctcgatttagtacacacacttagggattgggggcaggagtcagacccagtcaggacacagcatggacatgagggtccccgctcagctccgtggggcctcctgctgctcgtcggcctcccgaggtcgaccaaagtgtacgacactccagactcgaccctacgttccttcccttccacttgtcgtctcgtctattcgtaggtaggtacgacgtagtacgtaccacctacgtccgtaccggttccggacccgggactacggtacgaaggttacgttaagttacggtacgtcggttacgggttcggtaccgttacggtacgtacgtaacgtaacgaaccggaaaccggaaacgggaaaccggtacccgtaaccgtaccgttaccgtacgtacgttacgtaacgtaacggtacgttacgtttaaggttaaggtaacggtacggtacgtaccgtacgtacggtacgggtacggtacggtcgtaaaaaaaaaacggtcggtacgtacggtacggtacgtaacgtacttactacgtacctactacctacgtaccgacgtacgtacgtacgtacgtacgtacgtacgtagtacgttacgttacgttacgtacttacgttactactacgtaacctaacgtagttaacgttacgtttacgtttacggtacggttaccggtaccggtacggtaacggtaacggtacggtacgtaacgtaacgtaacgtaaccggtaacgtacggtacgtacgtaccgtacctacgtcgttaccg

SEQ ID NO: 96853 - DNA, 548 bp, Homo sapiens
  misc_feature: GYAE6OF01CZMVF.29.59.F04.1.454.CMB.1.raw
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagtcgtggttggcctggtatcagcagaaaccagggaaacgcccctaagcctcctgatctagtacggcgtactagtttagaaagtgagtccatacgaaggttcggcggcagtggatcgtgggacagattcactctacacatcagcagtcngacncgctgattgtattttgactaacttatactcgaccaatagttaattaagtttacgtttaccggtggtaaccgttccggaccgaaacgggtaccaagggtcgaactaacgtaccgaaaacgtacgttggtacggacgtagcctaccgtagttccg

SEQ ID NO: 96854 - DNA, 552 bp, Homo sapiens
  misc_feature: GYAE6OF01BP5T5.29.59.F04.1.454.CMB.1.raw
  modified_base (440)..(440): a, c, t, g, unknown or other
  misc_feature (440)..(440): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttggcccgggccagtcagagtattagtagcgttggttggcctggtatcagcagaaaccgagggaaacgcccctaagctcctagatctataaggcgtactagtttagaaagtgacgtccatcgtaaggtcggcggcaggtggatcgtgggacagtacttcactctcacctatcagcacgcctagcacgccctgtatgttattttacgacttaactttacttacnctaccaagtagttaagttaacgtttacgtttaccggtggtaccgttacgggaccgtaagggaccgtaagggtcgacacgtacgaaacgtcgtagtcgtcagcctacgcttcg

SEQ ID NO: 96855 - DNA, 606 bp, Homo sapiens
  misc_feature: GYAE6OF01APR1O.29.59.F04.1.454.CMB.1.raw
  modified_base (202)..(202): a, c, t, g, unknown or other
  misc_feature (202)..(202): n is a, c, g, or t
  modified_base (280)..(280): a, c, t, g, unknown or other
  misc_feature (280)..(280): n is a, c, g, or t
  modified_base (371)..(371): a, c, t, g, unknown or other
  misc_feature (371)..(371): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatctgtaggtnacagatcaccatcacttggccggcagtcagatattagtagcgtggtgcctggtatcagcaagaaaaccgagggaaacncccctaaagcctcctagactataactaacgggctagtaagttaagaagtgacgtccaatacgtacggttcggcggacaggtgatcgagganagtatcactctcacatcagcagcctgacagtcagtatgtatttcgactaactttactacgacgaacctaacgtaagttacttaacgtttacggtttacccggagggttacccgttaaccgggaaccggtaaaccgggtaaccgtaaacggggttcggaaactaaggttaaacccggtaaaaccggtaagttccgggtacggtaccgtaacggaccctaaacgttcgtttacccgg

SEQ ID NO: 96856 - DNA, 511 bp, Homo sapiens
  misc_feature: GYAE6OF01AEAP7.29.59.F04.1.454.CMB.1.raw
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (440)..(440): a, c, t, g, unknown or other
  misc_feature (440)..(440): n is a, c, g, or t
  modified_base (499)..(499): a, c, t, g, unknown or other
  misc_feature (499)..(499): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttcactgtgtctgcatctgtaggtgacaggagtcaccatcacttgaccgggccagtcagagtattagtagctggttggcctggtatcagcgaagaaaccagggaaacgcccctaagcctacctgattctaagtaaggcgtactagtttagaagtcgagtccatcgaaggttcgcgcgagtgagcgtggacagtattcactctcacatcagcagcctgcagcctgatgatttgactattatcnacctanttactattgtttaccgngtaccgttcgacgtacggacgtaaggtcgatactaacgaaccgtagtcggtcggtacgngcctacgtgtcg

SEQ ID NO: 96857 - DNA, 902 bp, Homo sapiens
  misc_feature: GYAE6OF01EHQOO.29.59.F04.1.454.CMB.1.raw
  modified_base (202)..(202): a, c, t, g, unknown or other
  misc_feature (202)..(202): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttcactgtgtctgctatcgtgtaggtnacgagagtcaccatccacttcgccgggcagtcagtagttattagtagtcgtgggttcggccgttggtactcgaggaccaaggaaaaccggtaacggggaaaccgaccccgttaaaggccttaccgtagtacttactaacgtaacggtcgtttacgttaaagggttttaaggaaaaggttcggtaacggtaccccgtaagtaccggttaaaggggttcccgggacgggtaccgtaggttacgggtaagttccggttaaccgggggaactaacggttaaaacgtttacccgttaacccgttaccgttaaccctaacccgttaaccgttaacccgaacgggttaacccgtaaccccgggtcccgttaacgggtacccgtaaaccgggttccccgttaagggttaaccgtttacggttttaaacgttttttacccggaaaccgttttaaaacccttttttaacgttaaccgttaacccggtaaccgttaaaaccgttaacggttttaaaccttttaaaacggtttttaaccggttttttacccggggtaaccggggtaacccgggttttaacccggggaacccggttaaaacggggtaaacccgtaaggggtttaccggtaaacgtaaccgttaaaccgtaaaaaccggttaccggttacgggttaaccgggtcctaaccggtccctaaacccgtgttacccgg

SEQ ID NO: 96858 - DNA, 563 bp, Homo sapiens
  misc_feature: GYAE6OF01EI7DU.29.59.F04.1.454.CMB.1.raw
  modified_base (382)..(382): a, c, t, g, unknown or other
  misc_feature (382)..(382): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagcttggttggcctggtatgagcaagaaacccgagggaaacgcccctaagctcctgatctataaggcgtctaagtttagaagtgacggtccatacgaacggttcggcggcaggtggagtcgtgggacagtaattcactcncacatcagctagcctagcacgcctaggtactgtattttgactaacttatacgtgaccaagtagtaattattacggtttccggtaggtaaccggttcgaacccggtaagggaaccgtaaggggtcgaactaattccgaaaaaggtacccttggtcgggacttacggacctaacgtagttccg

SEQ ID NO: 96859 - DNA, 690 bp, Homo sapiens
  misc_feature: GYAE6OF01CWC2N.29.59.F04.1.454.CMB.1.raw
  modified_base (395)..(395): a, c, t, g, unknown or other
  misc_feature (395)..(395): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctggtaggtgacagagtccaccatcacgttcggcccgggccagtcagtagtattagtagtcgttggttcggccttggtatcagacaacgaaaccgaagggaaccgacccctaagcctccgtagactacgtaagtacggtcgttacgttaagtttagaaaggtcgacgtccagtacgaagggttcggcggacgaggtggatcgngggacagtactcactctacacatcagcacgccgtgaccacgtccgtagtcgttagttattttacgaacctttaacgtttaacttacgtaccgtaacccttaaacgttaagtttaacgtttaaacggttttaccggttttacccgggttacggggttaacccggtttacccggggaacccggtaaaacgggggaacccggttaaaggggtacggtaaaccttaacggtaaacccgtaaaccgggtaaacgttcgggtaacgggtaccctagtaacccctaccgttaacgtttccgg

SEQ ID NO: 96860 - DNA, 919 bp, Homo sapiens
  misc_feature: GYAE6OF01CI1HX.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctccaggtgccaaatgtgacatccagatgacccagtctccttcactgtgtctgcatcgtgtaggtgacagagtccacctatccacgttcggccgggccagtctagtagttattaggtacgtcgttgggttggccgttggtactcgagcaacgaaaccgaagggaaaccgacccctaagcctaccgtgtactacgtaagtaacggtacgttacgttaaggtttaagtaagtacggtacggtacccctaagtaccgtaaacggggtttccgggacggtacgtaagggttcgggtaacgttcggtacgggggaactaaacggttaaacgtttacccgtaaccgttacctaacccgtaaccgtaacgttaccccgacgggtaacccgacccggttacccgttacggacccgtaaaccggtccccttaggttaacgtttacgggtttaacgttttttaccggaaaccgttttaaaccgtttttaacgttttaacccgtaacccggtaaccgtaaaacccgttaaagggtttttaaaccttttaaaccgggttttttaacgggttttttaacccccggggttacggggttaacccggtttttacccgggggaaaacccgggttaaaacggggggtaaaccccggtaaaaggggggtttcccggaaaacccgtttaaaacccggtttaaaacccgggaaaaaacccgggtttaaacccggtttcgggttaaacccggggttacccggttaaacccggaacccccgtaaacccgtttacggttttacccccgg

SEQ ID NO: 96861 - DNA, 646 bp, Homo sapiens
  misc_feature: GYAE6OF01ANRUV.29.59.F04.1.454.CMB.1.raw
  modified_base (269)..(269): a, c, t, g, unknown or other
  misc_feature (269)..(269): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggcagtcagagtatagtagctggttgcctggtatcagcagaaaccngggaacgcccaagctcctgatctataggctctagttagaagtgagtccatcgaaggttcgcgcagtgatcgtgggacaggtattcactctcacatcagcagcctgccgagtccgtgtacgttgtatttttggactttaactttactttaaccgtacgtaacccgtaaacgtaacgtttaacgttaacgttttaccggtttttcccggtaacgggttaacccggtttacccgggaaccggttaaaaccgggggtacccgtaaaacgggggtttacgggaaacccgttaaacggttaaaccgtaaaacccgggtaagtttaccggggttacgggtaccgttacccgggtaccctaaacccggtttaacctttacccggg

SEQ ID NO: 96862 - DNA, 861 bp, Homo sapiens
  misc_feature: GYAE6OF01BYR3H.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatcgtgtaggtgacagagtcaccatcacttgccgggcagtcagagtattagtagcgtggttggctggtatcagcaacgaaaccgagggaaacacccgtaagcctccgtagacttactaagtaacgggtcgttacgttaaggtttaacgaaaggtcggtaacgggtaccaagttacgtaaacgggttcgggacggacgtacggtacggtacgtacggttacgggaacgtaacggtaaactttaccggtaaccgttacccttaaccgaacccgtaacgtaccgtaacggacccgaaccggttacccgtacgacccgtaacggtccctttaagggtaagtttacggtttaacgttttttaccggaaaccgttttaaaccttttaaacccgtttaacgtttaacccggtaaacccgttaaacccgttaaaacggttttaaactttaaccgggtttttaaaccggttttttaacccggggtaacccgggtttaaccggggtttacccggggtaaaccccgggttaaaaccggggggtaaaacccggttaaaccgggggtacgggttaaaacccgttaaacccgttaaaacccgggtaaaaacccgttaaacccggggtttaggtacccggggtttaacggtaaccgacccggttaacccgtaaacgttttcccgg

SEQ ID NO: 96863 - DNA, 586 bp, Homo sapiens
  misc_feature: GYAE6OF01A1P5V.29.59.F04.1.454.CMB.1.raw
  modified_base (290)..(290): a, c, t, g, unknown or other
  misc_feature (290)..(290): n is a, c, g, or t
  modified_base (464)..(464): a, c, t, g, unknown or other
  misc_feature (464)..(464): n is a, c, g, or t
  modified_base (580)..(580): a, c, t, g, unknown or other
  misc_feature (580)..(580): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttcactgtgtctgcatcgtgtaggtgacagagtcaccatcacttggccgggccagtcagtagttattagtagctgggttgccttggtatcgagaccgaagaaaccgagggaaacnccccgtaagcctaccgtgacttactaagtaacggcttacgtaagtttaagaaagtgtaccggtaccagtacgaagggttcggcgacgaggtggattcggaggactagacttcactctacgacagtcagcagtcctgacagtccgtagtactgttacttgacttaacgttattcngaacctaagtagtaagttaacgtttacgtttcgaggtaccgttacggaccgtaaacgggacgtagggtctaacgtaatacccgaaagtacgttgacggtacctacggctaaccgtnttaccg

SEQ ID NO: 96864 - DNA, 612 bp, Homo sapiens
  misc_feature: GYAE6OF01BDGIP.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgctatctgtaggtgacagagtcaccatcacttgccgggcagtcagtagtattagtagcgtggttcggcctggtatcgagcaacgaaaccgaagggaaacgcccctaagcctcctagactctaagtaacggcgttacttaaggtttaagaaagttcggacgtccagtacgtaagggttcggcggcgaggtggatcgtaggacagtaacttcactctacaccatcgagcacgtcctgccacgtcctgtagttgtattttagaccttaactttacttacgtaccgacctaaacgtagtttaattaacgtttacggtttaccggaggtaccggttaccgggaccgtaaagggtaaccgtaagggtacgaacctaagtaacccgaaacgtacgtacgggtacggaccttaggacctaacgtcgttaccg

SEQ ID NO: 96865 - DNA, 567 bp, Homo sapiens
  misc_feature: GYAE6OF01B535V.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccatcatccctgtctgcatctgtcggagacagaatcacctattatttgccggacaagtcacgacaataaactacctttttaaattggtatcagcaacaaaccgagggaacgaccccaaagcctcctgactcgatgctgcatacaatttgagtaggtcgggtccatccgaggttcagtggcgatggatcgtaggaactaatttcactctaccacatcagacgtagtctagaccaactagaattattttacgaccttaactttacctagttactacaaactagtacgtttaactagttactttaccctttcgtaccgtttccggacccgttcgggaacccgtaagttaccgattactacgaaacgtacgtggtacgtctagaccactagtcttacg

SEQ ID NO: 96866 - DNA, 673 bp, Homo sapiens
  misc_feature: GYAE6OF01DGAWI.29.59.F04.1.454.CMB.1.raw
  modified_base (367)..(367): a, c, t, g, unknown or other
  misc_feature (367)..(367): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggcagtcagagtattagtagcgtggttcggccgttaggtatcagacaagaaaccgagggaaacgaccctaagcctaccgtgatctaagtaggcgttatagttagaagtgacggtaccatacgaggttcggcgcgagtggatcgngggacagtattcactcacacctatcagacacgccgtagaccacgtcctagtacttaggttactttttacggaaccttaaaccgttttattaaccgtacgaaccctaaaacgttacggtttaactttaacgttttaacggttttttacccggggtacgggttaacccgggtttacccgggtaaaccggtaaaccgggggttaacccgtaaagggggttaaccggaaacttaaccggttaaaacccgaaaaccggttacgttacgggttaccggtacccttacgggaccctaaccgttagtttacccg

SEQ ID NO: 96867 - DNA, 873 bp, Homo sapiens
  misc_feature: GYAE6OF01A09VH.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctgggctcctgctgctctggcctccaggtgccaaatgtgacatccagatcgaccagtctccttcactgtcgtctgctattcgtggtaggtagacaggacgtccaaccgtactccgtaccgttcgggccccgggactaaggtacgaacgtagttaagttacggtaggtccgtttagggttccggtccgtaggttactcgacgtaccgaaacgaaaaccggaacggggaaaccgtaccccgtaagtccctccgtaggtaacttaccgtaaggtaacgggtccgttagtttaaacgggtttaagtaaacggtcgggttaaccggtaccctaacgttaaccgggtaacgggttacgggacggtacgtagggtaggtacgttcgggtaacgggaaataacggttaacttccgtaaccttaccgtaccctaaccgtacgtaccgtaacgaccgtaacgtacccgttacggaccaccggtaccgttagttacgtttacgtttacgttttaccgtaaacctttaacgtttaccgttaacgttaacccgtaaccgttaaaccgttaacgtttaacgtttaaacggttttacccggtttaaccggggttacccggttaaccggggttacccgggtaaacccgggtaaaccggggtaacccgggttaacgggtaacgtaacccggttaaaccgtaaaccgttaaacccggttaggttacccggtacgggtacggttaacccgtaacccgttccggttaaacgtttcccggg

SEQ ID NO: 96868 - DNA, 554 bp, Homo sapiens
  misc_feature: GYAE6OF01CLBH7.29.59.F04.1.454.CMB.1.raw
  modified_base (353)..(353): a, c, t, g, unknown or other
  misc_feature (353)..(353): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaacgcccctaagctcctgatctataggcgtctagtttagaagtgaggtcccatcgaaggttcggcgcagtggatcgnggacagtaattcactctcacctatcgagcagcctgcagcctgattgtatttcgaacttaactttattaactcgaacctaatagttaattaagtttacggttttccgaggttaccggttcggaccgtaaagggaccgtaaagggtcgaactacgtaaccgtaaaccgacgttcggtacggccgtagacctcctaacgttccg

SEQ ID NO: 96869 - DNA, 673 bp, Homo sapiens
  misc_feature: GYAE6OF01DSNIC.29.59.F04.1.454.CMB.1.raw
  modified_base (189)..(189): a, c, t, g, unknown or other
  misc_feature (189)..(189): n is a, c, g, or t
  modified_base (306)..(306): a, c, t, g, unknown or other
  misc_feature (306)..(306): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctncatcgtgtaggtgacgagtcgtcactatcctacttcggcccgggccagtcgagtagtacgttagtagcgttggttcggtccgtggtactcgagcgaacggaaaccgaacgggaaacnccccgtaagccgtcctgacttatagtacggtcttagttaaggttaagaagtcggtacgtcctagtacgtaagggttcggacggcgtaggtcggtatcgggtggtaaccagtaacgttccacgttcctacactactacgtagaccacgtctacgccgtacgtccgttagtattagttactttacgtaccttaagttacttaacctacgtaacccgtaataacgttaattaacggtttaccggttttacgacgggtttaccgtcgggtaaaccggtaacgggtaaacccgtaagggtacgtaagtaaccgtaaacggtaacggtaaacgttcggtaacgtaccgtaacgacccttacgtagtttacccg

SEQ ID NO: 96870 - DNA, 766 bp, Homo sapiens
  misc_feature: GYAE6OF01CB1S5.29.59.F04.1.454.CMB.1.raw
  modified_base (356)..(356): a, c, t, g, unknown or other
  misc_feature (356)..(356): n is a, c, g, or t
  modified_base (412)..(412): a, c, t, g, unknown or other
  misc_feature (412)..(412): n is a, c, g, or t
tcagatagagtactcacgaccggtgctcgatttagtacacacacttagggattgggggcaggagtcagacccagtcaggacacagcatggacatgacgggtcccccgctcagctccgtggggcctcctgctgctcgtcggcctcccgaggtcgaccaaagtgtgacatccagatcgaccagtcctcctcactgtgtctgctattcgtggtaggtacgacgagtacgtaccacctaactccgtccgttcggcccgggccgtaagtcgtaaggtaagtttaacgttaggtacggtcggttgggttacgtccgttaggtactaccgaagacgaaacggaaaccggaacggggtaaaccncccgtaagtccgtactacgtacgtagtaagtacggtctttacgttaagggtttaanaaacggtcgtaccgtaccgtaaggtaccggtaacgggttccgggacgtaggtaaggtacgtaacggtttcgggaaaggtaccgtaaagtaccttacgaccttaccctacgaaccctagtaccgagtaccgaacgtccgacgaccgtacgccgttagtagttacgttattaaccgtaacttaacgttacttaacgcgtaaacctaacgttaagtttaacttaggtttacgttaccggtacgggttaacccggtcggaaaccggtaccgggaaaccggttacggtacgtaacgtaacgtaaccgtaaaacggtcgttacggtaccggtaacacggaaccttaaccgcggttacccg

SEQ ID NO: 96871 - DNA, 650 bp, Homo sapiens
  misc_feature: GYAE6OF01AK7X3.29.59.F04.1.454.CMB.1.raw
  modified_base (202)..(202): a, c, t, g, unknown or other
  misc_feature (202)..(202): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctccaggtgccaaatgtgacatccagatcgacccagtcctccttccactgtgtctgcatctgtaggtnacagagtcaccatcacttggccggccagtcagagtattagtagcgtggttggccttggtatcagcaagaaaccgaggggaaacgcccctaagctcctgactctataaggcgttacgttagtttaagaaagtggacggtaccattacgaacgggtttcgggcggtcagggtggtatcggtaggggacaaggtaacttcaccgttctaccaccattcgacgccacggccttcgacgtacgcccttaggtacttacgtttacttttcgaaccttaactttacgtttacgtccgaaccctaagtaacgttaatttaacgtttacggtttttccggagggtttaccggttcgggacccgtaaacggggaacccgtaaaggggttccgaaacgttacgtaaaccggaaaccgtaacgttgggtacggtacacggtacccaacgttcgttacccg

SEQ ID NO: 96872 - DNA, 531 bp, Homo sapiens
  misc_feature: GYAE6OF01ATA6V.29.59.F04.1.454.CMB.1.raw
  modified_base (106)..(106): a, c, t, g, unknown or other
  misc_feature (106)..(106): n is a, c, g, or t
  modified_base (200)..(200): a, c, t, g, unknown or other
  misc_feature (200)..(200): n is a, c, g, or t
  modified_base (273)..(273): a, c, t, g, unknown or other
  misc_feature (273)..(273): n is a, c, g, or t
  modified_base (333)..(333): a, c, t, g, unknown or other
  misc_feature (333)..(333): n is a, c, g, or t
tcagatagagtactcacgaccggtgctcgatttagtacacacacttagggattgggggcaggagtcagacccagtcaggacacagcatggacatgagggtccccgntcagctcctggggctcctgctgctctggctcccaggtgccaaatgtgacatccagatgacccagtctccttcactgtgtctgcatctgtaggtnacagagtcaccatcacgttgccgggcagtcagatattagagctggtgctggtatcagcagaaaccagggaacncccctaagctccgtgatctataaggctctagttagaagtgagtccatcgaaggttcgcgnagtgatcgtgggacagattcactcacacatcagcagctagcagcctgatgtatttgacttaacttatacgtcgacctaagtagttattaagttcggttttacgaggtaccgttcggaccgtaaacggggaccgtaagggtcggaaccagttaaccgaaaacgtacgttggtacggtactacggacctaccgtgttccg

SEQ ID NO: 96873 - DNA, 647 bp, Homo sapiens
  misc_feature: GYAE6OF01C95MC.29.59.F04.1.454.CMB.1.raw
  modified_base (106)..(106): a, c, t, g, unknown or other
  misc_feature (106)..(106): n is a, c, g, or t
  modified_base (144)..(144): a, c, t, g, unknown or other
  misc_feature (144)..(144): n is a, c, g, or t
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (634)..(634): a, c, t, g, unknown or other
  misc_feature (634)..(634): n is a, c, g, or t
tcagatagagtactcacgaccggtgctcgatttagtacacacacttagggattgggggcaggagtcagacccagtcaggacacagcatggacatgagggtccccgntcagctcctggggctcctgctgctctggctcccaggtnaccaaatgtgacatccagatgacccagtcctccttccactgtgtctgctatctgtaggtnacagacgtcacatctacgtggccggcagtcgagtagtattagtagcgtggttcggcctggtatcgaacgacaacggaaaccgaggggaaaccnccccgtaaggtcctcgtagtaactaccgtaagtacgggacctttagtaaagttagaaaagtcggtaggtcctagtacgtaaggttcgggcgtnaggttggatcggngggtaactagtaacttccgaactcactaccataccacgtacacgtctacgacgtcgtccgttagacgttgttactttagtaacttaactttacgtttacacgaacctaattacgtattaaacgtttcgtttacgggacggttaccggtaccggaaccgtaacgggacgtaaacggtcggtaataacggttaaaccgaaacggttaacgtcggttacgacgtacggtacccncgttaacttccgg

SEQ ID NO: 96874 - DNA, 790 bp, Homo sapiens
  misc_feature: GYAE6OF01D5Z4K.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatctgtaggtgacagagtcaccatcacgttcgccgggccagtcagtagttattagtagcgttgggttggccttggtactcaggacaaggaaaccgaacggggaaacgtccccgtaagccttaccgtgactactaagtaacggtcgttacttaaggtttaaggaaaggttggtacggtaccctaagtaccgtaaaggggtttccgggacggtcgtaggtacggacgttcggtagggaaccgtaaggtaaactttccgaccttacgtaccctaaccctacttaccgagtccgtaacgtacccgtacggaccgtacggtccccttaaggtaacttacggttactttttacggtaacctttaacgtttaacgtttaccgtaacgtaaccctaaacgtaacgtttaaagtttaaccgtttaacggttttttaccgggtaccgggttacccgggtttaacccgggtaacccggtaaaaccgggggtaaaccggtaaacggggttccggtaaaccgtaaccggttaaacccggtaaaacccggtaaaccgtttacgggttacggtacccgttaaccgggtaccctaacccgttaacggtttacccg

SEQ ID NO: 96875 - DNA, 617 bp, Homo sapiens
  misc_feature: GYAE6OF01A3BXR.29.59.F04.1.454.CMB.1.raw
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccggcagtcagagtattagtagctggtggcctggtatcagcagaaaccagggaaacgcccctaagcctcctgatctataaggctctagtttagaaagtgacggtccatcgaaggttcggcggnagtggatcgnggacagtaatcactcacaccatacagctacgcctgcagcctagattgtattttcgacttaacttacttacgtacgtacccaacgtaagttaacttaacgtttacggtttttacccggtagggttacccgggttacgggtaccccggtaaaacggggtaacccggttaaacggggtacgggtaaccgtaacggttaacccggtaaaaacccggtaacggtttacggtacgggtaccttacggacccttacccgtaagtttcccgg

SEQ ID NO: 96876 - DNA, 622 bp, Homo sapiens
  misc_feature: GYAE6OF01B6FY2.29.59.F04.1.454.CMB.1.raw
  modified_base (169)..(169): a, c, t, g, unknown or other
  misc_feature (169)..(169): n is a, c, g, or t
  modified_base (427)..(427): a, c, t, g, unknown or other
  misc_feature (427)..(427): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccngtctccttccactgtgtctgcatcgtgtaggtgacagagtccaccatcacgttcggcccggcagtcagagttattagagtcgtggttggcctggtatcgagacgaacgaaaccgagggaaacgcccctaaggcctacctagactactaagtaacggcgttacgtaagtttaagaaggtgacggtaccagtacgaagggttcggacggcaggtgacgtcgagggacagtactcactctacacagtcacgacacgtccgngcacgtctagtatcgttacttcgacttaattacgttacacgtaacctaagtagttaagttaacgtttacgtttaccgggtacgtaccgggtttaacggaaccggtaacgggtaaaccgtaagggtacgaaacctaacgttaaacccggaaacgtacggttaagtcgggtacctacggactaacccgtagttcccg

SEQ ID NO: 96877 - DNA, 691 bp, Homo sapiens
  misc_feature: GYAE6OF01CGJRS.29.59.F04.1.454.CMB.1.raw
  modified_base (202)..(202): a, c, t, g, unknown or other
  misc_feature (202)..(202): n is a, c, g, or t
  modified_base (683)..(683): a, c, t, g, unknown or other
  misc_feature (683)..(683): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctccaggtgccaaatgtgacatccagatgaccctagtctccttccactgtgtctgctatctgtaggtnacagacgtcaccatcacttggccggcagtcagagtattagtagtcgtggttggtcgtggtatcagacgaacgaaaccggaacgggaaacgtaccccgtaaggtcccttacgtacgacttaccgttaagtaacggtcgttacgttaaggtttaagtaaggtagacggtacctagtacggtaacgggttcggcggacgtggtggaagtcggtagggactaaggtacttcacttccacctaccgtactcgagcacgtccgtacgcacgtctgtacgttgttactttcgaactttaactttacgtactaccgaacttaacgtaagtttaacgttaaacgttttacgggttttaccgggttacggttaaccggggttaccgggaaaccgggtaaccggggtaaaccggtaacggggttaacggaactaacgttaaaccggaaacggttaacgttcgggtacgggttactacggtacccacccgttnttacccgg

SEQ ID NO: 96878 - DNA, 564 bp, Homo sapiens
  misc_feature: GYAE6OF01AD00O.29.59.F04.1.454.CMB.1.raw
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
  modified_base (555)..(555): a, c, t, g, unknown or other
  misc_feature (555)..(555): n is a, c, g, or t
tcagatagagtactcacgaccggtgctcgatttagtacacacacttagggattgggggcaggagtcagacccagtcaggacacagcatggacatgagggtcccccgctcagctcctggggctcctgctgctctggctcccaggtgccaaatgtgacatccagatgacccagtcctccttccactgtgtctgctatctgtaggtgacagagtccacctatcacgttcggcccgggccagtcagagtattagagtcgtggttggcctgggtatcagcacgaaaccgaggggaaacgcccctaagcctactgatactagtaaggtcgttactagttagaagtgacgtccatcgaaggtcggcgngagtggatcgtaggganagacttcgacttcnccacataccagcacncgtcgcacgcctgatgtatttcgacttaacttattactcgacctaagtataattaacgttacgttttccgtaggtaccggttccggaccgaacgggtaaccagggtacgtacgaataccgaaacggtacgtcggtcggactacgaccncgtcttccg

SEQ ID NO: 96879 - DNA, 774 bp, Homo sapiens
  misc_feature: GYAE6OF01AIV4X.29.59.F04.1.454.CMB.1.raw
  modified_base (202)..(202): a, c, t, g, unknown or other
  misc_feature (202)..(202): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatctgtaggtnacagacgtcacatcacttggccgggcagtcagtagttattagtagtcgttggttcggcctggtatcgagcaagaaaccgagggaaccgtccccgtaagcctaccgtgacttacgtaagtaacggtcgttacttaagtttaaggaaaaggttcgtaaccggttacccgtaagttaccgggtaaacggggtttccggggccggtacgtaacgggttcggtaagtttacccgggtaggggaaacttaacggtaaacttttaccgaaccgtttacccgtaaccctaacccgtaacgtttacccgaaggtacccgtaacggtccccgttacggaccgtaacggtcccgtttaggtaacgtttacgtttacgtttttaccgacctttaaacgtttcttaaccgtccgtaacctaaaggttacgtttaattaaccgttttacggttttcccggtaacgggttaccggttaccgggtaccggtaaacggggtaaccgtaacgggttaccggtaacctaattaacccggaaacgttaacggtcggtacggtacgttaaccgaccctaaccgtcgtttaccg

SEQ ID NO: 96880 - DNA, 848 bp, Homo sapiens
  misc_feature: GYAE6OF01DJN0Q.29.59.F04.1.454.CMB.1.raw
  modified_base (360)..(360): a, c, t, g, unknown or other
  misc_feature (360)..(360): n is a, c, g, or t
  modified_base (761)..(761): a, c, t, g, unknown or other
  misc_feature (761)..(761): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccgaggtgaccaatgtgacactccagatcgacccagttcctccttccactgtgtctgcatcgtaggtaggtcacgagacgtccaacctataccgtacgttccgggcccgggtacctaacgtaccgtaaggtaagtttagttacggtacgttcggttcgggtttcggacccgtttagggtaataccgaggaaccgaacgaaaaaccgggtaaccggggaaaccnccccgtaagtcccttccgtagtacgtaacgtaaggttaaccggtcgttttaagtaacggttttaaggaaacgttcggtacgttaccccaaggttaccgtaacggggttccgggacggtagtacgggttacggattccggtaaggaccgttaaagtacgtttaccaccgtttacctaccgaactactaccgaacgaccgtaacgccgttacggaccgtacgtaccgtaggttaagttcgtttaacgtttaccgtaacctttaacgtttacccgtatacccgttaaccgtaaacgttaggtttaaacctttaacggttttacccggttttacggtaccggggttaacccggtttaccgggaacccgtaaccgggtaaaccgggtaacgggtaaccgggttaanaaacccggttaaaccgaaaacgttacccgggttacggtttaacccgggacttacccgggaacccctaacccggttcgtttaacccgg

SEQ ID NO: 96881 - DNA, 735 bp, Homo sapiens
  misc_feature: GYAE6OF01C4ITJ.29.59.F04.1.454.CMB.1.raw
  modified_base (702)..(702): a, c, t, g, unknown or other
  misc_feature (702)..(702): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgctatctggtaggtgacgagacgtccactatcacgttcgcccgggactagcagtagttaattagagtcgttggttcggtccgtggttatcgagacaacggaaaccgaagggaaaccgccctaagccttacgtagtatacgttaagtacggtcgtttacgttaaggttaagaaggttcggacggttaccctaagttaccggtaaacgggttccgggacggtacgtaagggttacggaacgttaccgggtaggggaaacctaaggttaaactttccgtaaccttccctaaccgtaaccctaacgttaccgaacggtaccgacgttcccgtacgaccgtcgtcccgtagttacgttacgttagttttacgactttaaactttacgttaacgttacgaacctaaagttaagtttaacttaagtttaccggttttaccggtacggttacccgggttacggtaccggtaaacggggtaccgtaaggggtacgtaacgtaacgtaaccgaaacggttacgngggttaacgtccgaggtaccaccgttagttccg

SEQ ID NO: 96882 - DNA, 843 bp, Homo sapiens
  misc_feature: GYAE6OF01CN3KE.29.59.F04.1.454.CMB.1.raw
tcagatagagtactcacgaccggtgctcgatttagtacacacacttagggattgggggcaggagtcagacccagtcaggacacagcatggacatgacgggtcccccgctcagctcctggggctcctgctgctctggcctcccgaggtcgaccaaatgtgacatccgagactacgaccctagtccttcccttccacgttgtgtcctgctagttcgtggtaggtcgaacgagacgtaccaacctactaccgtaccgttccgggccccgggtaccacgttacgaaggtaacgttaaggtttaggtaacggtcggttagggttccggtaccgttaggtaacgtacgaaccggaacgaaaccggaaaaccggaaccggggtaaaacccgtaccccgttaaacgccgttaccgtacgtaacttaccggttaaacgtaacggtaccgtttaagttaaacgggtttaaaggaaaacggttcggtaaccggtaccccgttaagtaacccggtaacgggttccgggaccgtacggagggtcgtacggttcgggtacggaacgtaacgttactacgtactacctacctaaccgactaccgacgtaccgaccgtcgtacgaccgtacgtcgtacgtaagtttcgttaacgttttacgtaaaccttaagtttaaccgttaccgtaacaacccgttaagttaactttaaccgtttaacggttttacgtttacccgggttacggtaccgggttaccgggaaacggtaaaccgggtacgtaacgggtaacgtaaacgaaccgttaaacgaaacgttaaccgtcggtaccggacctacgtaacccgaaccgttcttacgg

SEQ ID NO: 96883 - DNA, 697 bp, Homo sapiens
  misc_feature: GYAE6OF01A0AHP.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccattgtgtctgctatctgtaggtgacagagtcaccatcacgttgccgggcagtcagatattagtagcgtggtcggcctggtatcgagacgaagaaaccgagggaaacgcccctaaagcctacctaggtactactagtaacggacgttctaagtttacgaagtgacggtaccagtacgtaagggtcggcggtacgaggtggacgtcgtagggacaagtaacgttcaacgtccgtactaacctagtacgaacgtccgaacgtccgtacgtaccgacgtcccgtagtaaccgttagttacgttttacgaacttaactttacgttaaccgtcgtaacccgaacgtaagtttaacgttaaagtttacccgttttaccgggtacgggtaacccggtttaccgggaaccgtaaaccggggtaacccgtaaacgggtacgggtaaaccgtaaccggtaaaccgtaaaaccggtaaccgttagggttaaccggtaccgtacgggaaccctaccggtaacgttacccgg

SEQ ID NO: 96884 - DNA, 576 bp, Homo sapiens
  misc_feature: GYAE6OF01EU48R.29.59.F04.1.454.CMB.1.raw
tcagatagagtactcacgaccggtgctcgatttagtacacacacttagggagttgggggcaggagtcagaccccagtccagggactacagctatggacatgagggtccccgctcagctcctggggctcctgctgctcgtggctcccaggtgtccaaatgtgacaatccagatgacccagtctccttccactgtgtctgcgatctgtaggtgacgagagtcaccatcacttcgccgggcctagtcagtagtattagtagtctggtggcctggtatcacgcagaaaccagggaaacgccctaagctccgtgatctataggcgtctagtttagaagtgaggtcccatcaaggtcgcgcagtgatctgggacagattcactctcaccatcagacagacctagccagtcctgattagtattttacgacttaacgttattactacgaaccaactaacgttaactttaagttacgttttccggtagggtaccgttacgggaccgtaaaggggtaacctaaggggttcggtaactaacgttaccgaaacgggaacttcggtcggacctaggctaccgtattccg

SEQ ID NO: 96885 - DNA, 605 bp, Homo sapiens
  misc_feature: GYAE6OF01APSAG.29.59.F04.1.454.CMB.1.raw
  modified_base (247)..(247): a, c, t, g, unknown or other
  misc_feature (247)..(247): n is a, c, g, or t
  modified_base (601)..(601): a, c, t, g, unknown or other
  misc_feature (601)..(601): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatctgtaggtgacagagtcaccatcacttggcccggcagtcagtagtattagtagngttggttcggcctggtatcgaggacaaggaaaacccgaggggaaaccgccccgtaaagcctaccgtagacttacgtaagtaacggtcgttacgttaagtttaagaaagtcggtaacggtcccaagttaccggtaaaggggttccggacggcgtaaggtggaagttcggtagggaactaaggtacttccgaacttcctacaccatacgacgcgtacgccgtgacacgtcctagtacttagtatttcgacttactttactacgtacgaccaagtataattagttacgtttcggaggtaccgttcggaaccgtaggaccgaggtgaactagtacgaaactagtcgtagctagctctnttcg

SEQ ID NO: 96886 - DNA, 710 bp, Homo sapiens
  misc_feature: GYAE6OF01CELEK.29.59.F04.1.454.CMB.1.raw
  modified_base (703)..(703): a, c, t, g, unknown or other
  misc_feature (703)..(703): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccgaggtgccaaatgtgacatccagatcgacccagtcctccttccactgtgtctgcatcgtgtaggtgacagacgtacacctattccacgttcggcccgggaccaggtacaggtagttattaggtacgtcgttggtttcgccgttagggtacttcgaggaccgaacggaaaaccggaacgggtaaaccgtcccctaaagtcctaccgtagtaacttacgtaagtaacggtacgtttacgttaaaggtttaagaaaggtcggtaccggtaccctaagtaaccggtaaggggtttccgggaccgtggtaaggtacgtacgttacgggtaggaaccgtaagtaacgttacacccttacctaccgaacctagtaccgagccgaacggtccaggacctacgtccgtagtacttagttagtttaccgacttaacttacttaccacgtaaccaagtacttaagttactttacgttttacggtccgggtacgtacggaaccgtaacgggtaaccgtaacggtcgtaactaactaaccgaaaccggtattacgggtcgtacgtagaccctcggtnttacccg

SEQ ID NO: 96887 - DNA, 849 bp, Homo sapiens
  misc_feature: GYAE6OF01CTOZ3.29.59.F04.1.454.CMB.1.raw
  modified_base (222)..(222): a, c, t, g, unknown or other
  misc_feature (222)..(222): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggcctcccgaggtcgaccaaagtgtagactatccgaagatcgacccctagtccttccttccgacttgtgtctagctattcgtggtaggtnacgagtactaccacagtccgtacgttcggcccgggcctagtacgagtagttagttaggtacgtcgttagggttcggtccgttaggtactcgacgaccgaacggaaaccggaacgggaaaccgtaccccgttaaagtccgttaccgttagtaacgttacgttaaaggtaacgggttaccgtttacgtttaaacggtttaaaggtaaacgggttacggtaacgggttaacccctaacggtttaccggtaaacgggggttttcccgggacgggtaccggtaaagggttccgggttaacgttaccggggttaacggggaacttaaacggttaacctttaccgaaccgtttaccctaaccctaaccgttaactaccgaacgtaccggacctccggttacgaccgtacggtccgttagtaaccgtttgtttaacgttttacgtaacctttaacgttacttaccgtaacggaacctttaaacgtagttaacgtttaacgtttaccggtttccggtacggttaacccggtacggtaaccggtaaacgggtaaccgggtaaaggtaccgtaactaaccgttaaacgtaaccgtaacggtttcggaacgtcgtaacggaccctacgttcgttaccgg

SEQ ID NO: 96888 - DNA, 920 bp, Homo sapiens
  misc_feature: GYAE6OF01AF07X.29.59.F04.1.454.CMB.1.raw
tcagatagagtactcacgaccggtgctcgatttagtacacacacttagggattggggggcagggagtcagacccagtcaggacacagcatggacatggagggtccccgctcagctccgtggggctcctgctgctcgtcggcctcccgaggtcgaccaaagtgtcgaacactccaagactacggaccctagttcccttcccttccacgttggtcgttcctgctacgtcgtagggttacggtagacgaggtaccgtaccaacctacgtcctacggttaccggcccgggaccgtacggtacgtaaggttaagttagttaacggtcggtcggttcgggttacggtaccgttaggttactaccgacggtaccgaaaaccgggtaaaaccggaaccgggtaaaccccgtaaccccggttaacgtccgttaccgtaggttaaccgttaaccggttaacggttaaccgggttactttaacggtttaaagggtttaaacggtaaacgggtaccggttaacccggttaccgtaaggttaccgggttaacggggtccggggacggtacggtagggtacggtacggttcgggaagggtaaactaacggttaaccttaccgaccttacccgtaccaacgtttaacgaccgtaacggccttacccgggacttaccggacttacggcgtagtttaccgtgttttaacctttaacgaacccgttttactttaacgaccgtaaccgtaaaccgttaaagtttagtttaaccgttttaaccggggtttacggttcccggggtaacccggttaaccgggttaccgggaacccgggtaaaacgggttcgggtaaacgggtaaccgtaacctaaacgttaacccggaaacggggtttctcggggtacccgtacgaacccctaacgttaggtttccttacgg

SEQ ID NO: 96889 - DNA, 572 bp, Homo sapiens
  misc_feature: GYAE6OF01APYVH.29.59.F04.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (283)..(283): a, c, t, g, unknown or other
  misc_feature (283)..(283): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtnacagngtcacatcacgttgccggccagtcagagtattagagctggttggcctggtatcgagcaagaaaaccgaggggaaacnccccgtaagcctcctagactctaagtaacggcgtacttagttaagaaagtgacggtcccaagtcgaagggttcggcggtcgagtggatcgtagggacagtaacttcactctcacntcactcatccngacacgctgtaactgtattttacgacttaacttacttactcgacctaacgtagttaactaacgtttacgtttaccggtaggtaccgttcggacggtaaacggtacgtaaggtacgaacgataaccgaaacgtacgtggtacggtactacgactacctgtaccg

SEQ ID NO: 96890 - DNA, 694 bp, Homo sapiens
  misc_feature: GYAE6OF01BLY42.29.59.F04.1.454.CMB.1.raw
  modified_base (212)..(212): a, c, t, g, unknown or other
  misc_feature (212)..(212): n is a, c, g, or t
  modified_base (272)..(272): a, c, t, g, unknown or other
  misc_feature (272)..(272): n is a, c, g, or t
  modified_base (682)..(682): a, c, t, g, unknown or other
  misc_feature (682)..(682): n is a, c, g, or t
tcagatagagtactcacgaccggtgctcgatttagtacacacacttagggagttgggggcaggagtcagacccagtcaggacacagcatggacatgagggtccccgctcagctcctggggctcctgctgctctggctcccaggtgaccaaatgtgacatccagatcgaccccagtcctccttccacttggtcgtctgacatccgtgtaggtnacagacgtcaccatcacgttcgccgggccagttcaagagtattagtacgcgttggttacncgtggtatcgaagccgaaggaaaacccgagggtaaaaccgaccccgtaaggtcctccgtaggtacttacgtaaggtaaacggtcgtttaacgttaaggttttaaggaaagttcggaccgggtcccaaggttaccgaagggtttccggcggacgtaggtacggagttacggtagggacgtaacgtaagtttccacgttcgtaccgactaacgtcgtacgaccgtacgacctcgacgtacgtccttaggactttagtacgttttacgacttaacgtttaagtttacctacggaacccctaagtaacggtttaattaaacgttttcggtttacggtacgggtaccgttaccggacggtaaccgggtaaacgacgggtcgaactagtaaccgaaacgtacgtgtacgtcgaccnccacgtcttacg

SEQ ID NO: 96891 - DNA, 603 bp, Homo sapiens
  misc_feature: GYAE6OF01ACYVV.29.59.F04.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtnacagngtcaccatcacttgccgggccagtcagagtattagtagctggttggccttggtatcagacaacggaaaccgaagggaaacgcccctaagctacctgactctataaggcgtactagtttaagaagtgaggtccatcgaaggttcggcggcngtgatgtgganagatcnctctcaccatcagcagcctgccagcctgtattgttattttcgacttaactttactttaccgtagtaccctaaagtagttaacttaacgtttacggtttttaccggtacgggttaaccggttacgggtacccgtaaacggggtaacccggtaacgggttacggaaccgtaacgtaaccgtaaaacggtaaccgttaggtacggtaccgtacgaccgtaaccgtctttaccg

SEQ ID NO: 96892 - DNA, 553 bp, Homo sapiens
  misc_feature: GYAE6OF01BYSPM.29.59.F04.1.454.CMB.1.raw
  modified_base (401)..(401): a, c, t, g, unknown or other
  misc_feature (401)..(401): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatctgtagtgacagacgtcacatcacttggccggccagtcagagtatagtagcgtggtgcctggtatcagacaacgaaacgagggaaacgcccctaagcctacctagatactagaaggtcgtacttaagttaagaagtgacgtaccagtacgtaaggtcggacggcaggtgatcgtagggacagtactcactcacacatcacgcacgccngcacgctgattagtagtttcgaacttaacttacttacgcgaacctaagtattaacttaagttcggtttaccggaggtaccggtaccggaacgaacgggaactagggacaacactaacgaaacgtagtcggtacgactacgactactgttacg

SEQ ID NO: 96893 - DNA, 821 bp, Homo sapiens
  misc_feature: GYAE6OF01E4Z8O.29.59.F04.1.454.CMB.1.raw
tcagatagagtactcacgaccggtgctcgatttagtacacacacttagggagttgggggcaggagtcagacccagtcaggacacagcatggacatgagggtccccgctcagctccgtggggctcctgctgctctggctccaggtgccaaatgtgacatccagtactcgaccctagtcctcctcactgtgtcctgctagttcgtggtacggtacgacgacgtacgtaccaaccattccgtaccgttcggcccggggactacggtaccgaaggtagtttaagtacggtacggtccgtttaggggttcggtaccgttagggttaactccgaggtaccgaaaacggaaaacccggaacggggtaaaccctaccccggtaacgtcctacccgtaggtacctttacgtaaggtaacgggttcgttaacgtttaagggtttaaaacgaacgggtacggtaaccgtaccgtaagttaccgggtaacggggttcccgggacggtacgacgggttacggtacgtacgggttacgggaaccttaaggtaaaccgttcctaaccgttacctaacccgtaccgtacgtacccgtacgacccgacgtccgagaccgtacgtccgtaggtacgttcgtttaacgtttaccgtacgtttaaactttagttaaccgtcgtaaaccgttaacgtaggtttaaactttaccggttttacggtttaccggtacggtaccgggttccggaaccggtaacggggaccgtacgggacgtaaccggtaacgttaaccgaaacgttcgggtcgttaacggtcccgtaagcccctaagttcgttccg

SEQ ID NO: 96894 - DNA, 732 bp, Homo sapiens
  misc_feature: GYAE6OF01BB152.29.59.F04.1.454.CMB.1.raw
  modified_base (205)..(205): a, c, t, g, unknown or other
  misc_feature (205)..(205): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatcgacccagtcctccttcactgtcgtctgctatcgtgtaggtnacagacgtcaccatcacgttcggccggctagtcagtagtattagtagcgttggtgcctggtatcgagcgaagaaaccgtaggggaaacgtcccctaaaggccttaccgtagtagtacttaagtaacggtcgttacgttaaggtttaaggtaaagtggtaaccggtacccaagttacgaaacgggtttccgggacggacgtacggttaggtaacgtccgggtagggtaacctaaaggtaaacctttccgaactttccgtaacctaaccgtaaccttaccgaacgtaccgtaaaccgtcccgtacggtacccgaacggtccccgtagtaacgtttggttaacttttacggaacctttaacttaacgtttcgtaacgtacctaaacgtaagtttaactttaacgtttacggttttaccggtacggtaacccggtttacggaacccgtaaagggtaaacccgtaaggtacgtaaacgtaacgtaaaccgaaacgttacggtagttacggctaacgactaccgtagttaccg

SEQ ID NO: 96895 - DNA, 827 bp, Homo sapiens
  misc_feature: GYAE6OF01C8RV5.29.59.F04.1.454.CMB.1.raw
  modified_base (106)..(106): a, c, t, g, unknown or other
  misc_feature (106)..(106): n is a, c, g, or t
  modified_base (200)..(200): a, c, t, g, unknown or other
  misc_feature (200)..(200): n is a, c, g, or t
tcagatagagtactcacgaccggtgctcgatttagtacacacacttagggattgggggcaggagtcagacccagtcaggacacagcatggacatgagggtccccgntcagctcctggggctcctgctgctctggctccaggtgccaatgtgacatccagatgacccagtctccttccactgtgtctgctatctgtaggtnacagacgtcacatccacttcggccggcagtacagtagttattagtacgcgttagggttcgccgtgggtactcgagaccgaaacggaaaccgtaggggaaaccgtccccgttaaaggccttaccgtagtaacgttaccgttaaggtaacgggttccgttaacgtttaaagggttttaacggaaaacgggttcggtaacccgggttacccgtaaacgttaccgggttaaacgggggtttcccggggaccgggtaacgttagggtttacggggtaaccggtttccgggttaacgggggtaaccgtaaacgggtttaaaccttaccccgttaaaccggtttaccccgttaacccgtaacccgttaacgttaacccggaacggttacccgtaaccgggtacccgtacggtaaccgtaaccggttcccgttaggtaaggtttacgttacgtttttaaccgacgttttaaacgttacgttaacgtacgtaccctaaaagttcgttaaacgttttacggttacggttttaccggtaggttacccggttaacggacgtaaacggggtacctaagggtacgtaacgtacgtaaaccgaacgttacgcggtacgaccttacgaccgtactgttacccg

SEQ ID NO: 96896 - DNA, 857 bp, Homo sapiens
  misc_feature: GYAE6OF01DYJ4S.29.59.F04.1.454.CMB.1.raw
tcagatagagtactcacgaccggtgctcgatttagtacacacacttagggattgggggcaggagtcagacccagtcaggacacagcatggacatgagggtccccgctcagctccgtggggctcctgctgctctggctcccaggtgccaaatgtgacatccagatcgacccagtctccttccacgttgtgtctgcatcgtgtaggtgacagagtccacactcacttcggccgggcagtcagtagttattagtagtcgtggttcggccgttggtactcgaacggtacgaaacggaaacccgaaggggaaaccgtaccccccgttaaaggtcccttaccgtaggtaacttaccgttaaggtaaccgggtacgttttacgttaaagggtttaaggaaaacggttcggaaccgggttacccctaagtttaccggtaaacggggtttccggggaccggtacgtaaggggttacggtaacgttcgggtaacggggtaaacctaaggttaaaacgtttcctaacccgtttacctaaccctaaccttacgttaaccgacgtaccggtaaccgtccgtaacggccgtaaccggccgttaggtactttagggtttacttttacggacctttaaacgttttacgttacgtaaccggtaaccctaaacgttaacggttttaaatttaacggttttaaccgggttttttaccggtacgggtttaacccgggttaacccgggtaaccgggtaaaccgggggtaaaccgttaaggggtacccgtaaacggtaaaccgttaaacccggaaaaccgggttaacggtacgggttacgtaacccgtacggaacccgtaacccgtttcgttaccccgg

SEQ ID NO: 96897 - DNA, 760 bp, Homo sapiens
  misc_feature: GYAE6OF01D65T4.29.59.F04.1.454.CMB.1.raw
  modified_base (205)..(205): a, c, t, g, unknown or other
  misc_feature (205)..(205): n is a, c, g, or t
tcagatagagtactcacgaccggtgctcgatttagtacacacacttagggattgggggcaggagtcagacccagtcaggacacagcatggacatgagggtcccccgctcagctcctggggctcctgctgctctggctcccaggtgccaaatgtgacatccagatcgacccagtcctccttcactgtcgtctgcatcgtgtaggtnacagagtcaccatcacgttcggccgggaccagtcagtacgttagttagtaggtcgttgggttcggtccgttggtatccgaagaccgaaacggaaaaccggaacggggaaaacccgtaccccgtaaacggtcccttaccgtagtaacttacgtaacggtaacggtcgttaacgtttaaggttaaagtaaaggtcggaccgttacccctaagtacgtaacggggttccgggacggtacgtaggtacggtagtaccggtagggtaacctaaggttaacttcctaaccgttcctacctaacctactaccgtacgtaccgtacggtcccgtacgacgtaaccgtccgtagttacttcggtttattttacgtaaccgtttaaccttttacgttaaccgtactaacccgtaaattaacgtttaactttaaacggttttaccggttttaccggttaccgggttacggttacccggtaaccgggaaaccgggtaacgtacggggtaacgtactaaacgtaacgaaaccggttagtacggtcggtactaccgtacacttgtaccg

SEQ ID NO: 96898 - DNA, 797 bp, Homo sapiens
  misc_feature: GYAE6OF01ETZMP.29.59.F04.1.454.CMB.1.raw
tcagatagagtactcacgaccggtgctcgatttagtacacacacttagggattgggggcaggagtcagacccagtcaggacacagcatggacatgagggtcccccgctcagctcctggggctcctgctgctctggctcccaggtgccaaatgtgacatccagatcgacccagtcctccttccactgtgtctgcatctagtaggtgacagacgtccaacctatccacgttcggccgggccaggtcagtacgttattagtagcgttggtacgccgtggtatcgaagcgaacgaaaccgagggaaaccgcccctaagcctaccgtagtaactaccgtaagtaacggtccgttacgttaaggttttaacggaaacgttggtaaccggtacccaaagttaccggtaacggggttccgggacggaccgtaagggtacggtacttaccggttaggggaaaccctaaggtaaactttcccgaacctttaccgttaccaacccgtactccgaaccgtctacggcccttacggccgtaacgtcccggtaagtacgttagtttaacgtttaccgaaaccttaacgttttacgttaccgtacgtaacccgtaaagttaaggtttaaactttaacggtttacgtttttaacccgggtacgggttaacccggtttaccggggaaaccccggttaaacgggggtaaaccgttaaacgggggttaccgaaacctaaaccgttaaaccggtaaaaccggtaccggttacgggtccggtacccgtaacggtaaccctaaccgtacgtttacccgg

SEQ ID NO: 96899 - DNA, 669 bp, Homo sapiens
  misc_feature: GYAE6OF01DCX8Q.29.59.F04.1.454.CMB.1.raw
  modified_base (213)..(213): a, c, t, g, unknown or other
  misc_feature (213)..(213): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggcctcccaggtgccaaatgtgacatccagatgacccagtctcctccactgtgtctgcatctgtaggtgacagagtcaccntcacttcggccgggccagtcagtagtacttagtacgtcgtgggttggcctggtatcagacaacgaaaccgaggggaaaccgcccctaagcctccagatcgtaagtacggtcttacgtaaggttagaaagtcgacgtcccagttacgaacgggttcggcggtactaggtggtactaccggtaggggaacaacggtaatttccgaaccttcctacacccgtataccgacgaccgtacgtcctacgacaccgtccgtagtacttgtactttcggacttaactttacgtacgtacgaaccctaaacgtattaattaacgttttacggtttaccggtcgggtaaccggtttacccgggacccgtaaacggggtacccgtaaaggtaccgggaacttaacgtaaaccggaaaaccgtaccggttaggtacccgggacttacccgaaccgtcttacgttaccg

SEQ ID NO: 96900 - DNA, 589 bp, Homo sapiens
  misc_feature: GYAE6OF01ENN4I.29.59.F04.1.454.CMB.1.raw
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttcactgtgtctgcatctgtaggtgacagagtcacctattatttgccgganaagtcacganataaactacttttaaatgtatcagacaacaaccgagggaacgacccaagcctctgactcgatgctgcatcaagtttagagtaggtcgggtaccagtccaggttcaggtggcagtgatcgtagggactaacttcactctaccactactcacgtctacgttctcgactaacgtagtaagttacttttacgacttaactttacttattacgtaacaacgtagttacgttaactacgttacttttaccctttacgttacccgtttccggtacccgttacggggacgttaagtacgtaactacgttaactaaacgtacgttcgtacggacctacgaactaccgtacttcgtcgttacc

SEQ ID NO: 96901 - DNA, 862 bp, Homo sapiens
  misc_feature: GYAE6OF01EZCRM.29.59.F04.1.454.CMB.1.raw
  modified_base (203)..(203): a, c, t, g, unknown or other
  misc_feature (203)..(203): n is a, c, g, or t
tcagatagagtactcacgaccggtgctcgatttagtacacacacttagggagttgggggcaggagtcagacccagtcaggacacagcatggacatgagggtccccgctcagctcctggggctcctgctgctctggctccaggtgccaaatgtgacatccagatgacccagtcctccttccactgtgtctgctatctgtaggtnacagacgtcaccatctacgttcgccgggctagtcagtagtattagtagtcgttggtacggtccttggtaatcgagccgaaaggaaaaccgagggaaaccgaccccgtaaagtcctaccgtagtacttacgtaacggtaacggtcgttacgttaaggttttaaacggaaagtttacggtaacggttcccaaagttaccggtaaaacggggtttccgggacggtaccgtaggttcgggtaagttcggttacggggaaactaacggttaaacgtttaccgtaccttacctaccaacccgtattacgacggtaccaacggtcccgtagaccggacggtacccgtaggtaacgttacggtttaactttttccgggaaaccttttaaccctttaaccggttaaccgtttacggttaaaccccgtaaacggttaccggggttaacccgtttttaaaccgggttccggtttaccccccgtttacgggtttaaccgggttacccgggtttacccggggtaaaccccgggtaaaacccgggggttaaaccgttaaacgggggttaacggtaaaaacccggtttaaccggaaaaaccgggttaaccggtttacgggttacggggtacccgtttaacgggaccccttaaaccgggttctttaaccccgggg

SEQ ID NO: 96902 - DNA, 752 bp, Homo sapiens
  misc_feature: GYAE6OF01BKPD6.29.59.F04.1.454.CMB.1.raw
tcagatagagtactcacgaccggtgctcgatttagtacacacacttagggagttgggggcaggagtcagacccagtcaggacacagcatggacatgagggtccccgctcagctcctggggctcctgctgctctcggctcccgaggtgccaaatggtgacatccagatgacccagtcctccttcactgtgtctgcatctgtagtgacagacgtcaccatccacgttggccgggccagtcaagagtattagtagtctggttggcctggtatcagcacgaaaccgtaggggaaacacccgtaagtctccgtagactcctaagtaacgggcttaccgttaaggtttaacgaaagttcggaacggtcccgtaacgttacgaaacgggtttccgggaccggtacgagggtaggtacgtacgttaggggactaaggtaacttactacgtacctcgaaccctataccacggtacctaacgcccgtcggaccgtacggccgttaggtacgttggttacgttttacggactttaaacctttacgttttaaccgtccgtaacctaaacggttaacgtttaaacgtttaaacgtttaccggttttacccgggttacgggtacccggttttccggggaaacccggtaaaccggggtaaaccggtaaagggtaccgggttaaaccaaacggttaaccggtaaaaccggttaacggttacgggttaccgggttacccgttaggaaccctaccggtactttaacccgg

SEQ ID NO: 96903 - DNA, 603 bp, Homo sapiens
  misc_feature: GYAE6OF01AE11F.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttcactgtgtctgcatctgtaggtgacagagtcaccatcacgttggccggcagtcagagtattagtagtcgtggttggcctggtatcgagcaacgaaaccgagggaaaccgcccctaagcctccgtagattacgtagtaacggcgtacttaagtttaagaaagttcgacggttcccaagtacgtaacgggttcggcggacgtaggtaggtagtcgtagggaacaagtaacttcaccttctaccgaactatcgagaccacgcctgccagcctgagtcgtatttgactaatttcgtactcgaccaagtagtaattaacgttcgtttaccggaggtaccgttacgaccgtaaagggaaccgtaagggtacgtaacgtaataaccgtaaaaccgtagttcggtacggtacacgtaccgtaacctgttaaccg

SEQ ID NO: 96904 - DNA, 727 bp, Homo sapiens
  misc_feature: GYAE6OF01CITSY.29.59.F04.1.454.CMB.1.raw
  modified_base (697)..(697): a, c, t, g, unknown or other
  misc_feature (697)..(697): n is a, c, g, or t
  modified_base (716)..(716): a, c, t, g, unknown or other
  misc_feature (716)..(716): n is a, c, g, or t
tcagatagagtactcacgaccggtgctcgatttagtacacacacttagggattgggggcaggagtcagacccagtcaggacacagcatggacatgagggtccccgctcagctccgtggggctcctgctgctctggctcccgaggtgaccaaatgtgacactccgagatcgaccctagtcctccttccacttgtgtctagctatcgtaggtaggtgacagtagtacacgtatacacgtcggccgggccagtcagacgtactaactaacctaattagttagtaagtttacgtaatacgtaaacggttaaaaccgaacgggtaacctacccttaaagtccgttaagcttacgttagtcgtacgtacgtacctcttacctttacgttacggaacggtaacgggttcgggtacctaacggaacgttaacctaaacgttcgtaggtcgggacgttacgtcgtacgggtacggatactactttacctacgtcctaacgactagtaccgtagtacgttacgtacgaactacgttacgtacgtttattaccggacttaccttaacgtctacgtaaacgtacggtttacggttaccgttacggtccgttacccgttacggtcgggtaacccgttaaccgggacgggtaaacggtaaccggtaaggaaacgtaacccgtacgaaaggttccgttaggccaaccggttnaacccgttactaacggttnttacccgtacg

SEQ ID NO: 96905 - DNA, 727 bp, Homo sapiens
  misc_feature: GYAE6OF01CUD5P.29.59.F04.1.454.CMB.1.raw
  modified_base (226)..(226): a, c, t, g, unknown or other
  misc_feature (226)..(226): n is a, c, g, or t
  modified_base (502)..(502): a, c, t, g, unknown or other
  misc_feature (502)..(502): n is a, c, g, or t
  modified_base (516)..(516): a, c, t, g, unknown or other
  misc_feature (516)..(516): n is a, c, g, or t
  modified_base (676)..(676): a, c, t, g, unknown or other
  misc_feature (676)..(676): n is a, c, g, or t
tcagatagagtactcacgaccggtgctcgatttagtacacacacttagggattgggggcaggagtcagacccagtcaggacacagcatggacatggacgggtccccgctcagctccgtggggcctcctgctgcctctggcctcccgaggtcgaccaaagtgtacgacactccaagactcgaccctagttcctccctcctacgtgtcgtctgctatcggtggtaganacgagactaccaacgtactaccgacggttccgggcccgggtactagtacgtaagtagttaacgttaggtacggtcgttcggggttacggtaccgttagggtactacgaacgggaaccgaaaacggaaaacccggaaacggggaaccctacccctaaggtccctacggtatacgtacgtaaagtacggtcgttaaacgttaggtaaacgaggtacgtacgtaccgtaagtacgtacgggtcggacgtgaagtcgagtcggagacgtatctacgtacncaccactagtacanaccgtgtccacggactcgacgttgaacttcggttaattccgtaactttaattacgtactacgaaccgtaaacgttagttaacgtttaacggtttccggtaccggtaccgggtaaccgggttaacggaccggttaaaccggtaagtaacgggacgttaaanaccgttaaaaccggagttacggcgtacggtacaccgtactacgttctaccg

SEQ ID NO: 96906 - DNA, 753 bp, Homo sapiens
  misc_feature: GYAE6OF01BXH44.29.59.F04.1.454.CMB.1.raw
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (434)..(434): a, c, t, g, unknown or other
  misc_feature (434)..(434): n is a, c, g, or t
  modified_base (728)..(728): a, c, t, g, unknown or other
  misc_feature (728)..(728): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctccaggtgccaaatgtgacatccagatgacccagtcctccttccactgtcgtctgcatctgtaggtgacagacgtcacatcacgttcggccggctagtcagagtattagtacgngtggtagcgtggtacncgagacaagaaaccgtacgggaaacctacccgtaagcctcctagtacgtactaagtaacggtcgttacgttaaggtttaagaagtacggtacgttacctagttacggtaacgggttcgggacgtcgtaaggtcgtacttcggaggtaaccagtaactccgtacgttacnctaccgactacgacgtcgacgtccgtacgaccgtacgtccgttagtacgttcgtttacgtttaccgtaactttaaaccgtttacgttaccgaaacccgtacctaaaacggtttaacggttaaagtttttaaaccggttttaccggttttacccgggtaaccggggtttaaccgggttaacccgggggtaacccgtaaaaggggttaaccccgggtaaagggttacccgggaaactttaaacgggttaaacccgaaaacccggttaacggtttcgggtacaacccgggtttaacnccccggtaaacctttacgtttaccg

SEQ ID NO: 96907 - DNA, 623 bp, Homo sapiens
  misc_feature: GYAE6OF01BBSJH.29.59.F04.1.454.CMB.1.raw
  modified_base (508)..(508): a, c, t, g, unknown or other
  misc_feature (508)..(508): n is a, c, g, or t
tcagatagagtactcacgaccggtgctcgatttagtacacacacttagggagttgggggcaggagtcagacccagtcaggacacagcatggacatgagggtcccccgctcagctcctggggctcctgctgctctggctcccaggtgccaaatgtgacatccagatgacccagtcctcctccactgtgtctgcatcgtgtaggtgacaggatacaccaatcacgttcggccggcagtcagtagtattagagtcgtggtgcctaggtatcgaggcaagaaaccgagggaacgccctaagctcctgacttctaagtacggcgtacgttaaggttaacgaaagtcggtacggtacctaagtacggtaaggtttccggcggactaaggtcggatcgggtagggacctaaggtacttacgacttctaccgtaccattacgacgtaccgacgtacccgtgaccgtacgtaccgtagtaagttgttaacgtttacgactttaactttagttaaccncgtaacccgaatacgttaattacgtttagtttccggagttacgttcggaaccgtacggaaccgtaggtacggactaactacggaaccgtgtacggtgactataccgactgttccg

SEQ ID NO: 96908 - DNA, 787 bp, Homo sapiens
  misc_feature: GYAE6OF01C629T.29.59.F04.1.454.CMB.1.raw
tcagatagagtactcacgaccggtgctcgatttagtacacacacttagggagttgggggcaggagtcagacccagtcaggacacagcatggacatgagggtccccgctcagcctccgtggggctcctgctgctctggcctcccgaggtcgaccaaatgtcgacatccagatcgacccagtcctccttccacttgtgtctgactagtctaggtaggtacgaacgagtacgtacacctactccacgttcggccggacctagtcagtagttatagtagtacgtggttcgccgttgtacgcgagacgaacggaaacgaaagggaaccgacccctaagcctaccgtagacttacgtaacggttaacggtaccgtttaacgtttaaggtttaaacggaaaggttacggtaaccggttaaccccgtaacggttaccggtaaaccgggggtttacgggacccgggtacgtacgggttacggaagttaccgggacggggtaaactaaacggttaccttaaccgtaccgttacctaacccgaacctaacgttaccaacggcctaacccggccgtacggtacctaccggttacgttaagtaagtttacgtttaactttaacgaacctttaactttaacttacgaaccgtaaccgtaaacgttatttaacgttaaccggttttgtttaacccgggcggtttaaccggtacccgaaacggaaacccgggtagaaaccggtcgtaaataaccgaaaccgtaaacgtcggtaggtccgacgttaccaacgtcttaccggtag

SEQ ID NO: 96909 - DNA, 698 bp, Homo sapiens
  misc_feature: GYAE6OF01DLGIH.29.59.F04.1.454.CMB.1.raw
  modified_base (203)..(203): a, c, t, g, unknown or other
  misc_feature (203)..(203): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctccaggtgccaaatgtgacatccagatgacccagtctccttccacttgtgtctgctatctggtaggtnacagatcacctatcacgttcggccggccagtcagtagttattagtagtcgttgggttcggtccttaggtactcacgacgaacgaaaccggaagggaaaccgacccctaaggccttaccgtagtacttacgtagtaacggtcgtttacgttaagtttagaaaggtgtaacggtcctagtacggtaacgggttcccggaggtacgaaggttgggaacttcgggtagggaaccgtaagtacttccgaacttcctacgaaccactacgacgcgacgtccgtgacgacgtccgtaggtacttacggttactttacgtaaccttaactttacttaacgtaccaacctaaacgttagtttaaatttaacggtttacggttttccgggtacgggttaacccggttacgggaaccggaaaccgggtaacgtaacggggtacgaacgtaacgtaaccggtaaaacgtacgttacggtcggtacgtacgacccttaccgtattccg

SEQ ID NO: 96910 - DNA, 566 bp, Homo sapiens
  misc_feature: GYAE6OF01D1SS8.29.59.F04.1.454.CMB.1.raw
  modified_base (275)..(275): a, c, t, g, unknown or other
  misc_feature (275)..(275): n is a, c, g, or t
  modified_base (286)..(286): a, c, t, g, unknown or other
  misc_feature (286)..(286): n is a, c, g, or t
  modified_base (343)..(343): a, c, t, g, unknown or other
  misc_feature (343)..(343): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (439)..(439): a, c, t, g, unknown or other
  misc_feature (439)..(439): n is a, c, g, or t
  modified_base (551)..(551): a, c, t, g, unknown or other
  misc_feature (551)..(551): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttcactgtgtctgcatctggtagtcgactagacgtcaccatcactcgccgggcagtcagatatagagcgtggtcgctgtatcagcagaaacgaggaaacnccctaagctcngatcgtagtacgtcgtacgtagttagaagtgacggtaccagtcgaaggttcggcggntacggtggactcggtaggactagaacttcgactcaccaccatcganacacgtcncgacncggactggtactgttaatttcgacttaacgttatacncgaaccaataagttacttaacgtttcgttacggtacggttacgaccggaacggtaaccggaacgtaacggtcgtaacaacgtaacggtaaacaagtcgggtcgacgtaaccncgtaacctgttaccg

SEQ ID NO: 96911 - DNA, 1078 bp, Homo sapiens
  misc_feature: GYAE6OF01E37WP.29.59.F04.1.454.CMB.1.raw
tcagatagagtactcacgaccggtgctcgatttagtacacacacttagggattggggggcaggagtcagacccagtcaggacacagcatggacatgagggtcccccgctcagcctcctggggcctcctgctgctctggcctcccaggtgccaaatgtgacatccagatcgacccagtcctccttccacttgtcgtctgactattcgtggtaggtcgacagtacgtccacctatctacgttcggcccgggcaggtcagtagttattagtagtcgttggttcggccgttaggtactacgacgacgaaacggtaaaaccggaaggggaaaccctaccccgttaaacggcccttaccgtagtaaccttaacgttaacgttaacggggtccttttaacggtttaaagggttttaaaacggtaaacgggttcggtaacccggttacccgtaaaccggtttcggggttaaaccggggtttccggggaaccggtacggttaacgggttacgggtaacggtttacccggggttaacggggaaaccttaaacggggtttaacccttttacccggtaacccccgtttaacgtacccccgtaaacccgttaccggtaacccggtaccgtacccggtaaccccgggtaccccggtacgtaacccgggttaaccgtttacccgggtaaggtttaaaccgttttaacgggttttaaccgtttttaaccggtaaaacccgtttttaaaacccgtttttaccgttaaaccccgttacccggaaaacccgtttaaaaccggtttaaacggttttaaaacggttttttaaaccggttttttaccccgggggtttttaccccggggttaaacgggggttttaacccccgggttttaacccgggggaaaccgggggtttaaaaacccggggtaaacccggggttaaacggggggttaaaccccgttaaacggttaaaaacccggggtttaaaacccccgtaaaaaccgggtttacccggtttaacccggggggtttaacgggtaacccccgtttaaggtaaaccccccgttaaccgtttaaccggtttttaaccccggg

SEQ ID NO: 96912 - DNA, 736 bp, Homo sapiens
  misc_feature: GYAE6OF01A8IA6.29.59.F04.1.454.CMB.1.raw
  modified_base (186)..(186): a, c, t, g, unknown or other
  misc_feature (186)..(186): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccgagatgacccagtctccttccactgtntcgtgctagtctggtaggtgacagtacgtccaaccatctacttcggcccgggctaggtcagagtaagttaggtagtcgttgggtcggtccgttggtatcgaacgacgtaacgaaaacccggtaagggaaaccgcccctaaaggtcctaccgttagatacgtaacgtaacggtccgttacttaaggttttaaacggaaggttcggacggtacccaagttaccggtaacggggttcgggacggtacggacggttaggacgtcgggtacggggaacctaagttaaccgttactaaccggttacctaccctaaccgagttaccacgtacgtacccggtacctcggaccgtaccggaccgttatacggttagttactttttacgacctttaactttcgttactcgaactaaacgtaagttttaactaacggtttttacgttcccggtagggtccgttccggaaccgggtaaagggtaaccggtaaggtacggacctaacggaaccggttaaacgtacgtagtaccgacgtaaccgtaccgtccgttaacgttccg

SEQ ID NO: 96913 - DNA, 852 bp, Homo sapiens
  misc_feature: GYAE6OF01ET7Q6.29.59.F04.1.454.CMB.1.raw
  modified_base (106)..(106): a, c, t, g, unknown or other
  misc_feature (106)..(106): n is a, c, g, or t
  modified_base (198)..(198): a, c, t, g, unknown or other
  misc_feature (198)..(198): n is a, c, g, or t
tcagatagagtactcacgaccggtgctcgatttagtacacacacttagggattgggggcaggagtcagacccagtcaggacacagcatggacatgagggtccccgntcagctcctggggctcctgctgctctggcctcccaggtcgaccaaatgtcgacactccagatacgaccctagtcctcccttccatgtgtctnctatcgtgtaggtcacagacgtccacctatcctacgttcggacccggcgagtaccaggtacgttaagttaggtacggtgttacgggttcggtccttaggtactgacgaccgaacgtaaaaccggaacgggtaaaccgtccccgttaaagtccgttacccgtagtaaccggtttacttaacggtaacggttaccgtttaacgtttaagggtttaaacgaacggttcggaaccgttccttaacgacgggtaaacggggtttccgacgggtcgtaggtacggtagttacccggtagggaacgtaacggttaccttaaccgttaccttaacccgtaccgttaacccgtaactaccgtacgtaacccgtaccgtaccgtacgtaccgtaaccgttcggtaacgttaacgttccgtttaaggtttaccgttaaacccgtttaactttacggttaaccctaccggtaaaccctaaggttaaccgttttaaagtttaccggttttaacccgggttttaccggttaacgggttacccggtaaaccggtaaccggtaaacgggtaaaccggttaacgggtaaccgttaacggtaaaccggttaaaccgaaaaccgttcgtaaccgggtacgtacccgtaaggtacccctagttcccgtttaacc

SEQ ID NO: 96914 - DNA, 747 bp, Homo sapiens
  misc_feature: GYAE6OF01DK322.29.59.F04.1.454.CMB.1.raw
  modified_base (552)..(552): a, c, t, g, unknown or other
  misc_feature (552)..(552): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtcgaccaaatgtgacatccagactcgacccagttcctcccttccacttgtcgtctgctattcgtaggtaggtacgacgaggtacgtaccaacctacttaccgtacgttccgggcccgggtacctaggtcgtaaggtaagttaacgtttacggtacgtcggtttgggttcggtccgttaggtactacgacgacgaaacggaaccggtaacgggaaaccgtccccgtaaggccttaccgtaggtactacgtaacggtaacgggtcgttaacgttaaggtttaacgaaacggttcggtaaccgttacctaagttaaccgggtaacgggttccggacggtacgtacggtaggtacgttcggtaggaaccgtaagtacctactaccttacctaacgaccctagtaccaggtaccngtccgtacgtaacgccggttactgtaagttacgtttacgtttacggtaactttaacctttagtaccgtacgaccttaaagtacgtttacttaacggtttcgttaccgggacggttacgtacccggaacggaacggtaaccggaggtacgaactacggaactaacggtacgtgtccgactacgactacgttcgtcg

SEQ ID NO: 96915 - DNA, 634 bp, Homo sapiens
  misc_feature: GYAE6OF01B1J3U.29.59.F04.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
  modified_base (457)..(457): a, c, t, g, unknown or other
  misc_feature (457)..(457): n is a, c, g, or t
  modified_base (575)..(575): a, c, t, g, unknown or other
  misc_feature (575)..(575): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtcgtctgcatcgtgtaggnacagcgtcaccatcacgttgcccgggccagtcaggtagtattagagtctggttcgcctggtatcagacaaggaaccgaggaacgaccctaagcctactgntactagtaggtcgtattaggtttaagaagtggacgtacccagtacgtaaggttcgggcgagtaggtgaatcggtacgggaatagtaacttccacttacacctaaccgattacacgtaccgacgtacctgactacggtcctaaggtacttaggtntttacgaactttaacgttaacttcgactaaccctaagtaagtttaacttaacgttttacggtttccggacggttccggttacccggaaacgtaacgggtacccgaaagggtccgtaanaaccggttaaacgaaaccggttatagggtccgtaactccgggaccctacggtattccgg

SEQ ID NO: 96916 - DNA, 822 bp, Homo sapiens
  misc_feature: GYAE6OF01CO5G0.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctcgtcggcctcccgaggtcgaccaaagtgtgaactactccagatcgaccccagtcctcccttccacgtgtcgtctgctatctaggtaggtagacgagacgtccaacctactaccgtacgttccgggaccccgggtaccacggtacgtagtagttaagttaaggtaggttcggttcgggttcggtccgttacgggtactacgaacgtaaccgaaacgggaaaacccggaaacggggtaaacccgaccccgttaacgtcctaccgtacgtacttacgtaaggtacggtacgttacgttaaggttaagaacgtggtacgtaccgtagtacggtacgggtccggcggtacgtggtaggacgtacgtacgggtaactacgtacttacgtacctacccgtacgtaaccctgaaccgacgtacccgtaaccggtaccgtcggtaaccggaccttacgtaggttaaccctttagggtttacgtttaaaccgttaccctttaaacgttttactaacccgttaacccgtaactttaaaccggttaagtttaaaccgtttaggttttaccggttttacccggggtacgttaacccgggttacccgggtaacgggtaaaccgggtacgggtaaaccgggttaccgtaaaagtacgttaaaacccgaagtaccgtgtaggtacccgataccgtacctcgtttaccg

SEQ ID NO: 96917 - DNA, 743 bp, Homo sapiens
  misc_feature: GYAE6OF01EEC3W.29.59.F04.1.454.CMB.1.raw
  modified_base (105)..(105): a, c, t, g, unknown or other
  misc_feature (105)..(105): n is a, c, g, or t
  modified_base (210)..(210): a, c, t, g, unknown or other
  misc_feature (210)..(210): n is a, c, g, or t
  modified_base (378)..(378): a, c, t, g, unknown or other
  misc_feature (378)..(378): n is a, c, g, or t
tcagatagagtactcacgaccggtgctcgatttagtacacacacttagggagtgggggcaggagtcagacccagtcaggacacagcatggacatgaggtccccgntcagctcctgggctcctgctgctctggctcccaggtgccaaatgtgacatccaagtatggaaccctagttcctccctttcacttgtgtctgctatctggtaggtnacagacgtccacatccacgttcggccgggactaggtcaagtacgttattagtagtcgtgggttcggccctggtactacgagacaacggaaaccgtaaggggaaccgtaccgtaacgccgtcgttacgacgtactaagtaacggtccgtagtttaggttaacaaaggtntacggtacctagtacgtaaacgggttcgggacggtacgtaggtacggtacttacgggcgggtaaactaggtaaactttccgacgttacctactaacccgtagttaccgacggaacctaccggttccgacggtaccgtacgtaccggttagttacgttaagtttacgttttaacggacctttaaaccgttacttaaccgtcgtaaccctaaagttaacgtttaaacgttaacggtttttacgtttacgggtacgggttaccggttaacggaaccgtaaacggggtaacgtagggtaaacggtacttaaacgtacggtaaacccgtagcccgggtttaagccgtacccggaattcccgtgttacccg

SEQ ID NO: 96918 - DNA, 743 bp, Homo sapiens
  misc_feature: GYAE6OF01B8ZU4.29.59.F04.1.454.CMB.1.raw
  modified_base (484)..(484): a, c, t, g, unknown or other
  misc_feature (484)..(484): n is a, c, g, or t
tcagatagagtactcacgaccggtgctcgatttagtacacacacttagggagttgggggcaggagtcagacccagtcaggacacagcatggacatgagggtcccgctcagctcctggggctcctgctactctggcctccgaggtcgccagatgtgacatccaagatcgacccagtcctccatccactccctgtactgctagtcgtggtacggagacaagtaactaccactatttattcggacgacctaagcaacgactaacttaaaccttaacctttttaattggtatactaaggactaaccaaaccggacggggaaccgaccccaaaggtcctaccggtacgtagtacggtactcggtacctggacctacttaaccgtaatttaaggacggtacgggttccgggacctagtccggtagtacgtagtggacgtgtacggtatcggtaacggacttaacttacgactctaccgacctacgtacgntacgtacgtcttaacggaccttaacggtagttaacgttacgtttacgtaacgttaactttaacgttacttaacgtactaaacgggttaactaacgttacgttaaccggttttaacctttccgtttaccgttacccggttacggtacccggttaacgggaccttaacggtaaccggtactttaaccctaaacggtaaacctacgggttaaccggtcccggttactcgggaacccccttagttaacccgtcggtttacccc

SEQ ID NO: 96919 - DNA, 866 bp, Homo sapiens
  misc_feature: GYAE6OF01BUOEZ.29.59.F04.1.454.CMB.1.raw
  modified_base (132)..(132): a, c, t, g, unknown or other
  misc_feature (132)..(132): n is a, c, g, or t
  modified_base (619)..(619): a, c, t, g, unknown or other
  misc_feature (619)..(619): n is a, c, g, or t
tcagatagagtactcacgaccggtgctcgatttagtacacacacttagggagttgggggcaggagtcagacccagtcaggacacagcatggacatgagggtccccgctcagctcctggggctcctgctgctntcggctcccgaggtgaccaaatgtgaacatccagatcgacccagttcctcccttcacttgtacgtctgactacttcgtaggtaggtacgaacgaggtacgtaccaacctactccgtacgttcgggacccggggtccaaggtcctaaggttattaacgtttaggtacggtcgtttcggggttaccggtccgttagggtaacttacgaacggaaccgaaaacgggaaaaccccgggtaacggggtaaaacccctacccccggttaaagtcccgtttaccggtagtaaccggtttaacgttaaacggtaacgggttaccgtttaacggttaaggtttaaacggtaaacggtcggtaaccgttaccgtaagttaccggtaacggggttacggacgtacggtaagggtacgtacggtacgtacgggaacgtaacgttaaacttccaccgttactacccgtaacctagtaccggtaatacccgtacggttacnccggtaacgttaacccggccgtttaggtaacgtttacggtttactttaaacccttaaggttaaacccttttacgtaccgttaacccggaacctaaaggttaaccgtttaacgttttaaccggttttcgggttaaccgggttacggtaacccggtaacgggtaaacccggacgggttaaacccggtagggttacccaataaccggtaaacgaaacgtttgacggtcttagacccattacctggttacc

SEQ ID NO: 96920 - DNA, 726 bp, Homo sapiens
  misc_feature: GYAE6OF01B1GRJ.29.59.F04.1.454.CMB.1.raw
  modified_base (172)..(172): a, c, t, g, unknown or other
  misc_feature (172)..(172): n is a, c, g, or t
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
tcagatagagtactcacgaccggtgctcgatttagtacacacacttagggattgggggcaggagtcagacccagtcaggacacagcatcggacatgaggtccccgctcagctcctgggctcctgctgctctggctccgaggtgaccaaatgtagacatccagactgaacccngtcctccttccactgtgtctgcatcctgtaggtnacagacgtcacctanctacgttcggaccggccaagtcagtagtatgtacgtgtgtcgctggtatcacgcaagaaaccgaggggaaactcccaagtcctcgtagactactaaggtaacgcttaacgtagttaacggaagttcgtaacgtcctagtaccgtaaagggttccggacgaccgtaaggtggtactacggtaggaaactacggtaaacttcctacgttacctaccgtaacctaagtacctaacggtacgtaccgtaccgtacgaccggtaacgtacccgttagttaacgttacgtttaactttaacggtaaccgtttaaaccgtttaagtttaaccgtaccgtaaccctaacgttaagtttaacgttaaacgttttacggtttaccggtaccgggttaaccggtttaaccggaaccgtaaacgggttaacccggaagggttaccggtaaagaacggttaaacctaaacgggtaccgttacgggtacgtacgtacgtaccgtaaccgtcgttacccg

SEQ ID NO: 96921 - DNA, 935 bp, Homo sapiens
  misc_feature: GYAE6OF01AI5LS.29.59.F04.1.454.CMB.1.raw
  modified_base (199)..(199): a, c, t, g, unknown or other
  misc_feature (199)..(199): n is a, c, g, or t
tcagatagagtactcacgaccggtgctcgatttagtacacacacttagggagttgggggcaggagtcagacccagtcaggacacagcatggacatgagggtccccgctcagctcctgggctcctgctgctctggctcccaggtgccaaatgtgacatcagatgacccagtctcattccatgtgtctgcatctgtaggtnacgtagagtcaccatctacttggcccggcagtccgaagtacgttagttaggtacgcgttggttggtcccgtaggttaacgttcaagtaccgaaggtaaaacccgaaggggaaaccggtccccctaaagtccgttaccgtacggtactaccgttaagtaaacgggtcgttacgtttaaggtttaaacgaagttcgggtaacggtcccgtaaggttacgtaacgggtttaccggggcggtaaccggttaggtcgggtaactccgggttacgggaaacgtaacggtaacgtttccgacttaccgtaacccgtacctaactacgtacggaccgttaccggtacccgttaccggtaccgtaacgggtacccgttacggttaaacgtacggttttacgtttaccggttaacgttaaacccgttttaacgtttaaccgttaacccggtaccccgtaaaacggtttaacgtttaaaccggttttaaaaccgttttcgggtttttaaccccgggttaacgggttttaaccccgggttacccgggggtttaaccccgggtaaaaccggggggttaaaaccccccgggttaaacgggggttttaacccggggtaaacccggtaaaaccggtttttaaaccccggggaaaaaccgggttttaaccccgggtttaaaccgggttttaccccggggttaaaccggttcccgggtaaaacccccgtttaaccgggtttaaaacccccgggg

SEQ ID NO: 96922 - DNA, 764 bp, Homo sapiens
  misc_feature: GYAE6OF01E14R3.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctgggggcctcctgctgctctggcctcccgaggtgaccaaatgtgacactccagatcgaccctagtccttaccttccacgttggtgttcctgctattcgtaggtaggtagacgagacgtaccacctactaccgtacgttccgggcccggggtacctacgtaccgaaggttacgtttaagtttagtaacggtcggtttcggggttccggtcccgttagggttataccgaggaacccgaaagggtaaaacccggaaccggggtaaacccgaccccgtaaggtcctaccgtagtaaccgtacgttaaacggtaacggttaccgttacgtttaaggttaaaggtaaacggtcgtaccggtacccaaggttacgggtaacgggtcgggacggtacgtagggtcgacgtacggtacgggaactaagtaccgttctacctccgtacacctagtcacggactcgcctcgactactcgtagtacgtgtttattccgtaacgttaactttagtacccgtgaacctaagttattaacgttttacggttaccgttcgggttacccgaccggttccgggaaacggtaccgggtaacgtagggtacctaacgaaccgttaaacgacggttaagtcgggtacgtacgtaccgacttccgtgttccg

SEQ ID NO: 96923 - DNA, 791 bp, Homo sapiens
  misc_feature: GYAE6OF01BEF1M.29.59.F04.1.454.CMB.1.raw
tcagatagagtactcacgaccggtgctcgatttagtacacacacttagggagttgggggcaggagtcagacccagtcaggacacagcatggacatgagggtccccgctcagctcctggggctcctgctgcctctggctcccaggtgccaaatgtgacatccagatcgacccagtcctccttccatgtgtctgctatcgtaggtaggtcgacagactcaccatctacgttcggccggacagtcagtagttattaggtacgtcgttggtcggcctggtactcgacggacgaacggaaaccgacgggaaacctcccgtaagtcctacgtgtactcgtaagtaacggtcgttacgttaaggttaaggaaacggttcggaaccggttaccctaaggttacggtaacggggttccggaccggtagtacgggtggtacgttcgggtacgggaactaaggttaacctccgtaccttactaaccaccgtaacgtccgaacgtaccgtaccggtacctacggtaccgaaccggttctaaggttacgtttcggtttaactttacggaaacccttttaaacgtttaccttaaccggtacctaaaccccgttaaagttaacggttttaacttttaaaccgggttttccgggttttaaccccgggtacgggttaacccggttaccggggaaaccccggttaaacgggtaacccggttaagggggttacctaaacgtaaccggttaaaccgaaacggttaccgggtcgtacgggtaccttacgggaaccctaccgttgttaccccg

SEQ ID NO: 96924 - DNA, 699 bp, Homo sapiens
  misc_feature: GYAE6OF01EEVGL.29.59.F04.1.454.CMB.1.raw
  modified_base (684)..(684): a, c, t, g, unknown or other
  misc_feature (684)..(684): n is a, c, g, or t
tcagatagagtactcacgaccggtgctcgatttagtacacacacttagggagttgggggaagacaatgggtttgattcagattacatgggtgacttttctgttgtatttccaatctcagatcgccccggagaattgtgttgacgcagtctccagacaccctgttctttgtctcgaaggggaaagcgacctaccttctcctgcgtacggtccaggtcaaggtacgttaccttaacccaacgtacttacgttacgcctaggtaccacttacgaaacgtaacctgggcccaacgggcctcccgtaggtccttaccgtccattccgtacggtcacctactaccgacggcggaccggtcccacgtcggacctaccgcccgaagtaccgtaggttacgagggtcgacgtaggtcggtacgtcggaactacgtacttaccactctaccgtactcgacgcgacgtacgtaccgaccgtgtaagttacgtttcgagttaacgtggtaactttcgtagtcgtatacgtagtagtcggtagtccgtacctacgaccgtaccgtacccgggttcggaacccggtaaccggacgaaccgtacgggtacgtaaacgggttaaccttaaccgggtaacctggtacggtcgacgtaccacttcggtaccttcgttctcgtaccttccgtcccagtcctanagttaactctagtac

SEQ ID NO: 96925 - DNA, 808 bp, Homo sapiens
  misc_feature: GYAE6OF01CKO0Z.29.59.F04.1.454.CMB.1.raw
tcagatagagtactcacgaccggtgctcgatttagtacacacacttagggagttgggggcaggagtcagacccagtcaggacacagcatggacatgacgggtcccccgctcagtctccgtggggctcctgctgctctggctcccgaggtgaccaaattgtcgacatccagatcgacccagtcctaccttcacgtgtgtctgctatcgtggtagtcgacaggactaccaaccactaccgtacgtaccggccgggacagtacgagtagtattaacggagtcggtggttcgaccgtagtacgtacgacgacgaaacgaaaccggtaagggaacccctaccgtaagcctaccgtagtacgtacgtaacggtaacggtcgttaacgttaaggttaacgaaaggtacggtaccgtaccgtaacgttacggtagggtccggacggtacgtagggttacgacgttcgggtaacggaacttaacgtaacgttcccgtaaccttaccgtaacctaaccgtaacgtaccggtaacctaccggtaccgtcccgttaacggacccgtaaccggttacccggtatttaaccggttaacgtttaaccgttttacgtaaaccgttttaaacgtttaacgttaaaccgtaccgtaaaccgttaaagttaacggttttaaccttaaacgggttttacccggtttacgggtaaccgggtaaccgggttacccgggaaaaccgtaaccgggtaacggtaacgggtccgtaaagtacgtaaacggaacgtaagttccgggaacgtaccgacgacctaaccgtgttaccg

SEQ ID NO: 96926 - DNA, 830 bp, Homo sapiens
  misc_feature: GYAE6OF01BC73T.29.59.F04.1.454.CMB.1.raw
  modified_base (208)..(208): a, c, t, g, unknown or other
  misc_feature (208)..(208): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgaccaaatgtgacatccagatcgacccagtcctcccttccactgtgtctgctatcgtggtaggtnacagagtccacatctacgttcggccggcagtcagtagttagttagtaggtcgttgggttcggccgttaggtactcgaggaccgaaacggaaaaccggaacggggaaaccgtccccgtaaggtcctaccgtaggacttacgtaggtaacggtcgtttacgttaaggtttaaggaaaggtcgtaacggtacctaaggtacggtaacgggttcgggaccggtagtagggttacggtacgtcgggtaaggggtaactaaggttaacctttacccgtaaccgttacccgtaacccgtaaccgtacgttaccgaacggtacccgtacggtccccgtagggaccgtaccggtccgttaaggtacgtttaacggtttacttttaccggtaaactttaaccgttttacgttaaccgtaccgtaaaccgttaaacggtaaacgttttaaaccgtttaacgggtttttaacccggtttacccgggttaccggggttaaaccgggtttacccggggaaacccggtaaaccggggtaaccggttaaacgggtacggtaaacccttaacggtaaaccggtaaaccggtaggttcgggtacggtacccgtaacgtacccgtaacccgttgttacccg

SEQ ID NO: 96927 - DNA, 696 bp, Homo sapiens
  misc_feature: GYAE6OF01A8810.29.59.F04.1.454.CMB.1.raw
  modified_base (143)..(143): a, c, t, g, unknown or other
  misc_feature (143)..(143): n is a, c, g, or t
  modified_base (161)..(161): a, c, t, g, unknown or other
  misc_feature (161)..(161): n is a, c, g, or t
  modified_base (212)..(212): a, c, t, g, unknown or other
  misc_feature (212)..(212): n is a, c, g, or t
  modified_base (349)..(349): a, c, t, g, unknown or other
  misc_feature (349)..(349): n is a, c, g, or t
  modified_base (474)..(474): a, c, t, g, unknown or other
  misc_feature (474)..(474): n is a, c, g, or t
  modified_base (573)..(573): a, c, t, g, unknown or other
  misc_feature (573)..(573): n is a, c, g, or t
  modified_base (581)..(581): a, c, t, g, unknown or other
  misc_feature (581)..(581): n is a, c, g, or t
  modified_base (652)..(652): a, c, t, g, unknown or other
  misc_feature (652)..(652): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctccaggtnaccaatgtgacatccganatcgaaccctgtcctccttccactgtgtctagctagtcgtaggtacggtanactaggtaccgtacctaacctacgtcctacgttcgggcccggacctaggtccaaggtagttattacggtagtcgttagggtcggtcgttaggtactcgacggacaaacggtaaaccggagggaaaccctccgtaacncgtccgtagtaacttacgtaaggtacggtcgttaacggttaagttaggaaaggttacggtaccggtaccagtacggtaacggggttcgaccggtagacggttacggtacgtacgggacggtaaanacgttagtacctaacgtcctacggtactacgtacacgtacgtacgcgtccgaacgtgaccgttaggttactagtttctacgttaacttaactcgtaacncccgtaanaacgtttataacgtttaacgttcgttacgggtaccgtcggtaacgaaccggtagaacccggtgtaccgtanaacgaacgtaccggagtcggtacgacgtacacctcgtagtcccg

SEQ ID NO: 96928 - DNA, 688 bp, Homo sapiens
  misc_feature: GYAE6OF01BQX2C.29.59.F04.1.454.CMB.1.raw
  modified_base (295)..(295): a, c, t, g, unknown or other
  misc_feature (295)..(295): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatctgtaggtgacagagtcaccatcacgttcggccggcagtcagagtattagtacgcgttggttcggccgttggtatcgacgacgaacgaaaccgagggaaacnccccgtaagcctccgtagactacgtaagtacggtcgttactttaaggtttaagaaaggtcggtacggtcctagtacgaacgggttcggcggtacgtaggtggacgtcggagggactagtaacttactaccgtctaccacctacgtccgaacgcgtaccggtcctacggccgtacgccgttagtacttgtttatttacgtaccttaactttacgttacgaccgtacctaaagtagtttaaacttaacggtttaccgttttaccgggacggttaaccggtaacccgggtaaccgggtaaaccgggtaaaccgggtacgggtaccgtaaacgtaactaacccggtaaacggtaccgttagggtccggtacctacggacctaccgttggttaacccg

SEQ ID NO: 96929 - DNA, 870 bp, Homo sapiens
  misc_feature: GYAE6OF01DNBIW.29.59.F04.1.454.CMB.1.raw
  modified_base (162)..(162): a, c, t, g, unknown or other
  misc_feature (162)..(162): n is a, c, g, or t
  modified_base (823)..(823): a, c, t, g, unknown or other
  misc_feature (823)..(823): n is a, c, g, or t
  modified_base (862)..(862): a, c, t, g, unknown or other
  misc_feature (862)..(862): n is a, c, g, or t
tcagatagagtactcacgaccggtgctcgatttagtacacacacttagggattgggggcaggagtcagacccagtcaggacacagcatggacatgagggtccccgctcagcctcctggggctcctgctgctctcggcctcccgaggtcgaccaaattggtanactagtactagactcgacccacgttcctcccttaccaccttgtcgtctgctacgttcgtggtacggtgacgagactaccacactcctacgttccggccggacacgtacgaggtattagttacggtacggtcggttacgggttcgtaccggttaggtactacgacgacgaaaaccggaacccggaagggaaacccctccccgtaagtccctaacgttacgtaacgttacgtaaacggtacggtaccgtttagtttaaagggttaacgaacggtcggtaacccgccgtaaggttaaccgggtacggggttcccggacggtacggttaaggtcgggttacgtaccggggtaacgggtaacctaacgttaaccgttcccgtaaccctttccgaacccgtaacgtaccgttaccgaccgttaaccggtacccgtaccgtaacgtaccgtaccggttacgttacgttacgtttagtttaccggtttaacctaacctttaaacgtttccgttacctaaaccggtacctaaacggttttaagtttaccgtttaacggtttttcggttacccgggtaaccggggttaccggtttaacccgggacgggtaaacgggtaaccggtaaacgggttaccgttaacaaacccggtaacggaaacccggtttaggngggttacccccgttaggacccttaaccgcccggtttttnttacccgg

SEQ ID NO: 96930 - DNA, 829 bp, Homo sapiens
  misc_feature: GYAE6OF01C95D6.29.59.F04.1.454.CMB.1.raw
tcagatagagtactcacgaccggtgctcgatttagtacacacacttagggattgggggcaggagtcagacccagtcaggacacagcatggacatgagggtccccgctcagctccgtggggctcctgctgctctcggctcccgaggtcgaccaaagttggtcgactactccgagaactcgaccctagtccttcccgttacctacgttggtcgttccgtagcctagttcggtaggtaacggtcgaaccgtaaggtacgtaccaacctacgtacctaccggttcggaccgggtccacgtacgtaggtacgtttaagttacggtaggtccgggttagggtttaccggtccgttaaggtactaccggaacggtaaccggaaaaccgaaaccgggtaggaaaacccggtacctaagggccttacgtacgtacttacgtaacggtacggtacgtttagttaaaggttaacgaacgggtacgtccggaaaccttacgtacggggttaacgggttccggacggaggtagttcgggacttacgggagtaaccgtacgtaaactttccgaccgttctactaaccgtcggtaccaacgtactacccggtcctacgtaccgacgtacgttagtaacgttagttacgttacgttaacttaacgtttactaaccgtacttaaccgaagtttaacgttacgtttaacgttaccggttttacggtacccgggttaccgggtaccggaaacgggtaccgggtaacggtaaccggtacggtaaacgtaaccgtaaccgtaaacggttcggacggttaccgtcgttacgtaaccgccgtttagttaccg

SEQ ID NO: 96931 - DNA, 899 bp, Homo sapiens
  misc_feature: GYAE6OF01ENDBC.29.59.F04.1.454.CMB.1.raw
  modified_base (193)..(193): a, c, t, g, unknown or other
  misc_feature (193)..(193): n is a, c, g, or t
  modified_base (228)..(228): a, c, t, g, unknown or other
  misc_feature (228)..(228): n is a, c, g, or t
tcagatagagtactcacgaccggtgctcgatttagtacacacacttagggagttgggggcaggagtcagacccagtcaggacacagcagtggacatgacgggtcccccgctcagcctccgtgggctcctgctgctctgcctccgaggtcaccaatgtacacactccagactacgaccctgtccttccttaccncgttgtcgtctcgactacgttcgtaggtacggtanaaccgagtacgtaccaccttacgtccgtaccgtccggcccggacgtacgttaggaaggttactttaaggtcggttacggttccggtttacgggttccggtccgttaacggttacgaccgaacgggtaccgaaaccggtaaaaccccgggaacgggtaaccccttacccgtacctcgttacccggtaagttacggttacctaaacggggttaccgttcggtttaacggttaaaaggtttaaacggaaggttaccccggtaccgttacggtaaccgtttaacggggtacggtacggggtcccggtaagtagggttaccggtacggttacgggtaaccggttaactaacggttaacctttacccgtaccttacctaacccgtacgtaaccgtacctaccgacccggtattacccggtactaccgggtacccgtagttacgttagtttaccgttttaaccgttactaacgttttaacctaacgttttacccgaacttaaacctaagtttaaccgggttttaacttacgggttttaccggttaccggtaccggtaaccgggttaccggaacgggtaaacccgggtaaggtacgggttaaccaaacgggtactaaaacccggttaaggtacccggtagtacccgttaccggttaacacccgtagtttacgttaccgg

SEQ ID NO: 96932 - DNA, 971 bp, Homo sapiens
  misc_feature: GYAE6OF01B9N1D.29.59.F04.1.454.CMB.1.raw
  modified_base (646)..(646): a, c, t, g, unknown or other
  misc_feature (646)..(646): n is a, c, g, or t
tcagatagagtactcacgaccggtgctcgatttagtacacacacttagggagttgggggcaggagtcagacccagtcaggacacagcatcggacagtgacgggtccccgctcagcctccgtggggcctccgtggctgctcgtcggcctaccgaggtcgaaccaaagttcggtacgaacctacgttaccgagtacgtaccgaacccgtacgttcccttcccgttaccacgttgttcgccgtcggtactacgttcgtaggttacgcgaaccgtagacgtacctaccgtatacctaccggttacgggcccgaggtacgtagtaggtaacgttagttaacggtccgtgggttacggtacggtcgttagttacgacgacgaccggaaaaccgaaccgggaacggtaaacccgaccgtaccgccgttaacgtaaccgtaaggtaaccgttacggtagtttaacgttaagttaaacggtacggtaccggtaccgtaacctaacggtcgggttaaacgggtccgggaaacggtaggtagggtaccgtaacgtcggggtaaaacgtacgtaacttacgtaaaccgtcccttaaagtacccgtaaccgacggtccaaacggcccgggttaactacccggttaccgagggtaacccnccggggtttaattaacgggttttccgttaaaccttttaccggaaacctttttaaacggtttaccctaaacggtttaaaccccggttaaaccgaaaacggttttaaaccgtttttacggtttaaccgggttttaaccggtttccccgggggttaaaaccttaccgggggttaaaacccggggtaaaccggtaaacccgggtttaaacggggaaacgtttaacccgggtaaaaggtaacccccttaaagggggaaaccctttggggtaaaccccggtacgttaaccccggggtaaactttacccgtagttaaaccccgttttccggg

SEQ ID NO: 96933 - DNA, 821 bp, Homo sapiens
  misc_feature: GYAE6OF01CAS09.29.59.F04.1.454.CMB.1.raw
tcagatagagtactcacgaccggtgctcgatttagtacacacacttagggattgggggcaggagtcagacccagtcaggacacagcatggacatgagggtccccgctcagctctggggctcctgctgctcgtggctcccaggtcgccaaatgtgacatccagatcgacccagtcctccttcactgtgtctgctactcgtggtaggtgacgagtagtacacctataccgtacgttcggcccggcgtaagtcgagtagttagttaggtacgtcgtgggttcggtcctggtactcgacggactaaacggaaaccggaaggggaaaccgtaccccgtaacggtccctaccgttagtaaccgttacgttaaaggtaacggggtactttaaccggtttaaggtttaaacgggtaaaacggttcgggaaccggttacccctaaggttaccggtaaacggggttcggacggtaaccgtaggtcggtacggttacggtaacggggaaactaggttaaacttcccgaaccttcctaacccgtacgtaactaccgagtaccgtaaccgtccgtacgtacgaccggtaacgttcgtacgttacgtttaacgttttcggaaacctttaacgtttaaccgttaaccgtaccgtaacctaaacggttaatttaaaccgttaaagttttccgggttttaaccgggacggttaaccggtaccgggaaacggtaaaccggggtaacgttacggggtaaacgtaaccgttaacgaaaaccggttaaacggttaccgtaggggttaacgacccgtaagtaacccgtacttaccggttaccg

SEQ ID NO: 96934 - DNA, 734 bp, Homo sapiens
  misc_feature: GYAE6OF01E0BQZ.29.59.F04.1.454.CMB.1.raw
  modified_base (170)..(170): a, c, t, g, unknown or other
  misc_feature (170)..(170): n is a, c, g, or t
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
tcagatagagtactcacgaccggtgctcgatttagtacacacacttagggagttgggggcaggagtcagacccagtcaggacacagcatggacatgagggtccccgctcagctctggggctcctgctgctctggctcccaggtgccaaatgtgacatccagatcgacccngtcctccttcactgtgtctgcatcgtgacggtgacgngacgtcaccatcgacttcggccggcngtcagtagtatgtagcgtagggttcgaccgtggtactcgacgtacacggaaaacccgaacggaaccgtacccgtacgactcgtacgtacgtacgtaacgtaacggtacgttacgttaacggttaaggtaacggtacggtacggtaccgtacgtacgtacgggtcgggcggtacgtacggtaggtacgtacggtacggtaacgtaacgtaacgttaccgtaccttaccgtaccctacctacgtacgacgtacgtacgtaccgtacgtaccgtacgtacgtacgacgttacgttacgtttaccgtacttaacgtttaacgttaccgttaccgtaaccgtaacgtaacgttaacgtttaacgttttacggtttaccggttaaccgggttaccggttaccgggtaccggtaaaccgggtaaccggtaacgggtaacggtaacgtaaccggtaaaccgtaaaccggtaacggtacggttacggtaccgtaccgtaccgtacgtacg

SEQ ID NO: 96935 - DNA, 829 bp, Homo sapiens
  misc_feature: GYAE6OF01AU447.29.59.F04.1.454.CMB.1.raw
  modified_base (105)..(105): a, c, t, g, unknown or other
  misc_feature (105)..(105): n is a, c, g, or t
  modified_base (222)..(222): a, c, t, g, unknown or other
  misc_feature (222)..(222): n is a, c, g, or t
tcagatagagtactcacgaccggtgctcgatttagtacacacacttagggattgggggcaggagtcagacccagtcaggacacagcatggacatgagggtccccntcagctcctggggctcctgctgctctggcctcccaggtcgacccaaagtcgtacgacatccgaagtacgtacgaaccccgtagttcccttaccctttaccgacttcggtcgttcctnaccagttccgtaggtaggtcgaacgtacggtactaccacctacgtcctaccggttccgggacccgggtaccaggttccgaaggtagttattacggtacgtcggttcgggtacggtccgtgtacacgacgtaacgtaaaccggaaaaccgaacgggaaaccccgtaccgtaacgtaccctacgtacgtacttaccgttaaaggacggttaaccgtttaggttaaacgtttaaacggtaaggtccggtaaaccgggtccttaaacggtaccggggtaaacgggttccgggaccggtaacggtagggtccggtactcggggtaacggaacgttaacgttacctaccggaaccttcgaacctaccgtaacgttccggaactaccgtacgtcccgtacgtaaccgccggtaacttaacggtacgttagtttacgttcctaacttaaccgttacgttacaaccgtaacgtaagttaaagttaccgttaactttacgggttacccgtcgggttacccgttaacgggtaacccggtaacggtaaccgggaaaggttccgaactaaggtaacccgtaacgtagggttaccgcgttacgaccgtcctagtcttaccg

SEQ ID NO: 96936 - DNA, 826 bp, Homo sapiens
  misc_feature: GYAE6OF01BUS53.29.59.F04.1.454.CMB.1.raw
  modified_base (109)..(109): a, c, t, g, unknown or other
  misc_feature (109)..(109): n is a, c, g, or t
  modified_base (143)..(143): a, c, t, g, unknown or other
  misc_feature (143)..(143): n is a, c, g, or t
  modified_base (158)..(158): a, c, t, g, unknown or other
  misc_feature (158)..(158): n is a, c, g, or t
  modified_base (164)..(164): a, c, t, g, unknown or other
  misc_feature (164)..(164): n is a, c, g, or t
tcagatagagtactcacgaccggtgctcgatttagtacacacacttagggagttgggggcaggagtccagacccagtcaggacacagcatggacatgagggtcccccgntcagcgtcctggggctcctgctgctctggctccnggtgccaatgtgacntccagntcgaccctgtctccgttcactgtcgtctgctagtccgtaggtacggtgacgaggtactaccaaccacgtctacgttccgggaccggggacctaaggtccaggtaacgttagttacggtaggcgttacgggttcggtaccttgggtaactcgacgtccgaacggaaaacccgaggggtaaacctaccccgtaacggtccgtaccgtacggtactaaccttaacggtaacgggtccgtttacggttaaggttttaaggaaacggttacggtaacggtacccgtaacggtcgtaacgggtccggggtacggacgtaacggtacgggtacgttccggtaagggacctaagtacgttaccgtacttacctaccgtacctaactacgtaacgaccgtacgaccgtacggtcgaacggtacccgttaggtacgttacggtttatttaccgaacttttaacttacgttataacccgtacctaaaccgttagggttaacctttaacggttttaccggtttccggtaacggttacccggtttaccgacccgggttaaaccggaccggtttaaacgggtaccgggaacctttaaacggaccgtaaaaccggtacgttacggggtaacccgtccccggttaaacggtcccaaacccccgttagtttcccccggg

SEQ ID NO: 96937 - DNA, 539 bp, Homo sapiens
  misc_feature: GYAE6OF01A36SJ.29.59.F04.1.454.CMB.1.raw
  modified_base (288)..(288): a, c, t, g, unknown or other
  misc_feature (288)..(288): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
  modified_base (534)..(534): a, c, t, g, unknown or other
  misc_feature (534)..(534): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgaccctagtcctccttcactgtgtctgcatctgtaggtgacagacgtcaaccatccacttcgccggtcagtcagtagtattagtagcgttggtcggcctggtatcgagcagaaaccagggaaacncccctaagcctccgtgatctagtacgcgtactagttagaagtgacgtcatcgagtcggcgnaggtgatgngganagatcactcgcaacntcacgcgacnccgtgctacgcctagtatagttacgtttgaacttaacgttactactcgaaccctaagtagttaactagtttacgttcggacggtaccgtcggtacgaagtaccgaggtcgactagtaaccaaacgacttcggacgtctagactccgnttccg

SEQ ID NO: 96938 - DNA, 791 bp, Homo sapiens
  misc_feature: GYAE6OF01EQXC7.29.59.F04.1.454.CMB.1.raw
  modified_base (157)..(157): a, c, t, g, unknown or other
  misc_feature (157)..(157): n is a, c, g, or t
  modified_base (190)..(190): a, c, t, g, unknown or other
  misc_feature (190)..(190): n is a, c, g, or t
  modified_base (209)..(209): a, c, t, g, unknown or other
  misc_feature (209)..(209): n is a, c, g, or t
  modified_base (523)..(523): a, c, t, g, unknown or other
  misc_feature (523)..(523): n is a, c, g, or t
  modified_base (729)..(729): a, c, t, g, unknown or other
  misc_feature (729)..(729): n is a, c, g, or t
tcagatagagtactcacgaccggtgctcgatttagtacacacacttagggattgggggcaggagtcagacccagtcaggacacagcatggacatgagggtcccccgctcagcctccgtggggcctcctgctgctctggctccgaggtgacaaatgtnacatccagatcgacccagtccttcctcactgtntctgacattcgtagtaggnacagtactcacatctactggccggacagtcagtagtatagtagtgtaggttcgccgttaggtactacgacgacgaaacggtaaaaccggaacggggaaaacctaaccccggtaacgttaccttaccgtaaggtacttaacgtaaacggtaacgggttaccgttaacggtttaaggtttaaaggaaacggttacggaacgggtaccctaaacgttaaccggtaacggggtttacgggacggtacgtaagggtaaggtacgtacccggtaggggaactaaaggttaacttaccaccgttacctaccgaacccttanaccgaacgtaccgtaacgcgtacggaccgtaaccgtacgtacgtaagtttacgtttacgttactaaccgttaacttaacttaaccggtacaaaccgtaaacttacgggttaaacttttaacgtttaacggttttacccgggaacgggtttaacccgggtaccgggtaaaccgaaaacggggttaaccgtaaacgggttacgtaaanaaacgttaaaccggaaaaccgtagttaccggtacgtaaccgtacgacctaacgtccgttacg

SEQ ID NO: 96939 - DNA, 549 bp, Homo sapiens
  misc_feature: GYAE6OF02HBBAX.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcggcggcagtggatcgtgggacagaattcactctcaccatcagcagcctgcagcctgatgtattttgactaacttattactgaccaactaagttaattaattagttttcccggttaggtaccgtttacgggaccgtaacggggaacccgtaagggtacggaactataaccgaaacggaacgttacggtacggtcgtacggacctaccattccg

SEQ ID NO: 96940 - DNA, 497 bp, Homo sapiens
  misc_feature: GYAE6OF02GGGKN.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaagtgaggtcccatcaaggttcggcgcagtggatctgggacagaattcactctcaccatcagcagcctgcagcctgatgattttgctaacttattactgaccaactagtaataattagttttccgtggtacgttcggccgagggaccaaggtggacatacaacgactgtggctgctaccatc

SEQ ID NO: 96941 - DNA, 530 bp, Homo sapiens
  misc_feature: GYAE6OF02IXEPP.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaccagggaaagcccctaagctcctgatctataaggcgtctagtttagaagtgaggtcccatcaaggttcggcgcagtggatctgggacagaattcactctcaccatcagcagcctgcagcctgatgtattttgctaacttattactgtaccaactagttaataacttagtttttcccgtggtaaccgtttcggaccgtaagggaccctaagggtcggaacataccgaaacgtaacttcggtacggcctggaccaccgattccg

SEQ ID NO: 96942 - DNA, 509 bp, Homo sapiens
  misc_feature: GYAE6OF02GSDEL.29.59.F04.1.454.CMB.1.raw
tcagatagagtactcacgaccggtgctcgatttagtacacacacttagggattggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtcccatcaaggttcggcggcagtggatctgggacagaattcactctcaccatcagcagcctgcagcctgatgattttgactaactttattactgacccaactagtaattaattagttttccgtggtaacgtttcggaccgtaagggaccaagggtggaacagtacaaacgactgtggctgcacatc

SEQ ID NO: 96943 - DNA, 499 bp, Homo sapiens
  misc_feature: GYAE6OF02G9NP1.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcggcggcagtggatctgggacaggaattcactctcaccatcagcagcctgcagcctgatgattttgactaacttattactgaccaactagtaataattagttttccgtggacgttcggaccagggaccaggtggacatacaaacgactggtggctgcaccatc

SEQ ID NO: 96944 - DNA, 544 bp, Homo sapiens
  misc_feature: GYAE6OF02JI98F.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttgcctggtatcagcagaaaccgagggaaagcccctaagctcctgatctataaggcgtctagtttagaagtgagtccatcgaaggttcgcggcagtgatcgtgggacagatcactctacacatcagcagcctgcacgcctagattgtatttcgactaactttattactcgacctaacgtagttaacttaacgtttacgttttccgaggtaccgtttccgggaccgaacgggtacctaagggtcggaactagtaaccgaaacgtacgttggtacggaccttgacctaccgtattccg

SEQ ID NO: 96945 - DNA, 505 bp, Homo sapiens
  misc_feature: GYAE6OF02F3ZLH.29.59.F04.1.454.CMB.1.raw
  modified_base (425)..(425): a, c, t, g, unknown or other
  misc_feature (425)..(425): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtcccatcaaggttcggcggcagtggatcgtgggacagaattcactctcaccatcagcagcctgcagcctgatgattttgctaactttattactgacccaanagttaataattagttttccgtggtacgttcggccaagggaccaagggtggaacatacaaacgagtgtggctgcaccatcg

SEQ ID NO: 96946 - DNA, 500 bp, Homo sapiens
  misc_feature: GYAE6OF02HYJSO.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcgcgcagtggatctgggacagaattcactctcaccatcagcagcctgcagcctgatgattttcgactaacttattactgaccaacagtaataattagttttccgtaggtacgttcggcctaagggaccaaggtggactatacaaacgactggtgctgcacatcg

SEQ ID NO: 96947 - DNA, 503 bp, Homo sapiens
  misc_feature: GYAE6OF02GY5FR.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggtttgcctggtatcagcagaaaccagggaaagcccctaagctcctgatctataaggcgtctagtttagaaagtgaggtcccatcaaggttcggcggcagtggatcgtgggacagaattcactctcaccatcagcagcctgcagcctgatgtattttgctaacttattactgaccaactagtaataattagttttccgtggtacgttcggaccgtagggaccaaggtggacatacaaacgactgtggctgcaccatc

SEQ ID NO: 96948 - DNA, 513 bp, Homo sapiens
  misc_feature: GYAE6OF02IFQD6.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaagcccctaagctcctgatctataaggcgtctagtttagaaagtgaggtcccatcaaggttcggcggcagtggatctgggacagaattcactctcaccatcagcagcctgcagcctgatgattttgctaacttattactgaccaacagtattaattagttttccgtggtacgttcggccgaagggtacccaagggtcggaacactacaaacgaactcggtaggcctgctaccattccg

SEQ ID NO: 96949 - DNA, 564 bp, Homo sapiens
  misc_feature: GYAE6OF02J1WMW.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaacgcccctaagctcctgatctataaggcgtactagttagaagtgaggtcccatcgaaggttcggcggcagtggatcgtgggacagtaattcactctcaccatcagcagcctgcagcctgatgtattttgacttaacttacttactcgtacccaacgtagtaattaacgttacggttttaccgtacggtaacgttcgggacccgtaacggggtaccgtaagggtacggaacctaagttaaccgaaaacggtacgttaggtacgggtactacgacctacccgtattccg

SEQ ID NO: 96950 - DNA, 577 bp, Homo sapiens
  misc_feature: GYAE6OF02G80D8.29.59.F04.1.454.CMB.1.raw
tcagatagagtactcacgaccggtgctcgatttagtacacacacttagggattgggggcaggagtcagactcagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtcccatcaaggttcggcggcagtggatctgggacagaattcactctcaccatcagcagcctgcagcctgattgtattttgactaacttattactcgtaccaaactagttaattaaagtttacggttttacccggtagggttaccgtttccgggacccgtaaaggggtacccgtaaaggggtacggtaaccgtaacgttaccgaaaaccggtaacgttacgggttacggtccgttacggacctaacccgtaacg

SEQ ID NO: 96951 - DNA, 585 bp, Homo sapiens
  misc_feature: GYAE6OF02JJJY4.29.59.F04.1.454.CMB.1.raw
  modified_base (201)..(201): a, c, t, g, unknown or other
  misc_feature (201)..(201): n is a, c, g, or t
  modified_base (368)..(368): a, c, t, g, unknown or other
  misc_feature (368)..(368): n is a, c, g, or t
  modified_base (418)..(418): a, c, t, g, unknown or other
  misc_feature (418)..(418): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtnacagagtcaccatcacttgccggccagtcagagtattagtagctggttggcctggtatcagcagaaaccagggaacgcccctaagctacctgatctataaggctctagttagaagtgagtccatcaggttcggcgcagtgatcgtaggacagtattcactctcaccntcagcagcctgacacgcctagattcgtattttcgactaacgttattacgngacctaaacgtagtttaacttaaacgtttacggtttttacccggtaggttaacccgtttaccggggaccgtaacggggttaaccctaaggggttcgggaaactacgttaaaccgaaacggttaaaccgtcggtttacggaccgttacgacctaaccgtcgtttaccg

SEQ ID NO: 96952 - DNA, 517 bp, Homo sapiens
  misc_feature: GYAE6OF02GCFBF.29.59.F04.1.454.CMB.1.raw
  modified_base (514)..(514): a, c, t, g, unknown or other
  misc_feature (514)..(514): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggcagtcagagtattagtagctggttggcctggtatcagcagaaaccagggaaagcccctaagctcctgatctataaggcgtctagtttagaaagtgaggtcccatcaaggtttcggcggcaggtggatctggggacagaattcaactctcaccatcagcagcctgcagcctgatgattttgactaactttattactgaccaaacagtaattaattagttttccggtaggtaccgttcggacctaagggaccaagggtggaactatacgaaacgtacgtgtggctgcaccntcg

SEQ ID NO: 96953 - DNA, 496 bp, Homo sapiens
  misc_feature: GYAE6OF02F2R0T.29.59.F04.1.454.CMB.1.raw
  modified_base (493)..(493): a, c, t, g, unknown or other
  misc_feature (493)..(493): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcgcggcagtggatctgggacagaattcactctcaccatcagcagcctgcagcctgatgattttgctaacttattactgcaacagttaataattagtttccgtggtacgttcggtacacgggacaaggtcggacatacaacgaactgtggactgcacntac

SEQ ID NO: 96954 - DNA, 508 bp, Homo sapiens
  misc_feature: GYAE6OF02HM4NX.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcggcgcagtggatcgtgggacagaattcactctcaccatcagcagcctgcagcctgatgattttgctaactttattactcgaccaacagtattaattagttttccgtggtacgttcggaccgaacgggacctaagggtggacagtacaaacgacgtggtgctgacaccatcg

SEQ ID NO: 96955 - DNA, 587 bp, Homo sapiens
  misc_feature: GYAE6OF02JJRV5.29.59.F04.1.454.CMB.1.raw
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggcagtcagagtattagtagctggttggcctggtatcagcagaaaccagggaaacgcccctaagctcctgatctataaggcgttctagtttagaaagtgacggtcccatcgaaggttcggcggcagtggatcgtgggacagattcactcncaccatcagcagccngcagcctgatgtatttgactaacttattactgaccctaaacgtagttaattaagttacgtttttacccggtaggttaaccgtttaccgggaccgtaacggggtaacccgaagggttacggaacctaagttaacccgaaaaccggttaaaccgttcgggttaccgggtaccttacggaaccctaacccgtagtttacccg

SEQ ID NO: 96956 - DNA, 557 bp, Homo sapiens
  misc_feature: GYAE6OF02GHH5I.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaagtgaggtcccatcaaggttcggcggcagtggatcgtgggacagaattcactctcaccatcagcagcctgcagcctgatgtattttgactaactttacttactgtaccaaactagttaattaatttacgtttttccgtaggtaccgtttccggacccgtaaggggaccctaaggggttcggaacctaagtaccgaaaacggtaacgttaggtacgggccttaggacctaccctagttaccg

SEQ ID NO: 96957 - DNA, 430 bp, Homo sapiens
  misc_feature: GYAE6OF02GB3WY.29.59.F04.1.454.CMB.1.raw
  modified_base (414)..(414): a, c, t, g, unknown or other
  misc_feature (414)..(414): n is a, c, g, or t
  modified_base (419)..(430): a, c, t, g, unknown or other
  misc_feature (419)..(430): n is a, c, g, or t
tcagatagagtactcacgaccggtgctcgatttagtacacacacttagggagttggggactgtccctgggagttgctggtaccaggatacagaattcttcacaatgttggagctacttccagggacagtccccaaacttctcatttatgacaatagtcagtcgaccctcagggattccctcgaccgattctctgcctccaagtctggctcgtcagccaccctgggcatcaccgggctccagactggggacaggccgattattatgtggaacatgggatagcagcctgagtgcttacgtcttcggaactgggaccaaggtcaccgtcctaggtcagcccaaggccaaccccatcgtcacttctcgttccccgccctcctcacgtacctctatctgacgcgggctggcaaggcganatagnnnnnnnnnnnn

SEQ ID NO: 96958 - DNA, 743 bp, Homo sapiens
  misc_feature: GYAE6OF02JQ0A3.29.59.F04.1.454.CMB.1.raw
  modified_base (218)..(218): a, c, t, g, unknown or other
  misc_feature (218)..(218): n is a, c, g, or t
tcagatagagtactcacgaccggtgctcgatttagtacacacacttagggattgggggcaggagtcagacccagtcaggacacagcagtggacatggacgggtccccgctcagcctccgtgggcctcctgctgctcgtggcctcccgaggtcgaccaaatgtgacactccagatcgaccctagtcctccttccactgtgtctgctatcgtggtaggtnacaggtagtccacctatccacgttcggcccgggaccagtcaggtagttattagtagtcgttggttcggccgttggtactcagacaaacggaaaccgaagggaaaccgccctaagcctacgtgtactactaagtaacggtccgtacgttaagttaaggaaagttggaccggttaccccaagttaccggtaaacggggtttccgggacggtaccggtaggttacgggtacttaccgggtagggtaacgtaacggtaactttacccgtaaccttacctaaccaacctacttacgaaccgtacgaccgtaccgtacgcaacgtcccgtggtaacttagttacttttacgaacctttaacctttagttaacctaccgtacctaaacgtaagtttaacttaaggttttaccgttttccggtacggttaccggttaccggaccgtaacgggtaccgtaagggtcgaacgtaacgtaacccgtaaacgtacgtacgggttacgtaccgtacggtaaccctacctacgttaccg

SEQ ID NO: 96959 - DNA, 574 bp, Homo sapiens
  misc_feature: GYAE6OF02F0VJT.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccgagggaaacgcccctaagctcctgatctataaggcgtctagtttagaagtgaggtcccatcgaagggttcggcggcaggtggatcgtgggacagtaattcactctcacatcagcagcctgcacgcctgatgtattttcgacttaactttattactcgacctaactagttaattaagtttacggtttttaccggtagggttaccgtttacgggacccgtaacggggtaccgtaaagggttcggaacctaagtaaccgaaaacggtaacgttacggtacggtaccgtacgaccgtacctattccg

SEQ ID NO: 96960 - DNA, 501 bp, Homo sapiens
  misc_feature: GYAE6OF02FLCCY.29.59.F04.1.454.CMB.1.raw
  modified_base (423)..(423): a, c, t, g, unknown or other
  misc_feature (423)..(423): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcggcggcagtggatctgggacagaattcactctcaccatcagcagcctgcagcctgatgtattttcgctaacttattactgaccaanagttattaattagttttcgtggtacgttcggaccgagggaccaagggtggacatacaagactgtcggtctgcactatc

SEQ ID NO: 96961 - DNA, 560 bp, Homo sapiens
  misc_feature: GYAE6OF02HKSUV.29.59.F04.1.454.CMB.1.raw
  modified_base (309)..(309): a, c, t, g, unknown or other
  misc_feature (309)..(309): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatctgtaggtgacagagtcaccatcacttgccgggccagtcagatattagtagctggttggctggtatcagcagaaaccgagggaaacgacccctaagcctcctgatctataaggctntaagttagaaagtgaggtccatcgaaggttcggcggcagtggatcgtggacagaattcactctcaccatcagcagcctgcagcctagattgtattttgactaacttattactgacctaactagtaattaacgttagttttccggtacggttacgttaccggaccgtaacgggtaccgaagggtggaaccgtaacgtaacgaaacggtaaccgttacggtacgggtccgtacggacctaaccgtagttaccg

SEQ ID NO: 96962 - DNA, 561 bp, Homo sapiens
  misc_feature: GYAE6OF02HQ9KX.29.59.F04.1.454.CMB.1.raw
  modified_base (376)..(376): a, c, t, g, unknown or other
  misc_feature (376)..(376): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaacgccccgtaagctcctagatctataaggtcgtactagtttagaaagtgaggtccatcaaggttcggcggcaggtggagtcgtggacagaattcactcncaccatcagcagcctgcacgcctagacttgactttttgactaactttacttactgacctaacgagttaactaacgttaggttttcccgaggtaccgtttacgggaccgtaacggggtacctaagggtcggaacctagtaaccgtaaacggacgttaggacggtacttacgactacccgattaccg

SEQ ID NO: 96963 - DNA, 523 bp, Homo sapiens
  misc_feature: GYAE6OF02G846W.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataggcgtctagttagaagtgaggtccatcaaggttcggcggcagtggatcgtggacagaattcactctcacatcagcacgcctgccagcctagattgtattttgactaactttattactcgaccaactattataagttacgttttcggtcggtacgttcggaccgtaagggaccaagggtcgaactacgtacaaacggtactcggtggcctggcctacgattccg

SEQ ID NO: 96964 - DNA, 517 bp, Homo sapiens
  misc_feature: GYAE6OF02I641Y.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagttagaagtgagtcccatcaaggttcggcggcaggtggatcgtgggacagaattcactctcaccatcagcagcctgcagcctgatgatttgctaacttattactgacctaactagttaattaattacgttttcgtaggtaacgtttcggacctaagggacctaagggtcggaacagtacaacgtaactggtgcctgactaccgtatcg

SEQ ID NO: 96965 - DNA, 545 bp, Homo sapiens
  misc_feature: GYAE6OF02IGTKF.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaagtgaggtcccaatcgaaggtttcggcggcagtggatctgggacagaattcgactctcaccatcagcagctgcagcctgatgtattttgctaacttattactgccaactagtacttaatacgtttttccgtggtaaccgtttcggtaccgaagggtaacccgaaggtacgggtaccaagtaccaaaccggtaacgtacggttagggccttaggacctaccgattaccgg

SEQ ID NO: 96966 - DNA, 516 bp, Homo sapiens
  misc_feature: GYAE6OF02IXDZ3.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtcggagacagaatcaccattatttgccggacaagtcacgacataaacaccttttaaatgtatcagcacaaaccaggaagccccaaagctctgatcgatgctgcatccaatttagagtaggtcggggtcccagtccgaggttcaggtggcgatggatcgtagggacaaatttcactctcaccatcagcagtctgcaacctgaagtatttgactaactttactattgtacaactagtagtttacagttactttcctttactacgtttcgacccgtggacctagtcgatactacaacgtactgtcgctgaccaccattctgtac

SEQ ID NO: 96967 - DNA, 570 bp, Homo sapiens
  misc_feature: GYAE6OF02HEMS2.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaacgcccctaagctcctgatctataaggcgtctagtttagaagtgaggtcccatcgaaggttcggcggcagtggatcgtgggacagaattcactctcaccatcagcagcctgcagcctgatgtattttgactaactttattactgaccctaactagttaattaagtttacgtttttaccggtaggttaaccgttccgggacccgtaacggggtaacctaaggggttcggaacctaacgtaaccgtaaaccggtaacgttcggtacgggtccgttacggacctacccgtattccg

SEQ ID NO: 96968 - DNA, 498 bp, Homo sapiens
  misc_feature: GYAE6OF02I05UB.29.59.F04.1.454.CMB.1.raw
  modified_base (398)..(398): a, c, t, g, unknown or other
  misc_feature (398)..(398): n is a, c, g, or t
  modified_base (425)..(425): a, c, t, g, unknown or other
  misc_feature (425)..(425): n is a, c, g, or t
  modified_base (473)..(473): a, c, t, g, unknown or other
  misc_feature (473)..(473): n is a, c, g, or t
  modified_base (495)..(495): a, c, t, g, unknown or other
  misc_feature (495)..(495): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccggcagtcagagtattagtagctggttggcctggtatcagcagaaaccagggaaacgcccctaagctacctgatctagtaaggcgtctagtttaagaagtgaggtcccatcaaggttcggcgcgagtggatcgtgggacagaattcactctacaccatcagcagcctgcagcctagntgtatttgactaacttatactgaccanagtataagttagtttcggtagtacgttcgacagggtacaaggtgacanacaacgatgcggctagctacgntcg

SEQ ID NO: 96969 - DNA, 523 bp, Homo sapiens
  misc_feature: GYAE6OF02HDGB2.29.59.F04.1.454.CMB.1.raw
  modified_base (280)..(280): a, c, t, g, unknown or other
  misc_feature (280)..(280): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaacncccctaagctcctgatctataaggctctagtttagaaagtgacgtccatcaagggttcgcggcagtgatcgtggacagaattcactctcaccatcagcagcctgcagcctgatgtattttgactaactttattactgtaccaactagttaattaagttacgttttccgtaggtacgttcggaccgtagggaccgtaggtcggacagtacaaacgtactggtacggcgtacgacctacgtatcg

SEQ ID NO: 96970 - DNA, 505 bp, Homo sapiens
  misc_feature: GYAE6OF02G6AM0.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaagtgaggtcccatcaaggttcgcggcagtggatcgtgggacagaattcactctcaccatcagcagcctgcagcctgatgtattttgctaactttattactgaccaactagtaataattagttttccgtggtacgttcggaccgtagggaccaaggtggacatacaaacgtactgtcggctgcaccatcg

SEQ ID NO: 96971 - DNA, 563 bp, Homo sapiens
  misc_feature: GYAE6OF02H4HNF.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcaagaaaccagggaaacgcccctaagcctcctgatctataggcgtctagtttagaaagtgacgtcccagtcgaagggttcggcggcagtggatcgtagggacaggattcactctacaccatcagcagcctgcacgcctgattgtatttgactaactttattactgacccaaacgtagttaattaagtttacgttttccggtagggtacccgttcgggacccgtaaggggtaccctaagggtggaacctagtaacaaaaccggtacgtacggttacggcctacggacctacctagttaccg

SEQ ID NO: 96972 - DNA, 542 bp, Homo sapiens
  misc_feature: GYAE6OF02HG8MK.29.59.F04.1.454.CMB.1.raw
  modified_base (375)..(375): a, c, t, g, unknown or other
  misc_feature (375)..(375): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaacgcccctaagcctcctgatctataaggcgtctagttagaagtgagtccatcaaggttcggcggcagtggatcgtggacagattcactctcacatcancagcctgcagcctgatgtatttgactaacttattactgaccaacgtagttaattaacgttagttttccggtaggtaccgtttaccggaccgtaaggggaacctaaggggtcggaactacgtaaccgaaaaccgtacgttaggtacgggccttcgacctaccattccg

SEQ ID NO: 96973 - DNA, 553 bp, Homo sapiens
  misc_feature: GYAE6OF02HNW4C.29.59.F04.1.454.CMB.1.raw
  modified_base (369)..(369): a, c, t, g, unknown or other
  misc_feature (369)..(369): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaacgcccctaagctcctgatctataaggtcgtctagttagaaagtgaggtccatcaaggttcggcggcagtggatcgtgggacagattcactcncaccatcagcagcctgcacgcctgatgtattttcgactaactttattactagtaccaactagttaataagtttacgttttccggttacggtaacgtttaccgggaccgtaacgggaccgtaacgggtcggaacgtaacgtacgtaaaccgtaacgtacggtacggtcctcgacctacctatacg

SEQ ID NO: 96974 - DNA, 509 bp, Homo sapiens
  misc_feature: GYAE6OF02FKQZ5.29.59.F04.1.454.CMB.1.raw
  modified_base (506)..(506): a, c, t, g, unknown or other
  misc_feature (506)..(506): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggccttggtatcagcagaaaccagggaaagcccctaagctcctgatctataaggcgtctagtttagaaagtgaggtcccatcaaggttcggcggcagtggatcgtgggacagaattcactctcaccatcagcagcctgcagcctgatgtattttgactaacttattactgaccaacgtagttaattaattagttttccgtaggtacgttcggaccgtagggaccaaggtcggaacatacaacgatgtggctgcacntcg

SEQ ID NO: 96975 - DNA, 676 bp, Homo sapiens
  misc_feature: GYAE6OF02HOWZV.29.59.F04.1.454.CMB.1.raw
  modified_base (561)..(561): a, c, t, g, unknown or other
  misc_feature (561)..(561): n is a, c, g, or t
tcagatagagtactcacgaccggtgctcgatttagtacacacacttagggattgggggcgaggagtcagaccagtcaggacacagcatggacatgagggtccccgctcagctcctggggctcctgctgctctggctcccaggtgccaaatgtgacatccagatgacccagtcctccttccactgtgtcctgctatctgtaggtgacagagtcaccatcacttggccgggcagtccagtagtattagtagcgttggttcggccttggtatcgagacaaggaaaacccgagggaaacgtaccccctaaagcctaccgtagattactaagtaacggtcttacgttaagttttaacgaaaagttcggaacggttcccaagttaccgaaaggtttccgggacggtacgtaggtggagtcgtaggggactaggtaattcgacgtctacaccactctaacgcagtcccgtgacctagcccgttagaacgtttcgaagttttcgaacttaacgtttacttacgtacgtaacctaacgtaagttaacttaacgttttacgttttaccggnggttaccggttacgtaaccggaacgggtacccgtaaggggtcgtaaccgtaattaaccggaaaaccggttacgtacgggtacggtaccgtacgggtacctaccggtattacccgg

SEQ ID NO: 96976 - DNA, 686 bp, Homo sapiens
  misc_feature: GYAE6OF02FU3RJ.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccaggggaaaagcccctaaacgtacgtcctccgtagtacttactaaggtacggtcgttacgtttaaggttaaagtaaggtaggtacccgtacctactaacggttaacgggtccgggacgacgtaggtaggtactggggtacgacgaagttactacctaccttacgtacccaactactacgacgacgaccgtcgcacgaccgtcgtagtagttagttttacgttcgaacctttaactttacttacgaccgtaaccctaagttaattaacgtttaagtttttaccggttacgggttaacggttaccgggttacccgtaaccgggtaaccggtaacgggttaacggggtaccgtaactaaccgtaaaccggaaacggttacggtcgggttacggtacgtaccggtaccctacgttaaccg

SEQ ID NO: 96977 - DNA, 672 bp, Homo sapiens
  misc_feature: GYAE6OF02IEWXY.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatctgtaggtgacagagtcacatcacttcgccgggccagtcagtagtattagtagcgtggtggtcctggtatcagacaagaaaccgagggaacgacccctaagcctcctgactatagtaaggcgtacttaagtttaagaagtggacgtaccatcgtaaggttcggcggcgtaggtggtacgtacgttagggaactagtaacttcgtacttctaccaactactcgagccagtcctacgcctacgtcctaggtacttagttacttttacgaacttaacgttactttacgtacgtaaccctaaacgtaagtttaattaaacgtttaacggtttttcccgggtagggttaacccgttttacggggaacccgtaaacggggaaccggttaaacgggttacgggtaaacctacgtaaaccggtaaaaccgtaaccggttacggttaaccgggtccgtacccggtaacgtacccgtaactttacccgg

SEQ ID NO: 96978 - DNA, 578 bp, Homo sapiens
  misc_feature: GYAE6OF02H75T7.29.59.F04.1.454.CMB.1.raw
  modified_base (289)..(289): a, c, t, g, unknown or other
  misc_feature (289)..(289): n is a, c, g, or t
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcacatcacttgccggcagtcagagtattagtagctggttggcctggtatcagcagaaaccagggaacacccgtaagctccngatactataaggctatagtttagaaagtgaggtccagtctaagggttcgngcagtggatcgtagganagtatcactctacacatcagcagctgcagctgattgattttcggactaactttaactttacgtacgacctaactaagttaacttaagttacgttttccggttaggtaaccggtttcccgggtaaccgaaccggggtaaccggtaagggtcgggtaaccgtagtaaccgtaaaacggtaccgttacggtacggtaccgttacgacgtaacccgacgtttaccg

SEQ ID NO: 96979 - DNA, 498 bp, Homo sapiens
  misc_feature: GYAE6OF02GRDCT.29.59.F04.1.454.CMB.1.raw
  modified_base (417)..(417): a, c, t, g, unknown or other
  misc_feature (417)..(417): n is a, c, g, or t
  modified_base (444)..(444): a, c, t, g, unknown or other
  misc_feature (444)..(444): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctctgatctataaggcgtctagtttagaaagtgaggtccatcaaggttcggcggcagtggatcgtgggacagaattcaactctcaccatcagcagcctgcagcctgatgattttgactaacttattactnaccaacagttaataattagttttccgnggtacgttcggacacgggacaagggtgacatacaaacgatgtggctgcacatcg

SEQ ID NO: 96980 - DNA, 566 bp, Homo sapiens
  misc_feature: GYAE6OF02HISS1.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcggcggcagtgatctgggacagaattcactctcaccatcagcagctgcacgcctagatgtattttgactaactttattactcgacctaacgattaattaattacgtttttaccggtaggtaaccggtttcgggaccgtaaggggtaccgtaaagggttcggaaccgtaacgtaccgaaaaccggtaaccgttaggtacgggtaccttacggacctacccgtagttacccg

SEQ ID NO: 96981 - DNA, 595 bp, Homo sapiens
  misc_feature: GYAE6OF02GLXMD.29.59.F04.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
  modified_base (282)..(282): a, c, t, g, unknown or other
  misc_feature (282)..(282): n is a, c, g, or t
  modified_base (399)..(399): a, c, t, g, unknown or other
  misc_feature (399)..(399): n is a, c, g, or t
  modified_base (434)..(434): a, c, t, g, unknown or other
  misc_feature (434)..(434): n is a, c, g, or t
tcagatagagtactcacgaccggtgctcgatttagtacacacacttaggattggggcgaggagtcagacccagtcaggacacagcatggacatgaggtcccgctcagctcctgggctcctgctgctctggctcccaggtcgccaaatgtgacatccagatgacccagtctccttccactgtgtctagcatctgttaggtnacagngtcaccatccattcgccggccagtcagatattagancgtggttgccttggttatcagcagtaaaccgagggtaaacnccccttaagctacctagatactataaggctagttagtttaagaagtgtagttcccaattcgaaggtttcggacggtacaggtcgatcgtaggggtacaaggtaacttccaagttccncgtaacctatacacgcagcctacgtacatcccgtnacgtgttaactttgacctaaacgtttcttaactcgtaactaacctaagtttataacgtttagtttaccgtaggttacgttacgggtcctaaacggacggtaacggtggtacaaccgttaacgaaccgtaacgtggtaccggtagtacgactaccgtatacg

SEQ ID NO: 96982 - DNA, 585 bp, Homo sapiens
  misc_feature: GYAE6OF02HITKG.29.59.F04.1.454.CMB.1.raw
tcagatagagtactcacgaccggtgctcgatttagtacacacacttagggattgggggcaggagtcagacccagtcaggacacagcatggacatgagggtccccgctccagctcctggggctcctgctgctctggctcccaggtgccaaatgtgacatccagatgacccagtctccttccactgtgtctgcatctgtaggtgacagagtcaccatcacttgccgggcagtcagagtattagtagctggttggcctggtatcagcaagaaaccgagggaaacgcccctaagcctacctgatctagtaacggcgtactaagtttagaaagtgaggtcccaatcgaaggttcggcggtcaggtggatcgtagggacaggtaactcactctacaccatacagtcacgcctagcacgcctagattagtacttttgaacttaactttattacctcgtaccaactaagttaattaatttacggttttacggtacggttaaccgttcggaccgaagggtaccgtaaagggtcggaactaacgtaaccaaaccgtaacgtacggtacggtaccgtacggacctaccgattaccg

SEQ ID NO: 96983 - DNA, 510 bp, Homo sapiens
  misc_feature: GYAE6OF02FI8HG.29.59.F04.1.454.CMB.1.raw
  modified_base (206)..(206): a, c, t, g, unknown or other
  misc_feature (206)..(206): n is a, c, g, or t
  modified_base (362)..(362): a, c, t, g, unknown or other
  misc_feature (362)..(362): n is a, c, g, or t
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagngtcaccatcacttgccggccagtcagagtatagtagctggttggcctggtatcagcagaaaccagggaaacgcccctaagctcctgatctataggctctagttagaagtgaggtccatcaaggttcggcgcagtggatcgtggacagattcactcncacatcagcagcctgcacgcctgatgtatttgactaacttattacngaccaanagttaataacttagtttccgtaggtaccgttcggacctaagggaccaagggtcgaactatacgaaacgtagtcggtaggcctagccacgtatccg

SEQ ID NO: 96984 - DNA, 548 bp, Homo sapiens
  misc_feature: GYAE6OF02FQKC7.29.59.F04.1.454.CMB.1.raw
  modified_base (281)..(281): a, c, t, g, unknown or other
  misc_feature (281)..(281): n is a, c, g, or t
  modified_base (391)..(391): a, c, t, g, unknown or other
  misc_feature (391)..(391): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttggccgggccagtcagagtattagtagctggttggcctggtatcagcagaaaccagggaaacncccctaagctcctgatctataaggctctagttagaagtgaggtccatcgaaggttcggcgcaggtggatcgtagggacagtaacttcactctcaccatcagcagcctgcngcctgatgtatttgactactttatactgaccaagtagttaataatttacggttttaccgtaggttacgttaccgggaccgtaacgggaccgtaagggtcggaacctaagtaacgaaacggtacgtacggtacggacttacggacctacctagttccg

SEQ ID NO: 96985 - DNA, 566 bp, Homo sapiens
  misc_feature: GYAE6OF02GLITB.29.59.F04.1.454.CMB.1.raw
  modified_base (300)..(300): a, c, t, g, unknown or other
  misc_feature (300)..(300): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggcagtcagagtattagtagctggttggcctggtatcagcagaaaccagggaaacgcccctaagcctcctgatctanaaggctctagttagaagtgaggtccatcgaaggttggcggcaggtggatcgtgggacagaattcactctcacatcagcagcctgcagcctagacttgtatttgactaaactttacttacttcgacctaactagttaattaagtttacgtttttaccgtaggtaaccgttaccgggaccgtaacggggtacccgtaagggttcgggaacctacgttaaccgaaacgtaaccgttaggtacggtccgtagaccctaccgagtttaccg

SEQ ID NO: 96986 - DNA, 715 bp, Homo sapiens
  misc_feature: GYAE6OF02H1EFT.29.59.F04.1.454.CMB.1.raw
  modified_base (201)..(201): a, c, t, g, unknown or other
  misc_feature (201)..(201): n is a, c, g, or t
  modified_base (283)..(283): a, c, t, g, unknown or other
  misc_feature (283)..(283): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtnacagagtcaccatcacttgccggccagtcagagtattagtagctggttggcctggtatcagacaagaaaccgaggggaaacncccctaaagctacctgtactactagtaaggtcgttacgttaagtttaaggaaagttggacggttacccagtaccggtaaaggggtttcggacggtcgtaaggttagggattccggtagggactaaaggttacttaccgaaccttccgtaacctaaccctaagtaccaacgaccgacggtcccgtacgccgtaacggtccgttagttacgttagttaagtttttacgaactttaaacttactttaacgtacgtaacccgtaaacgttaagttaaacgtttaacgttttaacgttttcccgggttaacgggtaccggtttacccgggaacccgtaacggggtaacctaacgggggtacgtaaccgtaacgtaaccgaaaaccggtaccggtttaggtacgggtaccgttacgtaccggtaccctacgttaaccg

SEQ ID NO: 96987 - DNA, 650 bp, Homo sapiens
  misc_feature: GYAE6OF02GVF6X.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcaagaaaccgagggaaacgccccctaaagctacctagactactagtaaaggtcgtacgtaagtttaagaaagtgacggtacccaataccgtaaagggttcggaccggtcgaacggtggaattccgtaggggaaccaaggtaaactttccaacgttcctaccacccgtatacacgtacacggtcctagcacgtccgtagacttagtattttcgaccgtaaactttagttactacgtaccgaaactacgttaaattaagtttacggttttacggtacggtaacgttaccggaccggtaaagggtacccgtaaagggtacggaacgtaacgtaaccgtaaaaaccggtacgttaggttacgggacgtcggaacctacccgtatttacccg

SEQ ID NO: 96988 - DNA, 863 bp, Homo sapiens
  misc_feature: GYAE6OF02HS81W.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatcgtgtaggtgacagagtcaccatcacttcgccgggccagtcaggagtattagtagcgttggttcggccgttggttactcgaggaccgaacggaaaacccgaaggggtaaaacccgacccccgttaaagcccgttaccgtaggtaacttacgtaaaggttaaacggtccgtttaacgtttaaacgggtttttaaaggaaaacggttcgggtaaccggttacccgtaagttaacccgggtaaacggggttttccggggaccgggtaccggtagggttacgggtaacggtttccggtaagggggtaaacctaaagggttaacttttacccgtaaccgtttcccgttaacctaaaccctaacgttaaccgaacggaaccgtaccgtacccgtacggaccgacggtacccgttaggttaacgtttacgtttaacgttttttacgaaaccgttttaaaccttttacgtttaaccgttaccgtaaccctaaacggttaacgtttaaacgttttaaacgttttaacggggtttttttacccggtacgggtttaacccgggtttaccgggtaaccggtaaccggggttaaccgtaaacggggttacggtaaccgtaaacgttaaccgaaaacggtacgttaggttaccggaccgttacggaaccctaccgtacgttaccg

SEQ ID NO: 96989 - DNA, 513 bp, Homo sapiens
  misc_feature: GYAE6OF02JOGWA.29.59.F04.1.454.CMB.1.raw
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (433)..(433): a, c, t, g, unknown or other
  misc_feature (433)..(433): n is a, c, g, or t
tcagatagagtactcacgaccggtgctcgatttagtacacacacttagggagttgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagacgtcaccatcacttcgccggccagtcagtagtattagtagcgtggttgtctggtatcagcaagaaccgaggaacgcccgtagctccgtgatactatagcgtactagttagaagtgacgtccagtcgaggtcgcgcgagtgatcgtggacagtatcactcacacntcagcagcngcngctgntgtnttacgactactntacngtacaatagtattacttgtttacgnggttaccgtaggtaccgacggtacgaggtacggactaataaccgtaacgtagtcggaggtcctagaccctactgttaccg

SEQ ID NO: 96990 - DNA, 676 bp, Homo sapiens
  misc_feature: GYAE6OF02H1KBR.29.59.F04.1.454.CMB.1.raw
  modified_base (212)..(212): a, c, t, g, unknown or other
  misc_feature (212)..(212): n is a, c, g, or t
  modified_base (299)..(299): a, c, t, g, unknown or other
  misc_feature (299)..(299): n is a, c, g, or t
  modified_base (313)..(313): a, c, t, g, unknown or other
  misc_feature (313)..(313): n is a, c, g, or t
  modified_base (385)..(385): a, c, t, g, unknown or other
  misc_feature (385)..(385): n is a, c, g, or t
tcagatagagtactcacgaccggtgctcgatttagtacacacacttagggattgggggcaggagtcagacccagtcaggacacagcatggacatgagggtcccccgctcagctcctggggctcctgctgctctggcctcccaggtcgaccaaatgtgacatccagatcgacccagtcctccttccactgtgtctgcatctgtaggtgacagngtcaccatcactcggccggacctagtcagagttattagtagcgttggttcggtccgtggtatcgagacaagaaaccgaagggaaccncccgtaagcctccngtactactagtacggcgttagtagttaagaagtgacgtccagtacgtaaggttcggagtacgagtgagtcgnggacagtatcactcacactactcgagcagcccgtgacccagtaccgtagtacttagtttacttttaccggaacttaaacctttaagttacgtaccgaaccctaaagtacgttaaacgtttaacgtttttaccggttttacgaacgggttacccggtttaccgggaaacccgtaaaccgggggtaccgttaaacgggggtacggtaaaccgtaacgttaaacccggttaaaaccgtacggttacgggttaccgggtaccttaaccggaaccgttacccgttaccgtttaccg

SEQ ID NO: 96991 - DNA, 568 bp, Homo sapiens
  misc_feature: GYAE6OF02FIDP7.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccaggggaaagcccctaagctcctgatctataaggcgtctagtttagaaagtgaggtcccatcaaggttcggcggcagtggatcgtggggacaggaattcactctacaccatcagcagcctgcagcctgatgtattttgactaacttattactgaccaacagttaattaagtttacgttttccgtagggtaccgtttaccgggaccgtaacggggtaccgtaagggtcggaaccaacgttaccgaaaaccggtaaccgttagggtacggtaccgtacggtacctacccgtagttacccg

SEQ ID NO: 96992 - DNA, 528 bp, Homo sapiens
  misc_feature: GYAE6OF02GZUSM.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataggcgtctagtttagaaagtgaggtcccatcgaaggttcggcggcagtggatcgtgggacaggaattcaactctcacatcagcagcctgcacgcctgatgtattttgactaacttattactcgaccaactagtaataattagttttccgtaggtacgttcgggaccgaagggacctaagggtcggaactacgtaacaaacgtacgtagtacggctaggactacctatcc

SEQ ID NO: 96993 - DNA, 623 bp, Homo sapiens
  misc_feature: GYAE6OF02I58TR.29.59.F04.1.454.CMB.1.raw
  modified_base (204)..(204): a, c, t, g, unknown or other
  misc_feature (204)..(204): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacngacgtcaccatcacttgccgggccagtcagagtattagtagctggttggcctggtatcagtcagaaaccgagggaaacgacccctaagctcctgactctagtagcgtctaagttagaagtgaacggtcctagtacgtaacgggttcgggcgacgtagtaggactcgtagggacaagtaacgttccactcctccaaccatcgacgaccagcctgccacgccttggaattgtagttttacgacttaaactttacttactacgtaccctaaagtacgttaattaacgtttaccgtttttccggacggttaaccggtttccgggtaaccgaaggggtaacccgtaagggttaccggtaacctaactaaccggtaaaccgtaggttacggtacgggtaccgtcgacccgtacgtacgtttaccg

SEQ ID NO: 96994 - DNA, 820 bp, Homo sapiens
  misc_feature: GYAE6OF02JDHX8.29.59.F04.1.454.CMB.1.raw
  modified_base (225)..(225): a, c, t, g, unknown or other
  misc_feature (225)..(225): n is a, c, g, or t
tcagatagagtactcacgaccggtgctcgatttagtacacacacttagggattgggggcgaggagtcagacccagtcaggacacagcatggacatgagggtccccgcctcagctccgtcggggctcctgctcgctctcggcctcccgacgggtcgccgaacgtggtcggacgtacgtaccgacggacgtaccgaccgtacgtcctcctcctactcgtcgtctcgntacccccccccccccccccccccccccctgtggtaggtcgacgacgtacgtaccacctactacctaccgtccggccggtaccgtacgtacgtaacgtagttaacgttaacggtagtcggtggttcggtccgttcggtagttacgtacgacgtaacgaaacggaacggaaccggaaccgtacgtaccgtaccgtacgtactactaacggtacggtacgttacgttaaggttaacgtaacggtacggtacgtaccgtacgtacggtacggtacgggtcggtacgtaggtacggtacgtacgtacggacggtacgtaacgtacgtacgttaccacctacgtacacgtacgactaccgtactcggactaccgtcgtacggttactaccggttagtttactaccggttaacctttaacgttacccgtacggttaaacccttaacggtaaccgtttaagttaaccggttttaccgggtttacccgggtaacggttacccgggttaccgtaaccggggtacgtaacggggttaacggtaacggtaccctaacggtaaccgtaaacgtcggttaacgccgtacgtacggactacgtcgttacg

SEQ ID NO: 96995 - DNA, 549 bp, Homo sapiens
  misc_feature: GYAE6OF02HK1JL.29.59.F04.1.454.CMB.1.raw
  modified_base (300)..(300): a, c, t, g, unknown or other
  misc_feature (300)..(300): n is a, c, g, or t
  modified_base (356)..(356): a, c, t, g, unknown or other
  misc_feature (356)..(356): n is a, c, g, or t
  modified_base (409)..(409): a, c, t, g, unknown or other
  misc_feature (409)..(409): n is a, c, g, or t
  modified_base (431)..(431): a, c, t, g, unknown or other
  misc_feature (431)..(431): n is a, c, g, or t
  modified_base (464)..(464): a, c, t, g, unknown or other
  misc_feature (464)..(464): n is a, c, g, or t
  modified_base (501)..(501): a, c, t, g, unknown or other
  misc_feature (501)..(501): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccatgtgtctgcatctgtaggtgacagcgtcaccatcacttggccgggccagtcagagtacttagtagctggttggcctggtatcagcagaaaccagggaaagcccccgtaaagccttaccngtatctagtaaggcgtctaagtttagaaagtgaggtcccatcgaaggttcgcggcngtggatcgtgggacagtaattcactctcaccatcaagcagcctgcagctgatntatttcgactaacttgttaacngacctaactagtaacttaagttcgtttttccgnggtaccgttggacctagggccctaagggtcggtaacncgtacctaaacggacttggtacggccttaggacccgtacctagttccg

SEQ ID NO: 96996 - DNA, 570 bp, Homo sapiens
  misc_feature: GYAE6OF02FGMR2.29.59.F04.1.454.CMB.1.raw
  modified_base (201)..(201): a, c, t, g, unknown or other
  misc_feature (201)..(201): n is a, c, g, or t
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtnacagagtcaccatcacttgccgggcagtcagagtatagtagctggttgcctggtatcagcagaaccagggaacnccctaagctctnatctataaggctctaagttagaagtgaggtcccatacgaaggttccggcggcaggtcgatcgagggacagtacttcactctacaccatcagcagcctgcagcctagcttgtatttcgactaatttacttactacgacctaagtagttaattaacgtttcgtttaccgtaggtaccgtttaccggaaccgtaaggggacccgtaagggttacgaaccgtaacgttaaaccgaaaccggtaacgttcgggtaccggacgttacggaccttacctacgtttaccgg

SEQ ID NO: 96997 - DNA, 531 bp, Homo sapiens
  misc_feature: GYAE6OF02GOMKC.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttcgccgggccagtcagagtattagtagcttggtttgcctggtatcagcagaaaccagggaagcccctaagctcctgatctataggcgtctagttagaagtgagtccatcgaaggttcggcgcgagtggatcgtgggacagtatcactctcaccatcagcagcctgcacgctgatgtatttgactaactttatactcgacaactagtattaagttacgttttccgtggtaccgttccgaccgtaagggtaccagggtagaaccgtataaccgtaaacgtacgttggtacggtatacggacctacctagttaccg

SEQ ID NO: 96998 - DNA, 535 bp, Homo sapiens
  misc_feature: GYAE6OF02H6R92.29.59.F04.1.454.CMB.1.raw
  modified_base (452)..(452): a, c, t, g, unknown or other
  misc_feature (452)..(452): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcacatcacttgccgggcagtcagagtattagtagctggttggcctggtatcagcagaaaccgaggaaacgcccctaagctcctgatctataaggcgtctagtttagaagtgagtcccatcgaaggttcggcgcgagtggatcgtgggacagaatcactctacacatcagcagcctgcagcctagatgtattttgactaacgttattactcgacctaatagttaattaacgttagtttttccggnggttaaccgttccgggacaacggggtaccgaagggtcggaactactaacgaaacgtacgtgtcggctcgaccaccgtattccg

SEQ ID NO: 96999 - DNA, 832 bp, Homo sapiens
  misc_feature: GYAE6OF02HBJRW.29.59.F04.1.454.CMB.1.raw
tcagatagagtactcacgaccggtgctcgatttagtacacacacttagggagttgggggcaggagtcagacccagtcaggacacagcatggacatgagggtccccgctcagctcctggggctcctgctgctctggctcccaggtgccaaatgtgacatccagatgacccagtctccttccactgtgtctgcatcgtgtaggtgacagagtcaccatctacttcggccggccagtcagagtattagtagctgggttcggctggtatcgagacaagaaaccgaagggaaaccacccctaagcctccgtagtacttacgtaagtaacggtcgttacgttaaggtttaaggaaaggttcggtaacggttacccgtaacgttacggtaaacggggtttccgggaccgggtacgtaagggtacgggtaacgttccgggtagggggtaaacctaagggttaaacctttaccgtaacccgtttaccgttaaccccgtaacccgtaacgttacccgaacgggtacccgtaaaccggtccccgttacggacccgtaaccggtacccggttaaggttaacgtttacggtttaagtttttacccggaaaccgttttaaaaccttttaacgtttaacccgttacggtaaaccccttaaaacgtttaaagtttaaacttttaaacggtttttacgggtttttaccgggttaacgggttaaccggtttacccggggaacccggtaaacggggtaacccgttaaaggggttaccggaaccgttaaagttaaacccgaaaaccgttacgttacgggtacggtccgttacggaccctacgtacgttaccg

SEQ ID NO: 97000 - DNA, 544 bp, Homo sapiens
  misc_feature: GYAE6OF02F1WQ1.29.59.F04.1.454.CMB.1.raw
  modified_base (205)..(205): a, c, t, g, unknown or other
  misc_feature (205)..(205): n is a, c, g, or t
  modified_base (290)..(290): a, c, t, g, unknown or other
  misc_feature (290)..(290): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
  modified_base (424)..(424): a, c, t, g, unknown or other
  misc_feature (424)..(424): n is a, c, g, or t
  modified_base (541)..(541): a, c, t, g, unknown or other
  misc_feature (541)..(541): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtagtgacagntcaccatcacttgccgggccaggtcagagtattagtagtctggttggccttggtatcagcagaaccagggaacgccctaagctcngatctataagcgtacttagtttagaagtgacggtcccatcgaaggttcggcggnaggtgatcgngggacagaacttcactctacacatcacgcacgcctgcagcctgtatgtatttcgacttaactttattacncgacctaaacgtagttaacttaagtttcggttttaccgtagggtacgttccgggaccgtaacgggaccgtaagggtcggaacacgtacgaaacgacgttggtcggctagacaccgtntcg

SEQ ID NO: 97001 - DNA, 705 bp, Homo sapiens
  misc_feature: GYAE6OF02IVH00.29.59.F04.1.454.CMB.1.raw
  modified_base (107)..(107): a, c, t, g, unknown or other
  misc_feature (107)..(107): n is a, c, g, or t
  modified_base (131)..(131): a, c, t, g, unknown or other
  misc_feature (131)..(131): n is a, c, g, or t
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (265)..(265): a, c, t, g, unknown or other
  misc_feature (265)..(265): n is a, c, g, or t
tcagatagagtactcacgaccggtgctcgatttagtacacacacttagggagttgggggcaggagtcagacccagtcaggacacagcatggacatgagggtccccgntcagctcctgggctcctgctgctntggctcccaggtgccaaatgtgacatccagatgacccagtctccttccatgtcgtctgcattctgtagtgacagngtcacntcagttcggccggtcagtcagagtattagtagtcgtggttcggcttggtactnagtcaagaaaccgaggaaccgtccctaagccgtaccgtagacttacgtaacgtacggaccgttacgttaagttaagaaaggtcggtacggttaccccagttacgtaaacgggtttccggacggtacgtaaggtggtaacttaccggtagggaacctaaggtacgttcccaagtcctacgtaccgtactacgaacggtacctacgtcgtaccgacgtacgtacccgtaggtacttggttactttacggacttaaacgttacctttacgtaccgaaccttaacgtaacgttagtttaaacgttaccgttttacggtaccggtttaaccgttaaccggacccgtaaagggtacccggttaaagggtaaccgtaacggtactttaaaccggaaacccggttaagttcggaacggttccgtaaccggactaaccgttactaccgg

SEQ ID NO: 97002 - DNA, 575 bp, Homo sapiens
  misc_feature: GYAE6OF02FK28R.29.59.F04.1.454.CMB.1.raw
  modified_base (302)..(302): a, c, t, g, unknown or other
  misc_feature (302)..(302): n is a, c, g, or t
  modified_base (338)..(338): a, c, t, g, unknown or other
  misc_feature (338)..(338): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggcagtcagagtattagtagctggttgcctggtatcagcagaacaggaaacgcccctaagctcctgatctataaggctntagttagaagtgacgtccatcgaacggttcggacgnaggtggatcgtaggacagtaatcactctacaccatcagcacgctagcacggcctagacttcgtattttcgacttaacttacttaacgttcgacctaacgtaagttaattaacgtttacggttttaccgtacgggttaacggttaccgggacccgtaacggggaccgtaagggtacggtaactaaccgtaacgtaaaccgaaacggttcggtacggtacgtcgaccctacgacttccg

SEQ ID NO: 97003 - DNA, 574 bp, Homo sapiens
  misc_feature: GYAE6OF02IL23A.29.59.F04.1.454.CMB.1.raw
  modified_base (440)..(440): a, c, t, g, unknown or other
  misc_feature (440)..(440): n is a, c, g, or t
tcagatagagtactcacgaccggtgctcgatttagtacacacacttagggagttgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgcccggcagtcagagtattagtagcgtggttggcctggtatcagcagaaaccagggaacgcccctaagctcctagatctataaggcgtctagttagaagtgaggtccagtcaagggttcggcggactaggtggatcgtagggacaggaaacttcaactctacacctaatcaagcaggcctagctacgcttgatgttatttcgacttacttacttacgtanaccctaagtagttaactttaattacgtttttccggacgggttaaccgtttcggggaccctaagggtaccgtaaagggtgtaaccaagtaaccgaaaccgtaggttcgtaggccttacggacctacggtattccg

SEQ ID NO: 97004 - DNA, 792 bp, Homo sapiens
  misc_feature: GYAE6OF02G31IO.29.59.F04.1.454.CMB.1.raw
  modified_base (201)..(201): a, c, t, g, unknown or other
  misc_feature (201)..(201): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtnacagagtcaccatcacttggccggccagtcagagtattagtagcgtggttggcctggtactcagcaagaaaccgagggaaacgccctaaagcctcctagactctaagtaacggtccgttacttaaggtttaagaaaggttggtaaccgggttaccctaacgttacgtaaacggggtttccgggacgggtaccgtaagggttacgggtaacgtttaccggtagggggaaacctaaggtaaacgttttcccgaaccttccttaacccaacccgtaactaccgtaccggtacgaacggtacccgtacggaccgacggtacccgttaggtaacgtttacggttacgttttacgaactttaaacctttactttaacccgttacgtaaaccctaaacgttaacgttaaacgttttaaacgttttaaccgggttttttcccgggtaacggtttaaccgggtttaccgggtaacccggtaaacgggggtaacccgtaagggggttaaccggtaaccgtaacgtaacccggtaaaaaccggtaaccgttacgggttacgggaacccgttaccggtacccgtaacccgtacgtttacccgg

SEQ ID NO: 97005 - DNA, 540 bp, Homo sapiens
  misc_feature: GYAE6OF02I4WXN.29.59.F04.1.454.CMB.1.raw
  modified_base (374)..(374): a, c, t, g, unknown or other
  misc_feature (374)..(374): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttcgccgggccagtcagagtattagtagctggttggcctggtatcagcagaaaccagggaaacgccccctaagctcctgatctataaggcgtctagttagaaggtgaggtcccatcgaaggttcggcggcagtggatcgtgggacagaattcactcncaccatcagcagcctgcagcctgatgtatttgctaacttattactgaccaactagttaataacgttacgttttaccggtgtaccggttcgaccggtaagggaaccgaacggtggaactacgtaaccgaaacgtaacgttgtacggtctagaccaccgtattacccg

SEQ ID NO: 97006 - DNA, 627 bp, Homo sapiens
  misc_feature: GYAE6OF02HEMSW.29.59.F04.1.454.CMB.1.raw
  modified_base (287)..(287): a, c, t, g, unknown or other
  misc_feature (287)..(287): n is a, c, g, or t
  modified_base (348)..(348): a, c, t, g, unknown or other
  misc_feature (348)..(348): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttggccgggccagtcagagtattagtagcgttggttggcctggtatcagcgaacgaaaccgagggaaacncccctaagctcctgatcgtataaggctactagttagaagtgagtccatcaggtcggacggnagtggtatcgtggacagtacttcactcacacctatcgagccgagcctacgcacgtccctagcttaggtacttttcgacttaaacgtttcttaacgtacgtaccgtaaacttaaggttaactttaacgttacggttttttcccggtaagggttacccggtttacgggacccgtaacggggtaacccgtaacggggtcgggtaaaccctaacgttaacccgaaacggttaaccgttacggtacgggtaccgttaccggtacctaacccgttagttacccgg

SEQ ID NO: 97007 - DNA, 430 bp, Homo sapiens
  misc_feature: GYAE6OF02F4UEI.29.59.F04.1.454.CMB.1.raw
  modified_base (411)..(430): a, c, t, g, unknown or other
  misc_feature (411)..(430): n is a, c, g, or t
tcagatagagtactcacgaccggtgctcgatttagtacacacacttagggagttgggggactgtccctgggagttgctggtaccaggatacagaattcttcacaatgttggagctacttccagggacagtccccaaacttctcatttatgacaatagtcagcgaccctcagggattcctgaccgattctctgcctccaagtctggctcgtcagccaccctgggcatcaccgggctccagactggggacgaggccgattattattgtggaacatgggatagcagcctgagtgcttacgcttcggactgggaccaaggtcaccgtctaggtcagcccaaggccaacccatgtccactctcgtccccgccctctcacgtactctagtctgagcgggctggacaaggcacatagnnnnnnnnnnnnnnnnnnnn

SEQ ID NO: 97008 - DNA, 710 bp, Homo sapiens
  misc_feature: GYAE6OF02GX3TD.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttcactgtgtctgcatctgtaggtgacagacgtcaccatcacttcggccgggccagtcagagtattagtagcgtaggttggcctggtatcgagacaaggaaaccgaaggggaaaccgaccccctaagcctcctagacttactaagtaacggacgttacttaagtttaacggaaaggtcggtaacggtcccctaagttaccgtaaacggggtttcgggaccggacgtaagggtcggtaacgtcggttaggggacctaaggtaacctttcgaccttacctaccaccctataccgagtacacgcctcgaccacggtccctagtacgtttaggttacttttacgacctttaacgtttaacttaccgtacgaacccgttaaagtaacgtttaagtttaacgttttaccggttttcccggtacggttaaccgggtttaccggaaccggtaaccgggtaacggtaacgggtacggtaaccgtaacgtaaccgaaaacgtacgttacggttacggtaccgtacggacctaaccgtacttaccg

SEQ ID NO: 97009 - DNA, 581 bp, Homo sapiens
  misc_feature: GYAE6OF02FOINX.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccggcagtcagtagtattagtagctggttggcctggtatcagcagaaccgaggaaacgcccctaagcctcctgatctagtaacggcgtacttagttagaagtgagtcccatcaggtcgcgacagtgatgtggacagattcactctcactatcgagcacgcgtacgcacgcgtcgatagttagtttcgtactaactttacttacgtcgtaacctaacgtattaagttaactttaacgttttacgttacggttaccggttaccggtaccggtaacgggtaaccgaacgggttacggaacgtaacgtaaccgtaaaccgtaacgttacggtacggtacgtacgaccgtactaccccccgttacg

SEQ ID NO: 97010 - DNA, 538 bp, Homo sapiens
  misc_feature: GYAE6OF02HVI1Y.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggtggcctggtatcagcagaaaccgagggaaacgcccctaagcctctgatctagtaaggcgtactagttagaagtgacggtccatcgaaggttcggcgcagtggatcgtggacagtattcactctcaccatcagcagcctgacagcctgatgtatttgactaatttatactgacctaacgtagttaattaattacgttttccgaggtaccgttcggacgtaacgggaccgtaagggtcggtaactacgtaaccgtaaacgtaactaggtacggctacggactaccgtatccg

SEQ ID NO: 97011 - DNA, 578 bp, Homo sapiens
  misc_feature: GYAE6OF02IQIKH.29.59.F04.1.454.CMB.1.raw
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcacctatcacgttggcccgggccagtcagtagtattagtagctggttggcctggtatcagcagaaaccagggaacnccctaagctcctgatctagtagcttntagttagaagtgacgtccatcgaagttcggngcagtgatcgnggacagatcgactctcacatcgagctacgcctgacacgcctagatagtatttcggaactacttactttactcgaacctaagtaattaacttaagtttaccgttttccggtacggttaccggttaccgtaccggtaacgggaaccgtaacggggtaacggaacctaaggtaaccgaaaacgtaacggttcggtacggtaaccgttacgaaccgtacctagtttaccg

SEQ ID NO: 97012 - DNA, 608 bp, Homo sapiens
  misc_feature: GYAE6OF02FPCDL.29.59.F04.1.454.CMB.1.raw
  modified_base (244)..(244): a, c, t, g, unknown or other
  misc_feature (244)..(244): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagagntggttggcctggtatcagcagaaaccgagggaaacgcccctaagcctccgtagatctaagtaacggcggtacttagtttaagaaagtgacggtcccatacgaaggttcggcggacaggtggatcgtggacagattcactctcacatcagcacgctcgacacgcctagtacttaggtattttcgaccttaaacttttacttaaccgttcaaccctaaagtagtttaaacttaacgttttaacgttttaccggtacgggttaaccgtttaccgggaaccgtaacgggtaaccggtaagggtcggaaactacggtaacctaaaccggaagttacggcggtaccgttacgacctaccgtacgttaccg

SEQ ID NO: 97013 - DNA, 593 bp, Homo sapiens
  misc_feature: GYAE6OF02IFZTL.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatctgtaggtgacagagtcaccatcacttcgccgggccagtcagagtattagtagctggttcggcctggtatcagcagaaaccgaggaacgcccctaagctccgtgatctagtaggtcgtctaagtttagaaagtgacggtccatcgaaggttcgcggcaggtgacgtcgtaggactagtaacttcaccgtctaccaactataccgagacagtcctgacacgtcctagtatgtattttgaaccttaagttacttacgactacctaacgtaagttacttaagtttacgtttccgtaggtaaccgttaccgaccgtaagggtaacccgtaagggttacggaactaacgtaacgtaaaaccggtaacgttcggtacgggtaccttaggaccctacgtagttaccg

SEQ ID NO: 97014 - DNA, 585 bp, Homo sapiens
  misc_feature: GYAE6OF02F1HEM.29.59.F04.1.454.CMB.1.raw
  modified_base (201)..(201): a, c, t, g, unknown or other
  misc_feature (201)..(201): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtnacagagtcaccatcacttgccggcagtcagagtattagtagctggttggcctggtatcagcaagaaaccgaagggaaacgccccgtaagcctaccgtagactactaagtaggcgtattaagttaagaagtgacggtcccagtacgaaggttcggcggactaggtggatcgtagggacaaggtaattcacttcacaccatcgagcacgcctagcacgtcctagatcgttatttcgacttaactttactactcgactaacgtaagttacttaagtttacgtttccgaggttaccgttacggaccgtaagggaccgaagggttcgaacctaacgtaaccgaaaccggttacgttgggtacgtaccgtacggacctacctagttaccg

SEQ ID NO: 97015 - DNA, 546 bp, Homo sapiens
  misc_feature: GYAE6OF02GAGX5.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccggcagtcagagtattagtagctggttggcctggtatcagcagaaaccagggaaacgcccctaagcctcctgactctataggcgtctagttagaagtgagtccatcgaaggttcggcgcgagtgatcgtaggacagtatcactctcacatcagcagctgcacgcctagactgtatttcgactaactttacttactacaccaactagttattaacgtttacgttttaccgtaggttaccgttcggaccgtaacgggtaccgtaagggtcggaactaacgtaaccgaaacgtaacgtacggtacggcgtacgacctaccgtattccg

SEQ ID NO: 97016 - DNA, 556 bp, Homo sapiens
  misc_feature: GYAE6OF02GYAL1.29.59.F04.1.454.CMB.1.raw
  modified_base (343)..(343): a, c, t, g, unknown or other
  misc_feature (343)..(343): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccggccagtcagagtattagtagctggttggcctggtatcagcagaaaccagggaacgccctaagctcctgatctataaggctctaagtttagaaagtgacggtccatcaagggttcggcggnaggtgagtcgtgggacagacttcacgtctcacctatcagcagcctagcgacgtctgatgttatttgactaatttactactacgacccaatagtaattaacgttacggttttccgtaggtaccgttacggaccgtacggggaaccaaggggtcgaacgtacgtaacgaaaccgtaacggttcggtacggtccgtacgtacgtaccctagttccg

SEQ ID NO: 97017 - DNA, 603 bp, Homo sapiens
  misc_feature: GYAE6OF02FHBRR.29.59.F04.1.454.CMB.1.raw
  modified_base (286)..(286): a, c, t, g, unknown or other
  misc_feature (286)..(286): n is a, c, g, or t
tcagatagagtactcacgaccggtgctcgatttagtacacacacttagggagttgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttggccgggccaggtcaggagtattagtagctgggttggccttggtatcagcagaaaccagggaaacncccctaagctcctgatctataaggctacttagttagaagtgacggtccatcgaggtcggcgcaggtgatcgtgggacagtacttcactctacacatcagcacgcctgccacgcctagtactagttacttttcggacctttaaactttattaaccgcgtaaccctaaacgtagttaactttaaacgttttaccggttttaccgttagggttaccgtttaccggaaccggtaacgggtacccggtaagggttaacggaacgaacgttaaccgaaaccggtaacgttcggtaccggtacgtacgacccaccgtagttccg

SEQ ID NO: 97018 - DNA, 528 bp, Homo sapiens
  misc_feature: GYAE6OF02G3MYE.29.59.F04.1.454.CMB.1.raw
  modified_base (523)..(523): a, c, t, g, unknown or other
  misc_feature (523)..(523): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttggccgggccagtcagagtattagtagctggttggcctggtatcagcagaaaccgagggaaacgcccctaagcctcctgatactataaggcgtctaagtttagaaagtgagtcccatcgaaggttcgcggcagtgatcgtgggacagattcactctcacatcagtagctgcagcctgattgtatttcgcttaacttatactcgacaactagtaattaattagtttcgtcggtacgttacggcgaacgggtacgtaggtacggacaactaacgaaacgtacgttgacggtactacgaccactagtnttacg

SEQ ID NO: 97019 - DNA, 1199 bp, Homo sapiens
  misc_feature: GYAE6OF02GW7FC.29.59.F04.1.454.CMB.1.raw
  modified_base (291)..(291): a, c, t, g, unknown or other
  misc_feature (291)..(291): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatcgtgtaggtgacagagtcaccatcacgttcggccgggccagtcgagtagtattagtagctgggttggcctggtatcagacaacgaaaccgagggaaccncccgtaagcctacctaggactacgtaagtaacgggtcttacgttaagtttaaggaaaggttcggaacggtaccccgtaagttaccggtaaacgggggtttccgggaccgggtacgtacgggttacgggtaacgttaccgggtaacgggggtaacctaaagggtaaaccgttttacccgtaacccgtttaccccggttaaccctaaacccccggttaaaccgttacccggtaaaccgggtaaacccggtaacccgggttaacccccgttaccggggtaaacccggttaacccggttaccccgggtttaacgggttaaaccgggttttttaaacccggggtttttaaacccgggttttttttaaaaccccggggttaaaacccccgttttttaaaaaaaaccccgtttttttttaaaacccgggttttttaaaaccccccgggttttaaacccccgggttaaaaaacccccccggttttaaaaaaacccgggtttttaaaaaacccggggttttttaaaaaaaccgttttttttaaaaaccccgggggttttttttttaaaacccccggggtttttttttttaaaccccggggggggggttttaaaaaccccgggggtttttaaaacccccccggggggggtttttaaacccccgggggggtttaaaaaacccccccgggggttaaaaaacccggggggggggttttaaaacccccccgggggtttaaaaaaaaccggggggggtttttaaccccggggggttaaaaaacccggggtttaaaaaacccccggttttaaaaacccccgggggttaaaaaaaaaccccccgggggttttaaaacccgggtttttaacccgggggggggtttaaacccccgggtttaaaacccgggggttttaacccccgggt

SEQ ID NO: 97020 - DNA, 907 bp, Homo sapiens
  misc_feature: GYAE6OF02IDVVQ.29.59.F04.1.454.CMB.1.raw
tcagatagagtactcacgaccggtgctcgatttagtacacacacttagggattgggggcaggagtcagacccagtcaggacacagcatggacatgagggtccccgctcagctccgtggggctcctgctgctctggcctcccaggtcgaccaaatgtgacatccagatcgacccagtcctccttcactgtcgtctgcatcgtgtaggtgacagacgtacacctatcacgtcggccggccagtcaggtagtatagtagtcgttggttcggctggtactcgagacgaaacggaaaacccgagggtaaacccgaccccttaaggtcccgttaccgtagtaacttaccgtaagttaacgggtccgtttacgttaaggttttaaaggaaaggttacggtaaccgggtaccctaaggttaccggtaaacgggggtttccgggacgggtaccgtaagggttacgggtaacgttcggggtaacgggaacgtaaacggttaacgtttacccgttacccgttaccttaaccgtaacccgtaaccgttaacccggtaacggtacccggtaaccggttacccgtaccgggtaacccgtaaccggggtacccgtttaaaggtacggttttaacgggtttaacggtttttaccgtaaacggttttaaaccttttaaacgttaacccggttaaaccgttaaacccgttaaacgttaaaacgttttaaacgtttaaacgggtttttaaccgggtttttacccgggtaccgggtttaaacccggggtttacccgggaacccggttaaaccgggggttaaccggtaaacgggtaaccggtaaacctaaaccggtaaacccgttaaaaccggtaaggttaccgggtaccggtaccggttaccggaaccttacccggtacgtttaccg

SEQ ID NO: 97021 - DNA, 542 bp, Homo sapiens
  misc_feature: GYAE6OF02GH0TK.29.59.F04.1.454.CMB.1.raw
  modified_base (201)..(201): a, c, t, g, unknown or other
  misc_feature (201)..(201): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtnacagagtcacatcacttgccgggcagtcagagtattagtagctggttggcctggtatcagcagaaaccagggaaacgcccctaagctcctgatctataaggcgtctagtttagaaagtgaggtccatcaaggttcgcggcagtgatcgtgggacagaattcactctcaccatcagcagcctgcacgcctgatgtattttgactaactttattactgacctaacagttaattaatttacgttttaccgtggtaaccgttacgggacctaagggacctaacgggtcggaactaagttaaccgaaacgtaacgtaggttacggacctaggacctacctattccg

SEQ ID NO: 97022 - DNA, 655 bp, Homo sapiens
  misc_feature: GYAE6OF02JZNSM.29.59.F04.1.454.CMB.1.raw
  modified_base (201)..(201): a, c, t, g, unknown or other
  misc_feature (201)..(201): n is a, c, g, or t
tcagatagagtactcacgaccggtgctcgatttagtacacacacttaggattggggcaggagtcagacccagtcaggacacagcatggacatgagggtccccgctcagctcctggggctcctgctgctctggcctcccaggtcgccaaatgtgacatccagatgacccagtcctcctccactgtgtctgcatctgtaggtnacagacgtcaccatcacgttggcccggccagtcaggatattagatcgtggttggcctgtatcgagcacgaaccgagggaacgccccgtaagtccgtctaggactacgtagtaacggcgttactaggtttaagaacgtggtaaccggtccctaagtaccgtaacgggttcggcggtacgtaggtacgtagtcggtagggaactaggtacttacacgttcgtaccacgtactccagaccctagtcctagacctacgacccgttgactttgtacgttttacgacttaaccgtttataccgtacgtacctaacgtaacgtttacgttaagtttcgttttacccggaggttaccgtttccggaacctacgggtaccggttaaggtacggtaactacgtaaccgtaaacccggtagttacggaccggttacgttaacggaccgttacccgtattacccgg

SEQ ID NO: 97023 - DNA, 585 bp, Homo sapiens
  misc_feature: GYAE6OF02HAENG.29.59.F04.1.454.CMB.1.raw
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccagatgtgacatccagatgacccagtctccttccactgtgtctgcatctgtaggtgacagacgtcaccatcacgttcggccgggccagtcagagtattagtagctgggtggtcctggtatcagcaagaaaccgagggaaacgacccctaagcctcctagatctagtaacggcgttactagttaagaagtgacgtccatcgaaggtcggcggnaggtgatcgngganagattcactctacacancngcacgtcngccacgtcctagctagtatttgacttaaacgttattacgacgtaccaaattacgttaatttaacgtttacggttttaccgagggttaccgtaccgggaccgtaaacgggtaaccgtaaggggtccggaaactaccgtaacggtaaaccggtacgttaggtcggtcctacggaccgtaaccttaccgg

SEQ ID NO: 97024 - DNA, 630 bp, Homo sapiens
  misc_feature: GYAE6OF02F35BT.29.59.F04.1.454.CMB.1.raw
  modified_base (202)..(202): a, c, t, g, unknown or other
  misc_feature (202)..(202): n is a, c, g, or t
  modified_base (282)..(282): a, c, t, g, unknown or other
  misc_feature (282)..(282): n is a, c, g, or t
  modified_base (358)..(358): a, c, t, g, unknown or other
  misc_feature (358)..(358): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatcgtgtaggtnacagagtcaccatcacttgccgggcagtcagagtattagtagcttggttggccttggtatcagcagaaaccgagggaacncccctaagcttctgatctataaggcgtctagttagaagtgacggtcccatcgaagggttcgcggtcaggtggatcnggggacagtaacgttcactcgtacaaccctataccgagccacgtcctgccgtagtcccgtagtagttagttacttttacgacttaaacttttacttaccgttacggaaccctaacgtaacggttaaactttaaagttttaccggtttttaccggtaccgggttaccggttttaccggaccggtaaccggggtacgtaaggggttaccgaacgttaacgtaaccgtaaacggtacgttaggtacggtacctacggacctaccgtagttacccg

SEQ ID NO: 97025 - DNA, 642 bp, Homo sapiens
  misc_feature: GYAE6OF02IE73K.29.59.F04.1.454.CMB.1.raw
  modified_base (201)..(201): a, c, t, g, unknown or other
  misc_feature (201)..(201): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtnacagagtcacatcacttggccgggccagtcagagttattagtagcgttggtcggcctaggtatcagacaacgaaaccgaagggaaccgtaccccctaagccttaccgtagattactaagtaagggccgttacgttaaggtttaagtaaaggtcggtaacggtccctaacgtacgtaacgggttcggcggtcgtaacggtggaagtcgtagggaactaggtaacttctacctctacaccaattcgaaggcacgccgtcgacncgtcctaggtnttagttattttacgacttaactttatacgtcgacctaatacgttaattaacttttacgggtttccgtaggtaccgtttacgggacccgtaaggggtaacccgtaagggtcgggtaacaacggtaaccaaaacggtacgttcggtaggtccctagaccgtactacgttcg

SEQ ID NO: 97026 - DNA, 597 bp, Homo sapiens
  misc_feature: GYAE6OF02HCYI8.29.59.F04.1.454.CMB.1.raw
  modified_base (201)..(201): a, c, t, g, unknown or other
  misc_feature (201)..(201): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtnacagagtcaccatcacttggccgggccagtcagagtattagtagcgtggttggccgtggtatcagcaagaaaccgagggaacgcccctaagcctccgtgtatactaagtaacggtcgttacttagttaagaagtgtacgtccagtacgtaacgggttcggcggtacgtaggtcggatcgtagggacaagtacttaccactcgtacacctatcgtagcacgtcctagcgacgtccgtagagttagttactttcgacttaacttacttactacgtacctaacgtaagttaacttaacgtttacgtttcggtacggtaccgttcggaccggacggtacgtaagggtcgaactacgtaacgaacgtacgtacggtcgtacgtacggacctacgtattacg

SEQ ID NO: 97027 - DNA, 574 bp, Homo sapiens
  misc_feature: GYAE6OF02GSKPB.29.59.F04.1.454.CMB.1.raw
  modified_base (408)..(408): a, c, t, g, unknown or other
  misc_feature (408)..(408): n is a, c, g, or t
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcattgccgggccagtcagagtattagtagctggttggccttggtatcagcaagaaaccagggaaacgcccctaagcctcctgatctataaggctctagtttagaagtgaggtcccagtcaaggttcggcggcaggtggatcgtgggacagaacttcactctcacatcagcagcctgcagcctgatgtattttanactaaacttctttaacncgtaaccaaanagttacgttaatttacggtttttaccgtagggtaaccgttcgggaacccggtagggtaaccgtaggggtacggaacgtaacgtaacccgtaaacggtaacgtcgggttaggaccgttaggaccctaccgtactttccg

SEQ ID NO: 97028 - DNA, 585 bp, Homo sapiens
  misc_feature: GYAE6OF02IGXSS.29.59.F04.1.454.CMB.1.raw
  modified_base (201)..(201): a, c, t, g, unknown or other
  misc_feature (201)..(201): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtnacagagtcaccatcacttgccggcagtcagagtattagtagcgtggttggcctggtatcgagcagaaaccagggaacgcccctaagcctctgatctataaggcgttactagtttaagaaagtgacggtccatcgaaggttcggcggctagtcggatcgtggacagaattcgactctacacatcagcagcctgcacgctgatgattttcgactaactttatacgtcgacctaacgtacgttaattaaacgtttacgttttacccggtaggtaaccggttccgggaaccgtaacggggtaaccggtaagggtaacggtaacgtaacgttaaccgtaaaccgaacggttcggttacgggtaccgtcgtaccgtaccgtaacgttccg

SEQ ID NO: 97029 - DNA, 572 bp, Homo sapiens
  misc_feature: GYAE6OF02FSJTC.29.59.F04.1.454.CMB.1.raw
  modified_base (294)..(294): a, c, t, g, unknown or other
  misc_feature (294)..(294): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
  modified_base (387)..(387): a, c, t, g, unknown or other
  misc_feature (387)..(387): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatcgtgtaggtgacagagtcaccatcacttcgccggcagtcagagtatagtagctggttggcctggtatcagcaacgaaaccagggaaacgcccctaagctccngactctatacggcttctagttagaagtgacggtccatcgaggttcggcgnagtggatcgnggacagtatcactctacactatcagccagtccngacacgcctgtatgttatttcgactacttacttacgtcaacctaacgtaagttaacttagttttaaccggttttcgtacggttaacggttaccggaccgtaacgggtaccgaagggttacggacgtaacgtaacctaaaccggtaagttcggtcggtaccgtagtaccctacccgtagttcccgg

SEQ ID NO: 97030 - DNA, 568 bp, Homo sapiens
  misc_feature: GYAE6OF02GRNBU.29.59.F04.1.454.CMB.1.raw
  modified_base (274)..(274): a, c, t, g, unknown or other
  misc_feature (274)..(274): n is a, c, g, or t
  modified_base (306)..(306): a, c, t, g, unknown or other
  misc_feature (306)..(306): n is a, c, g, or t
  modified_base (386)..(386): a, c, t, g, unknown or other
  misc_feature (386)..(386): n is a, c, g, or t
  modified_base (561)..(561): a, c, t, g, unknown or other
  misc_feature (561)..(561): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatctgtaggtgacagagtcaccatcacttgccggcagtcagatattagtagctggttgcctgtatcagcagaacagggaaacnccccgtaagctcctgactctagtacggtcgtnttagttagaaagtggacgtccatacgtaacggttcggcgcgtagtcggatcgtaggacagtacttcactcctacacctancaaggccagcctcgacacgtccgtgattcgttagttttacgacttaactttacttacgtaccgaacctaagattaagttaacgttacgttttccgaggttaccgttcggaccgtagggaacctacgggtcggaactacgtaaccgtaaacgcgttagtcggactacgacctacgngttaccg

SEQ ID NO: 97031 - DNA, 695 bp, Homo sapiens
  misc_feature: GYAE6OF02H1O54.29.59.F04.1.454.CMB.1.raw
  modified_base (516)..(516): a, c, t, g, unknown or other
  misc_feature (516)..(516): n is a, c, g, or t
  modified_base (635)..(635): a, c, t, g, unknown or other
  misc_feature (635)..(635): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggcctcccaggtcgaccaaatgtgacatccagatcgacccagtcctcccttccactgtgtctgcatctggtaggtgacagacgtcaccatccacgttcggccgggccagtcagtagttattaggtagtcgttgggttggtcctgggtactcgaggacgaacggaaaacccggtaaggggaaacccgtacccctaacggtcctccgtacggacttaccgtaagtaacgggtccgttacgtttaaggtttaaaggaaggtacggtacggtaccctaagtaccggtaacggggtttccgggacggacgtaggtcggtacgttcgggtagggaactagttaactctactcctacaccactcgacgcacgtcgtacgcgacgtctagtntagttactttcgtaacttaactttactactacgtaacctaacgtaagttactttaacgtttaccggtttaccggttaacggttaccgttaccggaccggtaaccggggacgtaacgggngtaaccgtaactaaccgtaaaccgtagtacgggtagtccgtacgacgtaccctgttaccg

SEQ ID NO: 97032 - DNA, 764 bp, Homo sapiens
  misc_feature: GYAE6OF02GLZL6.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgctatctgtaggtgacagacgtcaccatcacttcggccgggccagtcagtagtattagtagtcgtggtggccttggtatcgagacaacggaaaccgaagggaaacgaccccgtaagcctacctgactacgtaagtaacggtcgttacgttaagtttaacgtaaaggtacggacggttacccagtacgtaacgggttcggcggtaccgtaggtggtacgtcgtagggaacgaaggtaacttccgactctaccaacctagtccaagtccacgtccgtcggactaccggtaccttagtaacgttgtttaacgtttacgaactttaaacgtttacttaacccgttacgaaccccgttaaaataacggttttaaaacttaacggttttttaaaccggggttttacccgggttaaacgggtttaccccgggttaaacccggggttaacccgggtaaacggggttaaacccggtaaagggggttaaccggtaaacccgttaaaccgttaaacccggtaaaacggttaacggttcgggtaacggttacccgtacgggtaacccctacggttacctttaccccgg

SEQ ID NO: 97033 - DNA, 681 bp, Homo sapiens
  misc_feature: GYAE6OF02ICAAB.29.59.F04.1.454.CMB.1.raw
  modified_base (134)..(134): a, c, t, g, unknown or other
  misc_feature (134)..(134): n is a, c, g, or t
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
tcagatagagtactcacgaccggtgctcgatttagtacacacacttagggattgggggcaggagtcagacccagtcaggacacagcatggacatggagggtccccgctcagctccgtggggctcctgctgctcnggcctcccgaggtgccaaagtgtgacactccagactgacccagtcctccttccacttgtgtctgcatctgtaggtnacagtacgtccaactntctacgtcggccgggccagtcagtagttattagtagtcgttggtacggccttgtatcgagcgaagaaaccgaggaaactccccgtaagcctactagactttacgaagtaacggtcgttacgttaagtttaaacgaaggttggtaaccgtaccaagtccgtaagggtccggcgactaggtaggtacgtcgtacgggaactaagtacgtcacgtactacgacatacgagtacagtccgtacgctacgtacctagtacgttagttaagttttccgaaacttaacttaacgtttacgtaccgtaaacctaacggtaagttaacgtttaaccgtttaggttttaccccggttaggtaaccggttaccgggaccgtaacgggtacccggtaagggtacggtaacctagtaacccgtaaacgtacggttgaccgtacgttaccaccgtaccctaggttaccg

SEQ ID NO: 97034 - DNA, 621 bp, Homo sapiens
  misc_feature: GYAE6OF02GKTAG.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagacgtcaccatcacttcggcccgggccagtcagtagtattagtagcttggttggcctggtatcgagcaagaaaccgagggaaacgcccctaagctccgtgactcgtaataagggtcgttacttaaggtttaagaagtgacggtcccagtcgtaacgggttcggcggtacgaggtggactcgtagggaactagtaacttcacttctccaacctatccagtcacgtcctgactcgcctggtattgttactttacgacttaaactttattaacctcgtaacctaaacgttagttaactttaacgtttacgttttccggtaggttccgttaccggaccgtaacggggaacgtaaggtacggtaactaacgtaacctaaaccggtacgttggtacggtccgtacggaccctacgtcttaccg

SEQ ID NO: 97035 - DNA, 694 bp, Homo sapiens
  misc_feature: GYAE6OF02I0UP6.29.59.F04.1.454.CMB.1.raw
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctccaggtgccaaatgtgacactccagatcgacccagtcctccttccactgtgtctgcatctgtagtnacgagngtccaccatcgacttcggccggcagtcagagtattagagtcgtggttcggccgtaggtactcgacgacaaacggaaaccgtaaggggaaacctccccgtaaagccctaccgtagtactactaacgtacggtaccgttacgttaagtttaacggaaagtcgtaacggtaccctaagtacggtaacgggtttcggtcgtacgtacggtaggtactccggtaggaactaagtaactcaaccgtctactacactcacggctaacgtcctgaccgacgtaccgtagtactttagttaagttcgaactttaacgttacgtacgtaccgtaacctaagtacgtttaaacttacggttttacgtttaccggtagttaacccggtttacggaacggttaaccgggtaaccgtaaggggttacccgaaattaaccgtaaaccgtaaaccggtagttaccggtacgacgttaaccggacctaaccgtactttcccgg

SEQ ID NO: 97036 - DNA, 475 bp, Homo sapiens
  misc_feature: GYAE6OF02FWNOA.29.59.F04.1.454.CMB.1.raw
  modified_base (243)..(243): a, c, t, g, unknown or other
  misc_feature (243)..(243): n is a, c, g, or t
  modified_base (351)..(351): a, c, t, g, unknown or other
  misc_feature (351)..(351): n is a, c, g, or t
  modified_base (401)..(401): a, c, t, g, unknown or other
  misc_feature (401)..(401): n is a, c, g, or t
  modified_base (441)..(443): a, c, t, g, unknown or other
  misc_feature (441)..(443): n is a, c, g, or t
  modified_base (445)..(475): a, c, t, g, unknown or other
  misc_feature (445)..(475): n is a, c, g, or t
tcagatagagtactcacgaccggtgctcgatttagtacacacacttagggattggggactgtccctgggagttgctggtaccaggatacagaattcttcacaatgttggagctacttccaggacagtccccaaacttctcatttatgacaatagtcagcaccctcagggattcctgaccgattctctgcctccaagtctggctcgtcagccaccgtgggcatcaccggctccagcgtgggacnggccgattatacttgtggacattgggatagcagcctgagtgcttacggcttcggaactgggaccaaggtcaccgtcgtaaggtcacgccctaacggccaaaccccctntcgtaccacgttactcgttccccacccgttcctcgtacgttactcttacncgttcgaggccgggctggccgaaagtccgacgataccgannntnnnnnnnnnnnnnnnnnnnnnnnnnnnnnnn

SEQ ID NO: 97037 - DNA, 595 bp, Homo sapiens
  misc_feature: GYAE6OF02HSDCT.29.59.F04.1.454.CMB.1.raw
  modified_base (398)..(398): a, c, t, g, unknown or other
  misc_feature (398)..(398): n is a, c, g, or t
tcagatagagtactcacgaccggtgctcgatttagtacacacacttagggattgggggcaggagtcagacccagtcagggcacagcatggacatgagggtccccgctcagctcctggggctcctgctgctctggctcccaggtgccaaatgtgacatccagatgacccagtctccttccactgtgtctgcatctgtaggtgacagatcaccatcacttcgccggccagtcagagtattagtagcgttggttggcctggtatcagcaagaaaccgagggaaacgcccctaagctccgtgatctataggcgtacttagttaagaaagtgagtccagtcgaaggttcggcggctaggtggatcgtagggactagacttcactcacacctatcacgcagccngcacgcctgattgtatttgacttaactttattacgtacgtacctaaacgtagttaattaacgtttacgttttaccggtaggtaccgtttacggggaccgtaacggggtaaccgtaaacgggtcggtaactaacgtaaccggaaaaccgttaacgtacgggttacggacgttaccgtaaccgtacccgtagtttaccg

SEQ ID NO: 97038 - DNA, 740 bp, Homo sapiens
  misc_feature: GYAE6OF02H25L5.29.59.F04.1.454.CMB.1.raw
  modified_base (108)..(108): a, c, t, g, unknown or other
  misc_feature (108)..(108): n is a, c, g, or t
  modified_base (214)..(214): a, c, t, g, unknown or other
  misc_feature (214)..(214): n is a, c, g, or t
tcagatagagtactcacgaccggtgctcgatttagtacacacacttagggagttgggggcaggagtcagacccagtcgaggacacagcatggacatgagggtccccgntcagctcctggggctcctgctgctctggcctcccgaggtcgaccaaatgtgacatccagtatcgacccagttcctccttccacgtgtctcgtgcagtctgtaggtnacagacgtcaccatcacgttcggccggtacctaggtccagtagttactagtacgtcgttggttcggtcctaggtatacgaggtaccgaaacggaaaaccggacgggtaaacccctaccccgtaacgtccttcgtacgtacttaccgttaagtaaaccgggttcttaacggttaaggttttaaacgaaacggtcgtaacgtacctagtaccgtaacggggtcggacgtacgtaggtcgtactcggtacgggactaacgtacgttaccacttaccgtacctacctagtaccgagcctacgccgagtccgtacgtctagttacgttagttactttaccgtaacttaacttaccttaacgtacgtaaccttaaagttaacgtttaacgtttacgttttacggtttaccggtacggtaaccggttacggtacccggtaacggtaccggtacggtaacgtaacccgtagttaaacccgaaccgttacggtaccggtacgtaaccgttccgaacccgttccttaccgtttacg

SEQ ID NO: 97039 - DNA, 581 bp, Homo sapiens
  misc_feature: GYAE6OF02G3M0Q.29.59.F04.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccgaggtgccaaatgtgacatccagatgacccagtcctccttccactgtgtctgctatctgtaggtnacagagtccaccatccacttgccgggccagtcagagtattagtagctggttgcgtgtatcagacaagaaaccgaagggaacgacccctaagcctccngtataccgtataacggacgtctaagtttagaaagtgacgtcctaatcgaaacggtgcggngagtgatcgaggacaagtaacgtcactctacacctactcgagctacgccgttcgacacgtctagtactagttacgtttagcctaaactttattacgtacgaccaattaacgttaattaacgttacgtttacggtacggtacggttaccgacgtaacggacgtaacgggtcgtaactacgtaacaacgtaagtaggtggtacctaggactacgtagtaccg

SEQ ID NO: 97040 - DNA, 739 bp, Homo sapiens
  misc_feature: GYAE6OF02IJJUI.29.59.F04.1.454.CMB.1.raw
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (415)..(415): a, c, t, g, unknown or other
  misc_feature (415)..(415): n is a, c, g, or t
tcagatagagtactcacgaccggtgctcgatttagtacacacacttagggagttgggggcaggagtcagacccagtcaggacacagcatggacatggagggtcccccgctcagctccgtggggctcctgctgctctggcctccgaggtcgaccaaagtgcgacactccgagtactcgacccagttccctccttccactgtgtcctgactntcgtagtcgnacagntaccactatactcgtcggccggccagtctaaggagttataggtcgtcgttcggtcggtccgtgtactcgacgacgaacggtaaacggaaggaacccacccgttaagcctactagtactcgtaaacgacggtacgttattaagttaacggtaaggtcgtaccggttaccaggttaccgtaacgggttcggngtaccggtaggtaggtaccgtggtaacggaacagggttacctacctacgtccgaccaacttacgacgtaacgtcgaaccgccgttacggaccgtacggtcgttaacgtacgttaacgttcgttaacgttaaccttacgtttaccttaacggttaaccgtaaccgtaagttaaccgttaaatttaaccgttttacggtttaaccggttacgggttaccgttaaccggtaaccggtaacccgggaacggtaacggtaacggttaactaaccgtaaccgaaaaccggttaggtaccgtttaccggagtcccaacgtactcgttaccg

SEQ ID NO: 97041 - DNA, 859 bp, Homo sapiens
  misc_feature: GYAE6OF02HXIQD.29.59.F04.1.454.CMB.1.raw
  modified_base (250)..(250): a, c, t, g, unknown or other
  misc_feature (250)..(250): n is a, c, g, or t
tcagatagagtactcacgaccggtgctcgatttagtacacacacttagggtagttgggggcaggagtcagacccagtcaggacacagcatggacatgacgggtccccgctcagctccgtggggctccgtgctgctcgtggcctcccgaggtcgaccaaatgtgacagtccagatcgaccagtcctcctccactgtgtctgcagtctggtagtgacgagtagtaccacatacctacgttcggccggaccgngtcgaagtgttaacgttaggtacgtcgtttgggtacgtccgtaggtactacgtacggacggaaccgaaaacgggaaaacgggaacccgtaaccccgtaaacgtccggttacccgtggtaccgtttaacgtaaacggttaaccgggttacccgttaaggttttaagggtttaaagggaaacgggttaggtaaccggttacccgtaaacgttaccgggtaaccgggttccgggggaccgtccgggtaaggttaccggggacgtttacgggacggggtaaaccgttaaaacggttccttaacccgtaacccgttacccgttaccggtaaaccccttacgtaaacccggtacgtaacccggtaccgggtacccgtaccggtaaccggtagtaccccggttaataaccggtttacgtttacgttaccgtaaacgtttaactttaacgtttacgtaacgaaccgttaacgtaacgttaacgtttacgtttaaccggtttacggggtcgttaacccgggttaccggaaccgggtaacggaacgggttaacgggacggttaacctaacggtaaccaaaccggtaagttcggcggtcgaccgtaccgacgtccttacg

SEQ ID NO: 97042 - DNA, 716 bp, Homo sapiens
  misc_feature: GYAE6OF02I5KAA.29.59.F04.1.454.CMB.1.raw
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccgaggtgccaaatgtgacatccagatgacccagtcctccttccactgtcgtctgctatctgtaggtnacngagtcacatcctacgttcgcccgggtacagtcgagtagtacttagtacgtccgtgggttacggccttaggtactacgacgtacgaacgtaaaccgaacgggaaacgacccctaaggtcctcgtaggtactacgtataacggcgttacgttaagttaacgaagtacgtacggtaccctagtacgaaggtttcccgggacggtctaggtacggagttccgttagggactagtaaacgttactaaccgtcgttacgaaccctacgtactaacgctaccggtacccgtgaccgacggcctacggtacttaccgtaattttccggaaacttaccgtttaacttaaccgttcctaaccgtaacacgtttaaacgttaactttaccggggttttacggttaccggttaaccggttcggaacccgggttaaccggaccggttaagggtacgaaacgttacgtaaaccgtaacgaggttaaccgggtacgtcctagggaccctacggttattcccgg

SEQ ID NO: 97043 - DNA, 641 bp, Homo sapiens
  misc_feature: GYAE6OF02GASMV.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatcgacccagtcctccttccactgtcgtctgctatctggtaggtagacaggagtccaacctatccacgttcggccgggccagtcagagttattaggtagtcggtggttgtcgtggtatcagacaacggaaaccggacgggaaacgtaccccgtaagcctccgtagtactactaagtaggtccgttagttagtttaagtaaggtaggtaccggttccagttacgacggttccgggacggcgtacggtggtacgtcggtaggactacgtagttctaccgtcctacaactacgcgaacgcgacgcgtacgactaccgtctagtgtgttatttacgacttaacttcttaccacgtaactagtaagttaacgttaagtttccgggtttccgttacgtccggttacggaccggtacgggtaacgtagggtacgaacctaggtaaccctaaggtacgtcggtggtccaccgtcttaactcgttaccg

SEQ ID NO: 97044 - DNA, 645 bp, Homo sapiens
  misc_feature: GYAE6OF02G1LC0.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgctatctgtaggtgacagagtccacctatccacgttcggcccgggccaggtcagtacgttaattagtagcgtgggttggcctggtatcagcaagaaaccgagggaaacctcccctaagcctcctagactcgtaagtaggtcgttcgttaagtttagaaagtgtacggtacctaagtcggtaaggttcggaggctaggtagtacgtcgtagggacaagtacttccaacgttctacgacctatcgacgcgtacgcctagccgacgtccgtgtaagtgttactttcgaacttactttactacgtacgtaaccctaagtaacgttaagtttacgtttaccgttttacggtacggttaaccggtcgggtaacccgtaacggggtaccgtaagggtacgtaaccgtaacgtaaccgtaacggtacgttcggtacggccgtacggtaccaccgttagttaccg

SEQ ID NO: 97045 - DNA, 807 bp, Homo sapiens
  misc_feature: GYAE6OF02IBTID.29.59.F04.1.454.CMB.1.raw
  modified_base (275)..(275): a, c, t, g, unknown or other
  misc_feature (275)..(275): n is a, c, g, or t
  modified_base (302)..(302): a, c, t, g, unknown or other
  misc_feature (302)..(302): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgttcgtctgcattctgtaggtgacagtagtcaccataccacgttcggcccggcacgtcagagtattagtagtcgtggtcgtccttaggtacncacgacaacgaaaaccgaagggaaccnccccgtaaagccttaccgtactaacgttactaacggtaacgggtacgttaacgttaagtttaacggtaaaggtcggtaacggttacccgtaacgttaccggtaaccggggtttacgggacccgggtacgtaagggtacggtaacggtacgggttacggtaacgtaagtaaactttaccgaccgttcctacgaaccctagtacctaggactacgtccgttacgacgtaccggtaccgtagttacgttaggttaacttttcggaacctttaaaccgttttactaccgttaaccgtaaaccgttaaggtaaacgttaacgtttaaacgttttacccgggttttttacgggaccgggtttaaccgggttaaacccggtaaccgggtaaccggggtaaccctaaagggggttacgttaaccggtaaaccgttaaacccgggaaaacccggtttaaccggtacgggttaccgtaaccggtacctaccccgttaaccgtccgtttaacccgg

SEQ ID NO: 97046 - DNA, 581 bp, Homo sapiens
  misc_feature: GYAE6OF02F0WYP.29.59.F04.1.454.CMB.1.raw
  modified_base (276)..(276): a, c, t, g, unknown or other
  misc_feature (276)..(276): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttcactgtgtctgcatctgtaggtgacagagtcaccatcacgttgccgggcagtcagagtatagtagctggtgcctggtatcagcagaaaccagggaaacnccctaagcctcctgatctagtaaggcgtacttagttagaaagtgacggtccagtcgtaaggttcggcggcgaggtggatcgaggggtacaaggtaacttcactctcaccatacgagacacgcctgactacgcctgattacgttattttcgaacttacttacttacgtactaacctaactagttaattaacgtttacggttttaccggtaggttaccgttaccgggtaccgtacgggaaccgtaacgggtaggaacctaagtaccaaaccggtaattcggtacggtactcgacctactacttccgg

SEQ ID NO: 97047 - DNA, 727 bp, Homo sapiens
  misc_feature: GYAE6OF02I7SLJ.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctcgtggctcccaggtgccaaatgtgacatccagatcgacccagtcctccttccactgtgtctgcattctgtaggtgacaggtatccacctatcctacgttcggcccgggccaggtcaagtagttattaggtagtcgttgggttcggtccgtagggtactcgagaccgaacggaaaccggagggaaaaccgacccccttaagcctaccgtacgtaactacgtaagtacggtacgttacttaaggtttaagaaacggttggaccgtacccgtagttacggtaacgggttcgggacggtagtacggttggacttcggtagggaactacggtacttccacgttactaccgacctacgtcaacgccgtacgtaccgtgaccgacgtccgttagtagttacgtttagtttaaccacgtttaaacgtttaccttacgtacgtaacccgtaagtaacgttaactttaacgggtttacgttttaccggtacggggttaacccggttcggaacccgggttaagggaaacccggtagggttaccgaacgtacgtaaacgtaaccggttagttcgggtacgtaccggtacgacccttaccgtacttacgg

SEQ ID NO: 97048 - DNA, 552 bp, Homo sapiens
  misc_feature: GYAE6OF02G23AF.29.59.F04.1.454.CMB.1.raw
  modified_base (261)..(261): a, c, t, g, unknown or other
  misc_feature (261)..(261): n is a, c, g, or t
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
  modified_base (384)..(384): a, c, t, g, unknown or other
  misc_feature (384)..(384): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccaggtcagagtattagtagctggttggcctggtancagcagaaccagggaacncccgtaagctccngatactataaggcgtctagttagaagtggtacggtccatcgaacgggttcggacgggctaggtaggatacgtagggacagaacttcacttcnctaccatcagcagctgcacgctgatgtatttgacttaacttattaactcgaccctaagtattattaagtttagtttccggtaggttacgttcgggaccgtaacgggtaccgtaagggtcgaacgtagtacgaaaccgtagtcggtacgtccgtagaccgtacagttcg

SEQ ID NO: 97049 - DNA, 674 bp, Homo sapiens
  misc_feature: GYAE6OF02I7LES.29.59.F04.1.454.CMB.1.raw
  modified_base (289)..(289): a, c, t, g, unknown or other
  misc_feature (289)..(289): n is a, c, g, or t
  modified_base (469)..(469): a, c, t, g, unknown or other
  misc_feature (469)..(469): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtcgtctgcatctgtaggtgacagagtcacatcacttgccggcagtcagagtatagtagctggttggcctggtatcgatcagaaaccagggaacgccctaagctccngtactacgtaagaagcgttacttagttaagtaagtacggtacggtacccaagttacgtaaacgggttcggaccggtacgtagggttaggtaaccgttcgggtaacgggaacgtaacggtaaactttacctaccgtaccttacccaacgtaaccgttacaacgtccgaacgtcctcgaacncgtaccgtgtattagttatttacgaacttaacttacttccaagtaacaaccgttaagttaaaccttaaggttttccgttttaaccgggtacggttaccgttaccggggtaaccgacgggtaaccggtaagggtacggtaacctactaaacgggaaccttaaacggtaggtaccgggtacgtaccgaaccgtaaccgttcggttac

SEQ ID NO: 97050 - DNA, 536 bp, Homo sapiens
  misc_feature: GYAE6OF02G8E41.29.59.F04.1.454.CMB.1.raw
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatcgacccagtcctccttccactgtgtctgcatctgtaggtgacagctcacatcacttcgccggcagtcagagtattagtagctggttggtcctggtatcagcaagaaaccgaggaaacgcccctaagtcctacctgactactaagtacggtctacgttagttaagaagtgacgtccatcgtaacggtcggngacaggngagtcgngacagtactcactcacacntcancacnctgcacgctgacttntattnactacttatcacacaatagttaacttaagtttcgtttacggtcggtacgttccggaacgacggaaccgtaggtacgactagtaaccgaacgtacgttcgacggtctacgcctaccagttccg

SEQ ID NO: 97051 - DNA, 776 bp, Homo sapiens
  misc_feature: GYAE6OF02FY32I.29.59.F04.1.454.CMB.1.raw
  modified_base (205)..(205): a, c, t, g, unknown or other
  misc_feature (205)..(205): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcactctggtagggtanacgaagacgtcaaccgtatcacgttcgggcccggcacggtcaggtagttattagtacgtcgttgggttcggccttagggtactacgaacggtaccaaacggtaaaacccgggaaggggtaaaacccgtaccccgtaaaacggtccgttacccgtaagtaacttacgttaaacgtaacggggtccgtttaacgtttaacgggtttaaagtaaacggggttcgtaaccggttaccccgtaagttacccgggtaaacggggtttccgggacggtaccgtaggggtacggtacgtaccggtagggtaactaacgttaattaccgacttaccgtaccgaacctacggtactacggaacgtccgtccgtacgaccgtaaccggtccttaggtacttaggtttacctttacgtaactttaactttaacttacgtactaaccgtaactaagtttaaacttacgttttacggttccgtacggttaccgtaccgggtacgacgggtaacgtaacgggtacgaacctaagaaccgttaacggtacgttacggcggtaccgtacgacgtacccgtattacccg

SEQ ID NO: 97052 - DNA, 755 bp, Homo sapiens
  misc_feature: GYAE6OF02HBSK2.29.59.F04.1.454.CMB.1.raw
  modified_base (106)..(106): a, c, t, g, unknown or other
  misc_feature (106)..(106): n is a, c, g, or t
tcagatagagtactcacgaccggtgctcgatttagtacacacacttagggattgggggcaggagtcagacccagtcaggacacagcatggacatgagggtccccgntcagctccgtggggctcctgctgctctggctcccgaggtgccaaatgtgacatccagatgacccagtcctccttccgactgtcgtctagctagtcgtgtaggtcacagacgtccacatcacgttcggccggcagtcagtacgttagttagtacgcgttgggttcggtaccgttggtactacgaggtaccgaaacggaaaaccgtaggggaaacccgtacccccgttaaaggccttaccggtagtaacttcgtaagtaacggtccgttaacgtttaacggttttaaggaaacgttacggaccggttaccctaagttaccggaaacgggtttccgggaaccggacgttaagggtcggtacttcggacgggtaaccaagggttaactttacccgattacccgtacgtaaccgtacgtacgtaaccggcgtaaccgtcgtaacggaccgacgtaccgtagtacgtttacgttactttacggaactttaacgtttaactaccgtacgtaacccgtaatacgttaacttaacgtttcgtttaccggtacggttaccggtaccggtaaccggaacgggttaccgaagggttaccgaactaaccggtacgtaaacgtcggtacggtacgtacctaccggtaccgtaccttagttccg

SEQ ID NO: 97053 - DNA, 748 bp, Homo sapiens
  misc_feature: GYAE6OF02JR02H.29.59.F04.1.454.CMB.1.raw
  modified_base (157)..(157): a, c, t, g, unknown or other
  misc_feature (157)..(157): n is a, c, g, or t
  modified_base (160)..(160): a, c, t, g, unknown or other
  misc_feature (160)..(160): n is a, c, g, or t
  modified_base (167)..(167): a, c, t, g, unknown or other
  misc_feature (167)..(167): n is a, c, g, or t
  modified_base (174)..(174): a, c, t, g, unknown or other
  misc_feature (174)..(174): n is a, c, g, or t
  modified_base (190)..(190): a, c, t, g, unknown or other
  misc_feature (190)..(190): n is a, c, g, or t
  modified_base (516)..(516): a, c, t, g, unknown or other
  misc_feature (516)..(516): n is a, c, g, or t
  modified_base (547)..(547): a, c, t, g, unknown or other
  misc_feature (547)..(547): n is a, c, g, or t
tcagatagagtactcacgaccggtgctcgatttagtacacacacttagggagttgggggcgaggagtcacgaccagtcaggacacagcatggacatgagggtccccgctcagctccgtggggctccgtgctgctctggcctccaggtcgccaaatgnganatccagntgacccntctccttccactggtntctgacacttcgtggttaggtacgacgtaaggtgtaccaccctattaccgtactttccgggccccggccgtaacgtccgaagtaagttacttaggtacgcgttgggttcgggacctttagggtattcccgaaggaccttaaacggaaaacccggaaggggaaacccgcccccgtaaacgtccgtacttaggacttaacgtacgtaaagggtccttaacgtttaagttaacggaaacgttcgggacttacccgaattacggtaacggggtttccggacgtacgtacggttaggtaaccttcgaggggaaccctaggtaacccctttnaccgttaccgacctaacgtatacgaccggtnaaccgttctagccgactcgtatacgtgttacttcgtaacttaccgtttatacggttcaccgtacgtaattacgtacgttacgtttacggtcggtaacggtcgaacggtagggtaccgtaagggtcccgtaacggttaactaaccggttaacccgtaggtttacggtcggttaaaccgtcggaccctacggttacttccggg

SEQ ID NO: 97054 - DNA, 671 bp, Homo sapiens
  misc_feature: GYAE6OF02G4N46.29.59.F04.1.454.CMB.1.raw
  modified_base (467)..(467): a, c, t, g, unknown or other
  misc_feature (467)..(467): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccgaggtgaccaaatgtgacataccagatgacccagttccttcccttccacttggtgtcctgcatcgtaggtaggtgacgagtacgtaccacctatcctacgttcggcccgggcagtcagtagttagttaggtagtcgttggtacggtccgtggttactcgagacaacggaaaccggagggaaacctaccccgtaagccttaccgtagacttacgtaaggtagtcgttagttaaggttagaagtcggtacggtacctagtacggtacgggtcggacgaggtagtaggcttcggagggactagtaacttccgactcctacaccagtccgancgtacgcgtgacgacgtcgtagtacttagttacttagactttaacttacgtcgtaactaccgtaagtaagtttaacttacgtttacggtttccggtacggttaccggtaccgaaccggtacgggtacgttaagggaccgtaacgaacgtaaccgaaaccggttagtacggttacggtacctacggacccttaacgtcgttaccg

SEQ ID NO: 97055 - DNA, 791 bp, Homo sapiens
  misc_feature: GYAE6OF02HIP0K.29.59.F04.1.454.CMB.1.raw
tcagatagagtactcacgaccggtgctcgatttagtacacacacttagggattgggggcaggagtcagacccagtcaggacacagcatggacatgaggtccccgctcagctcctgggctcctgctgctctggctcccaggtgaccaaatgtgacatccagatgacccagtctccttccactgtgtctgcatctgtaggtgacagagtcacctatcacgttcgcccggcagtcagtagtattagtagtcgtggttcggcctggtatcgacgtacaacggaaaacccgtaaggggaaaacccgtacccccgtaaagcccttaccgtaggtacttacgttaacgtaacggtcggttaacgttaacggtttaacggaaagttcggtaaccggtacccctaagttaccggtaaacgggtttccgggacggtaccgtaggtacggtacgttaccggtaacggggaactaacggtaaactttaccgtaccttaccgtacccgtaacctacgtacgacgtacgaccggtcctacggaccgtaccggtacctaggtacgtttcggttaagttttaccgaactttaaaccgtttagttaacccgttacgaacccgttaacgtaagtttaacgtttaacgttttaccgggttttacccggtaacgggtttacccggttacgggtaaacccgggtaaccgggtaaccggttaaccgggtacggtaacccgtaaacgttaaacccgttaaaccggtaacgttacggtacggaccgttaccgaaccgttacccgtacttacccgg

SEQ ID NO: 97056 - DNA, 775 bp, Homo sapiens
  misc_feature: GYAE6OF02GZDBX.29.59.F04.1.454.CMB.1.raw
  modified_base (142)..(142): a, c, t, g, unknown or other
  misc_feature (142)..(142): n is a, c, g, or t
tcagatagagtactcacgaccggtgctcgatttagtacacacacttagggattgggggcaggagtcagacccagtcaggacacagcatggacatgagggtccccgctcagctcctgggctcctgctgctctggctccaggtnaccaaatgtgactatccagatcggaccctagtctcccttccactgtgtctagcatcgtgtaggtcacgaggtacgtaccacctagtctaccgttcggcccgggacctagtcgtaaggagttaagttaggtagtcgttggttcggtccgttacggttagtcgaacggacaacggaaaaccgaacggggaaaccgttacccccaaaggtcccgtaaccgtgtaacttacgtaacggtaaggtcgttacgttaacgtttaaaggaacggttacggtaaccggtaccttactaacgggtaaccggggtttccgggaccgggtagtacggtacggggtaacgttaccggtagggaaccgtaagttaacggttaccttacgtaccctacgttaacccgaactacggaacgtacgtaccgtacccttaggaccgtacgtccgtaggttaacgttacggttatttacggtaactttaactttagttaaccgtaccgtaaccgtaacgtaagtttaaccgtttaaagtttccgtttaacgggttccgtaaccggttaccgtaaccgggtaacggtagtaacggtacggtaacgtacgttaaccgaaacggttagtacggtcgtcgtaccgcgtacttgtacc

SEQ ID NO: 97057 - DNA, 795 bp, Homo sapiens
  misc_feature: GYAE6OF02IHHQW.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggcctcccaggtgccaaatgtgacatccagatcgacccagtcctccttccactgtgtctgcatctggtaggtgacagacgtaccacctactccgacgttcggcccgggtaccaggtccaaggtagttatttaaggtaggtccgttagggttcgggcccttaggttactacgagacgtaaacggaaaacccgtaaggggaaaccgtacccccgttaaggccttcccgtagtacttacgtaagttaacggcgttacttaaggttttaagaaacggttcggtacggtaccctaagttaccggaaagggtttcccggggacggactagggttcggacgttcggtacggggaactaaggttaacttacctaccgttactaccgtaacctaacgttccgaacgtccgtacggtcccgtacggaccgtaccggtaccgttacggttaacgtttacgtttaacgtttttacgacctttaaagttttaaccgttaacgttccggtaaaccctaaagttaacgtttaatttaaacggttttaccggtttttaccgggtacggttaaccgggtttaccgggacggtaaccggggtaccgtaaggggtcggtaacctaacgtaaccgaaacggtacgttcggtacggtccctacggtacctaccgtacgttaccg

SEQ ID NO: 97058 - DNA, 714 bp, Homo sapiens
  misc_feature: GYAE6OF02GZD4V.29.59.F04.1.454.CMB.1.raw
  modified_base (206)..(206): a, c, t, g, unknown or other
  misc_feature (206)..(206): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtcctccttccactgtgtctgcatctgtagtgacagntcacatcacttgccggcagtcagagtattagtagctggttcgcctggtatcagcaagaaaccgagggaacgcccctaagtcctccgtagactactaagtaacggtcgttacgttaagtttaagaaaggttacggtacggtaccctaagttaccggtaaacgggtttccgggaccggtaccgtaggttacgggtacgttacgtaggggaaactaaggtaactttccaacgttccaccaacctactacgtaacgcgtaacgtccgtacgaccacgtccgttagtacttacgttagttttacgaaccttaaacttttacgttacgtacgtaacccgtaaagttaacgtttaatttaacgtttaacgggtttttccggacggttaaccgggtttacccggaaccgggttaacgggaaccgttaaaggggtcgtaaaccgttaacggtaacccgtaaaacgttaccggttacgtacgggtacctaaccggtcccgtaacgttacgttacccgg

SEQ ID NO: 97059 - DNA, 609 bp, Homo sapiens
  misc_feature: GYAE6OF02F65VB.29.59.F04.1.454.CMB.1.raw
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcacatcacttgccgggcagtcagagtatagtagctggttggcctggtatcgagacacgaaacctagggaaacgcccctaagctcctgatctaataaggcgtactagttagaaagtgaggtccatcgaggtcgcggnagtggatcgnggganagtatacactctcaccatcagccacgccgtcgcacgcctgattgtatttgacgtaaactttattacctacgacctaaacgtaagttaatttaacgttttaacgggttttccggttacgggttaacccggtttaccgggaccggtaaaggggtaacccgtaaggggttaaccgggaactaaccgttaaaccgaaaaccgggttaacgttagggttacgggtaccttcgggaaccctaccgttattacccgg

SEQ ID NO: 97060 - DNA, 792 bp, Homo sapiens
  misc_feature: GYAE6OF02HXTZ6.29.59.F04.1.454.CMB.1.raw
  modified_base (202)..(202): a, c, t, g, unknown or other
  misc_feature (202)..(202): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggcctcccaggtgaccaaatgtgacatccagatgacccagtctccttcactgtgtctgcatctgtaggtnacagagcacatcacttgccggcagtcagtagtattagtagcgtggtcggtcctggtatacgagcgaacggtaaaccgaagggaaacgacccccgtaaagtccttaccgtaggacttcgtaacgtaacgggtccgtttacgttaaggtttaacgtaaaggttcgggtaacggtccccgtaaataccggtaaacggggtttccgggacggtacgtaacgggttacggtacgttacggtacggggaaaccgtaaacggtaaattttcccggaaccttaccgtaccgtaacccgtagtaccgacgggtacctaacggcccgttacgaccgtaacggtcccgttaacgtaacgtttcggtttactttttacgggaaccttttaaaaccttttacgtttaacgtaccggtaaccctaaagttaagttaaacttaacggtttttaccggtttttaccggtacgggttaaccggttttaccgggtaccggaaacgggggttaaccctaaacgggggtacgtaaccgtaaacgttaaacccgtaaaacggtaccgtttagggtaccgggtaccttaaccggaccttaccggaacttcgg

SEQ ID NO: 97061 - DNA, 762 bp, Homo sapiens
  misc_feature: GYAE6OF02IWS1K.29.59.F04.1.454.CMB.1.raw
tcagatagagtactcacgaccggtgctcgatttagtacacacacttagggagttgggggcaggagtcagacccagtcaggacacagcatggacatgagggtccccgctcagctcctggggctcctgctgctctggctcccaggtgccaatgtgacatccagatgaccctagtctccttccactgtgtctgcatcgtggtaggtgacagtacgtcaaccatcacgttcggccggccagtcagtagttacgttaagtagcgttgggttcggtcgtaggtactcgacgacgaacgaaaccgagggtaaccaccccgtaagcctaccgtgactacgtaacgtaacggtcgtacttaagttaacgtaagtaggtacggtaccagtaccggtaacgggtcggtacggaccgtaggtaggattacggacggtaacaacggtaagttacccaacgttaccaccgaacctaacgttacgaacgactaacgtaccgttcggaaccgacgtccgtaacggttaagttactttacgttacgtaaaccttaaactttaaccgttacgtaaaccgttaaaccgaaacccgttaacgttaaacgtttaacggttttaacccgggtttacccggttttaacggtaacccgggtttaccggaaacccgggtaaaccgggtaacggtaacggggtaacgtaaccggtaaaacggttaacccgaaaacggtttaaccgttaggttaaccggtacgttaaccgggactacccgtacgttccg

SEQ ID NO: 97062 - DNA, 863 bp, Homo sapiens
  misc_feature: GYAE6OF02I22SC.29.59.F04.1.454.CMB.1.raw
tcagatagagtactcacgaccggtgctcgatttagtacacacacttagggattgggggcaggagtcagacccagtcaggacacagcatggacatgagggtccccgctcagcctcctggggctcctgctgctcgtggctcccgaggtcaccaaagtgtgacatccagatcgacccagtctccttaccactggtgtctgctatcgtgtaggtcgacgtagacgtccaactatctacgttcggcccggactagtcaagtagttattacgtagtccgttaggttcggaccgttggtactcgtaggaaccgtaacggaaaacccggaacggggtaaacccggtaacccctaacggacccgttaccgtacggtacttaacgttaacggtaaccggtacgtttaaccgttaaaggtttaaggaaacggttaggtaaccggttacccacgttaacggtaacggggtttaccgggaccggtacgtacgggtacggtagtacggtaggggtaactaaggttaaccttacgtacttccgaaccaacctacgtacgacggtaccgtaccgtccgtacgaccgtacgtaccgtagtaagttcgtttaacgtttacgtaacgttaaccgttttacgttaccgtaccggttaaccgtaaacgtttaacggtttaaactttaaccggtttaaccgggtttttaaccgggtacggtttaaacccgggttaaccggggtaaccgttaaaccggggtaaccgggttaaacgggttcgggttaaaaccgttaacccggtaaaaccggtaaaacccgggttaacggttacgggttaccgggtaaccttacccgggtaacccgttaaccgttaccgtttaaccgg

SEQ ID NO: 97063 - DNA, 752 bp, Homo sapiens
  misc_feature: GYAE6OF02GEAJ1.29.59.F04.1.454.CMB.1.raw
  modified_base (345)..(345): a, c, t, g, unknown or other
  misc_feature (345)..(345): n is a, c, g, or t
tcagatagagtactcacgaccggtgctcgatttagtacacacacttagggagttgggggcaggagtcagacccagtcaggacacagcatggacatgagggtcccgctcagctctggggcctcctgctgctctcggcctccaggtcgaccaaatggtagacagtccagactcgaccctagtcctaccttccacgtgtgtcctacggctattcgttaggttaggtcaacgtagacgtccaccagttcctacgttcggcccgggtacagtacaacgtaggttacttaggactcgttgggttcggctaggtactcgagtacaacgaaaccgagggaaacctccgtaacncctccttagactataacggtacgacgtttacgttaggttaacggaaacggtggtaaccggtaccgttaagtaaccggggttaaggggtcccggacggtagtaaccgggttggtaccggttacgggtaaggaacccgttaagttaacccgtttaccaccgtttaccgtacccgtaaacgcctaacggtaaccgcgtaccggtaccgcggtaaccgacgtacccggtagttacgttaggtttacttagtaacttaaccgtttataccgtacgtaactacgtaagttaacttacggtttacgtttccgtacggttaccggtacggtaacccgtaggtaccggtacggtaagtaccgtaactaaaccgacggttaggaccgttggtaccgacgtacctaccggtattccgg

SEQ ID NO: 97064 - DNA, 724 bp, Homo sapiens
  misc_feature: GYAE6OF02HVRPM.29.59.F04.1.454.CMB.1.raw
  modified_base (208)..(208): a, c, t, g, unknown or other
  misc_feature (208)..(208): n is a, c, g, or t
tcagatagagtactcacgaccggtgctcgatttagtacacacacttagggattgggggcaggagtcagacccagtcaggacacagcatggacatgagggtccccgctcagctccgtggggctcctgctgctctggcctcccaggtgaccaaatgtgacatccagatcgaccagtcctccttccgactgtgtctagcatcgtgtaggtnacgagagtccacatcacgttcggccggaccagtccagtagttagttacgtagtcgttggtcggtacgtggtactcgagacaacggaaaccggagggaaaccctcccgtaagccttaccgagtacttctaagtaacggtcgttacttaggttaacggaaaggttggaacggtaccctaagtacggtaacggggtccggtacggacggtaaggtcggaacttcggacggggtaaactacgttaattccgaccttccgtacaccgtatacgacggcgtacgcgtagccgtacgtccgtagacgttacgttactttaccgtaacgttaactttacggtactaccgtacctaaagttaagtttaccgtttaacgttttaccgggtttccgggtacggttacccgggttaccgggtaaccgggaaccgggttaacggtaaccggttaacgggtaacccaacgttaaccgaaaccggtacgttcgggtacggtaaccgtccggaaccctaccgttattaccgg

SEQ ID NO: 97065 - DNA, 850 bp, Homo sapiens
  misc_feature: GYAE6OF02IJLWT.29.59.F04.1.454.CMB.1.raw
  modified_base (242)..(242): a, c, t, g, unknown or other
  misc_feature (242)..(242): n is a, c, g, or t
  modified_base (845)..(845): a, c, t, g, unknown or other
  misc_feature (845)..(845): n is a, c, g, or t
tcagatagagtactcacgaccggtgctcgatttagtacacacacttagggtaggtttggggggggacaggagtcagacccgtaccgtcgaggtacaacgagcagtcgacatgacggtcccgctcacgtcgtcctaggggctcctcgctcgctactcgctcccgaggtcgaccgaaatggtcgacctagtccagactcgaccctgtccttccttcacgtgtcgtctgcctattcctgtacggnacgacgtacgtaccactacttacctacgttcggacccgggtaccctaagttccgacggttaagttaacgttaggtacgttcggttacgggttccggtaccggttacggtaacgtaccgacgaccgaaacggtaaaccggtaacggtaacccgtaccccgttaacgtcccgttaccgtagtaaccgttacgttaaggtaacggttccgttaacgttaaggtttaacggtaacggtccggtaccggtaccctaacgtaccggttaacggggttaccgggacggtacgtacgggtcggtaacggtcggtacggtaactacgttaacctcctaccttacctacctaccgtacgtacgaacgaccgtacgtaccgtcgtaccgtacgttacgttacgttaacgttttaacgttactttaccgttacgttaaacttacgttaaccgtacctaaccgttacgttaaacgtttaacgtttaacggtttccggtttacccggtacggttaccggtaaccggtaacgggtaccgggaacgttaacggtaacgtaacctaaaccgtaacggtaaccggtaggtccggtaccggtaccgacgtaccgtaccgttnttccg

SEQ ID NO: 97066 - DNA, 582 bp, Homo sapiens
  misc_feature: GYAE6OF02GNDQ8.29.59.F04.1.454.CMB.1.raw
  modified_base (394)..(394): a, c, t, g, unknown or other
  misc_feature (394)..(394): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggcagtcagagtattagtagctggtggcctggtatcagcagaaaccgagggaacgccccgtaagctccgtagatactagtaggcgtcgtagttaagaagtgacgtccatcgaaggttcggcgcgagtgagtcgtggacagtatcactctacacctatcagcagtcctgacncgccgtagatgttatttgacttaactttatactcgacctaactagttaattaacgtttacggttttaccggtacggttaaccggttccgggaacccgtaacgggtaccgtaaggggttacggtaaccgtaacgtaaccgaaaccggtaacgttcgggtacggccttacggaccctaccgtattacccg

SEQ ID NO: 97067 - DNA, 689 bp, Homo sapiens
  misc_feature: GYAE6OF02JNM87.29.59.F04.1.454.CMB.1.raw
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (267)..(267): a, c, t, g, unknown or other
  misc_feature (267)..(267): n is a, c, g, or t
tcagatagagtactcacgaccggtgctcgatttagtacacacacttaggattgggggcaggagtcagacccagtcaggacacagcatggacatgagggtccccgctcagctccgtggggctccctgctgctcgtggcctcccaggtcgccaaagtgtagacatccagatcgacccagtctccttccactgtgtctgcatctgtaggtgacagngtcacntcactgccggcagtnagtgtatagtagcgtggttgcctggtactcagnaacgaaccgaaggaaccgccctaagcctaccgtgtactacgtagtaaggtccgttattaagtttaagaaggtgtacggtaccagttacgtaaggttcggacgacgtaggtaggtactcgaagggtacgtaaagtactctactcctacgaacctagtacgacgtaccacgtccgtaggacctacgtaccgtggttaacgtggtttaaactttcgtaaaccgtttaacctttacgttaacctccgtaacccgtaaagttacgttaaacgtttaactttaccgggttttaccgtacgggtttaacccgttaccgggtaaccgtaacgggttaaccggtaacgggttaaccgggtaaaccttaacggttaaacccgaaacgttacccgtaggttaccggcctacgggtaaccctagtaccgttacg

SEQ ID NO: 97068 - DNA, 765 bp, Homo sapiens
  misc_feature: GYAE6OF02GOBVH.29.59.F04.1.454.CMB.1.raw
  modified_base (107)..(107): a, c, t, g, unknown or other
  misc_feature (107)..(107): n is a, c, g, or t
  modified_base (209)..(209): a, c, t, g, unknown or other
  misc_feature (209)..(209): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (475)..(475): a, c, t, g, unknown or other
  misc_feature (475)..(475): n is a, c, g, or t
tcagatagagtactcacgaccggtgctcgatttagtacacacacttagggagttgggggcaggagtcagacccagtcaggacacagcatggacatgagggtccccgntcagctcctggggctcctgctgctctggctcccgaggtgcctaaatgtgactatccagatcgaccctagtcctccttcactgtcgtctgcatctaggtaggnacagactcaccatcacttcggccggcagtcagagtattagngntggttggcctggtactcgagtacgaaggaaaccgagggaaacctaccccgtaaggtcctaccgtaggtaacctacgtaacggtaacggtcgttacgttaagggtttaacgaaggttacgaccggtaccctaagttaccggtaagggttccgggaccggttacgtaggtacggactacgggtagggaactaaggttaacttccgaacttccgtaccaccgtaanccgaagccgacgtcctacgactaccgtcgtagtaacttcggttaactttacggaaccttacgtttaacgtaaccgttacgaaccgttaaacgtaagtttaaactttaacggttttaccggggttttaacccgtaacgggttaacccgggttaccgggaaaccggttaaccgggggtaacctaaaccgggggtcggttaaaccgtaaccggttaaacccgttaaacgggttaacccgttacggggtaaccggtccggttaacctaacccggttaacctacccggtttaccg

SEQ ID NO: 97069 - DNA, 775 bp, Homo sapiens
  misc_feature: GYAE6OF02FXUWO.29.59.F04.1.454.CMB.1.raw
  modified_base (231)..(231): a, c, t, g, unknown or other
  misc_feature (231)..(231): n is a, c, g, or t
tcagatagagtactcacgaccggtgctcgatttagtacacacacttagggagttgggggcaggagtcagacccagtcaggacacagcatggacatggagggtccccgctcgagctcctggggctcctgctgctctggctcccgaggtgaccaaatgtagacatccagatgaacccagtcctccttccactgtcgtctgctattctacgtaggtcacaggacgtccaaccgntaccacgttcggccggtaccagtcaagtaggttaacttaaggtacggtccttggggttcggacccttagggttaactccgaaggtacaaacggtaaaaaccgtaggggaaaaccctcccccgtaaagtccgtaccgttcggaattaccgttaaagaacggggtccgtaagtttaacggtttaagaaaggttacggtaacggttaccccaagtacgtaacgggttcgggacggtacagggttgactcggagggaacagtaaacttctaacgtcctacactaacgtcgacgacaacgtaccgtacgtccgaacgtccgaggttaactggtttacgtttacctaacgttaaccttttaacttaacggtaccgtaaacccgtaagtacgttaaaacgttacgttttacgggtttacccggttagggtaccgtttaccgggaaaccgggttaccgggaaccggttaagggtaccgggtaataaccggttaacgaaacccggttaactcgggttacgggaccttaccggactaacccgtagtttaacccg

SEQ ID NO: 97070 - DNA, 688 bp, Homo sapiens
  misc_feature: GYAE6OF02H4LJQ.29.59.F04.1.454.CMB.1.raw
  modified_base (261)..(261): a, c, t, g, unknown or other
  misc_feature (261)..(261): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccaggtgccaaatgtgacatccagatgacccagtctccatcatccctgtctgcatctgtcggagacagaactcactattacttcgccgacagtcacgacaataaacctacttttaaatgtactnagacaacaacgagggaacgacccaagcctactgactcgatgctgacactacctaatttaggagtacggtcgggtaccctacgtaccgtaggttcgtaggtcggacgtagtacggtagtacggtaagggtaacttaaagtttcctaccgtttaccaccgtaccctagtaccgacgtctaacgtctacgacctaaccgtagtaagttacttttagaaccttaacctttactagttactaacgtaacgtaagttaaccgttacgttagtttaaccttttcccgtttacgtaacccggttttccgggtaccccggttaacgggtaacccgttaacggttaccgtaacgtttaaccgtaaaccgtaaacggttaaccgttggggttaccggtccgtaaccgtaccgtaaccccgttagttccgtttaaccgg

SEQ ID NO: 97071 - DNA, 653 bp, Homo sapiens
  misc_feature: GYAE6OF02JW542.29.59.F04.1.454.CMB.1.raw
  modified_base (139)..(139): a, c, t, g, unknown or other
  misc_feature (139)..(139): n is a, c, g, or t
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (371)..(371): a, c, t, g, unknown or other
  misc_feature (371)..(371): n is a, c, g, or t
tcagatagagtactcacgaccggtgctcgatttagtacacacacttagggattgggggcaggagtcagacccagtcaggacacagcatggacatgagggtccccgctcagctcctgggctcctgctgctctggctcccnggtgaccaaatgtgacatccagatcgacccagtctccttcactgtgtctgctatctaggtaggtnacgagtctccaccatcgacttcggcccggacagtcagtagtntagtatcgtgtcgctgctnagcagaaaccgaggaacgtcccaaggtcctaccgtagtacgtactaagtaccgtcgttacttaaggttagaaacgttggtaccgtacctagtacgtagggttccgnggtactaggtcgtactcggtaggactaagtaaccgtcacgtcctacgtacatcacgtccgacggtcgacggtacacggtacctaggtagttacgttacgtttaccgtactttaaccgttacgttaaccgtaccggtactaaaccgttaggttaacttaacgttttacggtttacgtaccggttacgttaccgtaggtaaccggtaccgtagggtactaccggtaactaaccggtaaaggttaccgtaggttaccggtactaccggtactaccgtacgttacg

SEQ ID NO: 97072 - DNA, 567 bp, Homo sapiens
  misc_feature: GYAE6OF02IVVWB.29.59.F04.1.454.CMB.1.raw
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (283)..(283): a, c, t, g, unknown or other
  misc_feature (283)..(283): n is a, c, g, or t
tcagatagagtactcacgaccggtgctcgatttagtacacacacttagggattgggggcaggagtcagacccagtcaggacacagcatggacatgagggtccccgctcagctcctgggctcctgctgctctggctcccaggtgccaaatgtgacatccagatgacccagtctccttccactgtgtctgcatctagtggtnacngagtcaccattcacttaggccggtccagtcaggagtattagtagctggttggcctggtatcagcaggaacagggtaaacncccgtaagctacccgtgactactacgtaacggctcgtagttttagaaagttagacggtccattacgaaggtttcggcggcaggtcggattcgtaggaccagtaacgtctactctccacctatacagtacaacggcctaggccagtaccgtagacgttgattttacgacctaacctatttactgtaccgtaacagtaataagttacgttttccgaggtacgtcgacgaggtacgtaggtggtacaacgtacaacgtaccgtagtacggcctaggactacactacg

SEQ ID NO: 97073 - DNA, 710 bp, Homo sapiens
  misc_feature: GYAE6OF02G4FE5.29.59.F04.1.454.CMB.1.raw
tcagatagagtactcacgaccggtgctcgatttagtacacacacttagggattgggggcaggagtcagacccagtcaggacacagcatggacatgagggtccccgctcagctcctggggctcctgctgctctggctcccaggtgaccaaatgtgacatccagatcgaccctagtcctcccttccactgtgtctgcatcgtgtaggtgacagtagtccacatcacgttcggcccgggccaggtcaggtagttattagtagtcgttgggttcgcctaggtatcgagaccaacggaaaccgaaggggaaaccgccccgtaagtcctaccgtagtaacttacgtaacgtaacgggtcgttacgttaaggtttaaggaaagtcggtaccggtaccctaagttacgtaacggggttcgggcggacgtaggtcggattacggtagggaactaaggtaacttcctacgttcctaccaacctacgtccgaacgccgtaacgtccgtacgaccgtacgccgttagtacgttgtttaacgttttcggacctttaaactttacgttacctacgtaaccctaaacgtaagtttaacgttaacgtttacggttttaccggtacggtaccgtttaccgggaccggtaagggtacccgtagggtacggaactaacgtaacggtaaacgtagttacggacggtaccgtacgaccgtacctacttccg

SEQ ID NO: 97074 - DNA, 816 bp, Homo sapiens
  misc_feature: GYAE6OF02F2V50.29.59.F04.1.454.CMB.1.raw
  modified_base (209)..(209): a, c, t, g, unknown or other
  misc_feature (209)..(209): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggctcccgaggtgaccaaatgtgacatccagatcgacccagtcctccttccactgtcgtctgcacttcgtgtaggtnacagacgtaccaccactctacgttcggcccggtacacgtacagtaacgtttagttagtacggtcgttcgggttcggccgttaggttacctcgaacggtaccgaaacggaaaaccggaacgggtaaaaccgacccccgtaaagtcccttaccgtagtacttaacgttaagtaacggtccgtttacgttaaggtttaaacggtaaggtacggtaccggtacctaacgttaccggtaaacggggttccggaccggtaacggtggttaacggtacttcgggaagggaacttaaacggtaccgtttaccacgttaccgtaaccgtaacctacgtaccgtacaccgtacgtaccgtcgaccggtacgtacgtagtacgttgtttaacgttacgtaacctttaaccgttttaccgtaccgttaacaacccgttaaacgttaacggtttaactttaacggtttaccggttttaccgggtacgggtttacccggttaccggggtaacccgtaacgggtaaccggtaacgggttaaccggtaacgttaaacgtaaacccgttaacggtaaccgttgggtaaccggtccgtaacgtccggtaaccttaccggttccgg

SEQ ID NO: 97075 - DNA, 787 bp, Homo sapiens
  misc_feature: GYAE6OF02FO3LA.29.59.F04.1.454.CMB.1.raw
  modified_base (779)..(779): a, c, t, g, unknown or other
  misc_feature (779)..(779): n is a, c, g, or t
tcagatagagtactcacgaccggtgctcgatttagtacacacacttagggattgggggcaggagtcagacccagtcaggacacagcatggacatgagggtccccgctcagctccgtggggctcctgctgctctggctcccaggtgaccaaatgtgacatccagatcgacccagtctccgtccactgtcgtctgctatcgtaggtaggtgacagacgtcacctatctacgttcgccggacagtcgagtacgttatagtcgtcgtggtcggtacgttggtatcgagacgtaacggaaacggaacggtaaaccgtccccgtaagtccgttaccgtaggtaacttacgtaacgttagggtacggtttacgttaaagggtttaacgtaaacggtacggtaccggttaccttaacgttaccgggtaacggggtttccgggacggtacggtaggttaggtacgtaacggttacgggaaacttaacggttaacttaccaacggttacctacccaaccgttacgacgaacggtaccgtaccgtccgtacgaccgacgttaccggtaattaagggtttgtttacgttacgtaaaccgtttactttaacgttactaaccgtaacgtaaacttttaacgttaagttttacgttttaccgggtttacgttacggggttaaaccgttaccgggtaaccggttaaccgggtaacgtaacggggtacctaaaccgttaacggtaaaccgtaacgggtacgttaggcccggttaacgaccggtaaccctaccgttntttacccg

SEQ ID NO: 97076 - DNA, 930 bp, Homo sapiens
  misc_feature: GYAE6OF02GQFZ2.29.59.F04.1.454.CMB.1.raw
  modified_base (106)..(106): a, c, t, g, unknown or other
  misc_feature (106)..(106): n is a, c, g, or t
  modified_base (196)..(196): a, c, t, g, unknown or other
  misc_feature (196)..(196): n is a, c, g, or t
tcagatagagtactcacgaccggtgctcgatttagtacacacacttagggagttgggggcaggagtcagacccagtcaggacacagcatggacatgagggtcccgntcagctcctggggctctgctgctctggctccaggtgcaaatgtgacatccagatgaccagtctcctccatgtgtctgctatctgtaggtnacgtagtacgtacacctatcctaacgttcgggacccgggtaccaggtaccgaaggtacggttaagttaacggtaacggtaccgttacgggttacggtaccgttacggtaacgttaccgtaacggtacgtaaacggtaaaaacccggtaacggggtaaaaccgtacccccgtaaacggtccttaccgtaggtaaccttacggttaaacggtaacgggtccgttaacggttaacggtttaaaggaaacggttacggtacgggttaccccagttaaccgggtaagggtttccgggacggtaccgtaagggttacggtaacgttaccggtaggggtaacctaaaggttaccgttaccgtaaccgtttaccgtaacgtaaccgtaacgttaccgtaacggtacccggtaacggtacccgttacggaacccgttaacgggtacccgtttaaggtaaccgtttacggtttaacgttttaaccgggtaacctttaaaccggttttactttaaaccgggttccggaaacccgttaaacggttaaccgtttaaacggttttaaacgtttaccggggttttaaccgggtacggttaacccgggttaacgggttaacccggttaaccggggtaaccggttaacggggttaacggtaacccggttaaagtaacccggttaaaacgggttacgtaccgggtttacggtaccgtttaacggaacccgttacccggtaacgtttaccggg

SEQ ID NO: 97077 - DNA, 764 bp, Homo sapiens
  misc_feature: GYAE6OF02IEANO.29.59.F04.1.454.CMB.1.raw
  modified_base (199)..(199): a, c, t, g, unknown or other
  misc_feature (199)..(199): n is a, c, g, or t
tcagatagagtactcacgaccggtgctcgatttagtacacacacttagggagttgggggcaggagtcagacccagtcaggacacagcatggacatgagggtccccgctcagctcctgggctcctgctgctctggcctacccgaggtcaccaaatgtagacatccagatcgacccagttcctccttaccacgtgtcgtcngctatcgtagtaggtagacaggactaccacataccgtacgttcggaccggtcctagcgaagtatagttaggtacgtcgttggtcgtacgtaggtactgacgacgaaacgtaaaccggagggaaccctacccgtagtccctacgtagtaacttacgtaacggtacggttccttaagtttaaggttaaacggtaacggtcggtaaccggtacctagtttacccgggtaggttccgcgggtaacctggtacggtacgttacgggaacggtactaacggtcttacccgtactacccgtactaaccgtactacgacgtaccgtacgtccgttacgcctacggtacctaggttactttacggtctttaaccgtacgtttactacgttacgtaccgtaaccgtacgtaacgttaacgtttacgttttacgggttacccggtacggttaccgggttacccgggaaccggttaaccgggtacggttaccggtaacgtaacccgttaaggtaaacccgtaaacggttcggttacggacggttaccgtaccggtaccttaccgttagtttacccgg

SEQ ID NO: 97078 - DNA, 785 bp, Homo sapiens
  misc_feature: GYAE6OF02IRQH2.29.59.F04.1.454.CMB.1.raw
tcagatagagtactcacgaccggtgctcgatttagtacacacacttagggagttgggggcaggagtcagacccagtcaggacacagcatggacatgaggtccccgctcagctctggggctcctgctgctctggctacccgaggtcgacctaaagtgtgacatccagagtcgacccagtcctccttacacgtgtcgtctgactactcgtacggtaggtacgacaggtacgtaccacctactcgacgttcggacccggaccagtcgaagtagttaagttagtacggtacgttggtcgtcgtaggtactgacgtacgaacggaacggaagggaaccctaccgtaagtccgttacctaggtactaacgttaaggtaaccggttacgttacgtttaaacgggtttaacggaaacggttccgaaccggttacctaaaccgttaaccgggttaacggggttccggacggtacggtaggttacggacgtacgggtagggaaaccctaaggttaccttacgacgttacctaccgaactacggtaacacgtacgaccgtccgacgccgtaccgtgtaacgttacgtatttaaccgtttcgaacgtttacttagtaccgtaccgtaacgtaaacgttagtttaaactttacggttttacgtttacccgggtaggttaacccgggtaaccgtaaccggtaaccgggtaagggttaccggaacgtaaccgtaacggtaaaccgttaaaaccggtcgttaacggtacgggtaccctacggaaccttacctacgtttccg

SEQ ID NO: 97079 - DNA, 700 bp, Homo sapiens
  misc_feature: GYAE6OF02G3L7S.29.59.F04.1.454.CMB.1.raw
  modified_base (141)..(141): a, c, t, g, unknown or other
  misc_feature (141)..(141): n is a, c, g, or t
  modified_base (145)..(145): a, c, t, g, unknown or other
  misc_feature (145)..(145): n is a, c, g, or t
  modified_base (157)..(157): a, c, t, g, unknown or other
  misc_feature (157)..(157): n is a, c, g, or t
  modified_base (163)..(163): a, c, t, g, unknown or other
  misc_feature (163)..(163): n is a, c, g, or t
  modified_base (194)..(194): a, c, t, g, unknown or other
  misc_feature (194)..(194): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
tcagatagagtactcacgaccggtgctcgatttagtacacacacttagggagttgggggcaggagtcagacccagtcaggacacagcatggacatgagggtccccgctcagcctcctggggctcctgctgctctggctccnggtnccaatgtagacntccagntacggaccctagtctccttccactgtcgtcngccatcgtagtaggtcgacagtcgacctaccattccacgttcggaccgggctagtcaggattagttaggancgtggtcggtcnggtacngactcgaagtaaccgagggaaccccctaagcctctgactgtaacgtaggtcgttaattacgttagaacggtgacgtccaagtcgtaacggtcgcgtaggactacggtacgtacggtaggaccttaaaggtaccttacaccgttcaaccgtaccgtatccgaacgactacgtacgttacgcgttaacgcgtacgttcgttaatacgtttacgtactttaacgttactacgtacggtaacccttaaagttaggttaactttaacgtttcgtttttacccggaaagggtttaccctacgggggttaaccttaaacggggacccgttaagggaacggttaaaccgttaaccgaaacggttaaccggtaaggtttaccgttcgggtaccctaacgtacccttaacgggttacccttaaccgg

SEQ ID NO: 97080 - DNA, 758 bp, Homo sapiens
  misc_feature: GYAE6OF02JDNFS.29.59.F04.1.454.CMB.1.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
tcagatagagtactcacgaccggtgctcgatttagtacacacacttagggattgggggcgaggagtcagacccagtcaggacacagcatggacatgagggtccccgctcagctcctggggctcctgctgctctcggctccaggtcgaccaaactgtcgacatccctagagtcgacccagtcctccttaccactgttcgtactcncgatctcgtaggtnacaggtatcacatcctacgttcggcccgggtaccaacgttcgaacggtagttaagtttagtaggtccgttacgggttcgggttacgttggtactcgaacggtagaacgaaaccgtaagggaaacccgtacccctaacgcctaacgtcgtaacttctaagtaacggtcgttaacgttagtttaaggaacgttcggaaacgttcccaacggtaccgaacggggtttcgggaccggtactagggtcgtaacgttcggtacgggaacgtaaggtacccttacgtacgttaccctaccgtaacctaagttccgtaacgtaccgtaaccgttccgggaccttccgaccggtaacctaccggtagttccggttattacggttaacttaaccgttttaataaccttaccgtaaccctagtaacttaattacgttaagttttcccggttagttaaccgtaccggtacggtaccggtaaccggtacggtaacggtacaacgttaacgaaccgtagttacggtcggtactacggaccctaggtaccttacg

SEQ ID NO: 97081 - DNA, 644 bp, Homo sapiens
  misc_feature: GYAE6OF02JBZHP.29.59.F04.1.454.CMB.1.raw
  modified_base (146)..(146): a, c, t, g, unknown or other
  misc_feature (146)..(146): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctcgtggcctcccaggtnaccaaatgtgacatccagactcgacccagtcctccttaccacgtgtcgtctgctacctgtaggtgacagagtcaccatccacttgccgggcagtcagagtattagtagctggttggcctggtatcgagcaggaaaccacgggaaacgccccgtaagcctacctagactctagtaacggcgtacgtagtttaagaaagtggacggtccatcgtaagggttcggcggcgaggtggactgagggacagaacttcactctacaccgagtccagtccacgtcccgacgacgtcgtaccgtgacgtttagtacttttacgacttaaccgtttattaccgttcgaacccttaacgtaacgttaaagttaacgtttaacgggttttcccgtagggttaccccggttggacccgggaagggtacctaaggggtaccggtaacgtaccggtaacgtaaccgtaacgttcggttacggtaccgtcgtaccgacctaccgtacgttaccg

SEQ ID NO: 97082 - DNA, 717 bp, Homo sapiens
  misc_feature: GYAE6OF02G6PO6.29.59.F04.1.454.CMB.1.raw
  modified_base (207)..(207): a, c, t, g, unknown or other
  misc_feature (207)..(207): n is a, c, g, or t
tcagatagagtactcacgaccggtgctcgatttagtacacacacttaggagttggggcaggagtcagacccagtcaggacaccagcatggacatgaggtccccgctcagctcctgggctcctgctgctctggctcccaggtgccaaatgtgacatccagatgaccctagtctccttccactgtcgtctgcatctgtaggtgactagngtacactactctacgttcggccggctagtacagtagttagttagtacgtcgttggggttcggtccgttaggtacttcgaacgtacgaaccggaaaacccggaaacgggaaacccgtaccccgtaacggtcctacccgtagacttaccgtaagtacggtccgttagttaaggttaaggaacgttcgaacgtcctaagtacggtaacgggtcggtaccggtagtagtggtacgttacggtgggtaaacgtaagttaaccgttccgaaccgtttccgaaccctaacgtacgtaccgaacgtaccgaactccgtaacgaacgccgtacgtacggttagtagttacttacaacgttaacgttactacgtaccgaccttaacgtagttaaatttacgttacttttccgggtacgttaaccgtaccgtaccgtacggtaacggtacggtaacgtaaccgtaactaacgaaccgttagtacgttaccggactaccggaccgttaacctcgtttacccg

SEQ ID NO: 97083 - DNA, 825 bp, Homo sapiens
  misc_feature: GYAE6OF02H8M9Y.29.59.F04.1.454.CMB.1.raw
  modified_base (108)..(108): a, c, t, g, unknown or other
  misc_feature (108)..(108): n is a, c, g, or t
  modified_base (134)..(134): a, c, t, g, unknown or other
  misc_feature (134)..(134): n is a, c, g, or t
  modified_base (155)..(155): a, c, t, g, unknown or other
  misc_feature (155)..(155): n is a, c, g, or t
  modified_base (159)..(159): a, c, t, g, unknown or other
  misc_feature (159)..(159): n is a, c, g, or t
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
tcagatagagtactcacgaccggtgctcgatttagtacacacacttagggagttgggggcaggagtcagacccagtcaggacacagcatggacatggacgggtccccntcagctcctggggctcctgctgctgngctccaggtgacctaaatgtnactntaccagactgaccctagttcctccttacagttggtctacngcaattcgngggttagcaagacggtatccaaccgtntactacgttaccgggcccgggtacaaggtctaagaggtttaacttaggtaccgcgttgggtaccgggtccgtaggttaactcgaagtacggtaaaaccggaaaacgtaacgggtaacccgaccccgttaaacggcctttacccgagttaacttaccgtaaaggttacggtttacgttaagtttaaacggggttttaacgaacgggtaccgggtaacgttacctaaaccggttaaacgggtaccggggttacggggccgtaggtaaggtttaacggcgtacgggttaacaaacgttagtaactttacgaacccgttctaccgtaactacgtacgtacgtaccggagtccgtacgtaccgagtacgtcggttaacgttcgtttaacttccgtacgttaaactttaacgttaacgtactaaaccgttaacgtaagttaacgttttaacggttttaccgggtttaccggtaccgggtttaaccgggtaaccgtaaccggtacgggtaaccggtaacgggttaccggaacgttaacgtaaccggtaaacgtcccggttaaggtaccggtgtaacggtactacccgtacgttaccg

SEQ ID NO: 97084 - DNA, 940 bp, Homo sapiens
  misc_feature: GYAE6OF02JV71L.29.59.F04.1.454.CMB.1.raw
tcagatagagtactcacgaccggtgctcgatttagtacacacacttagggattgggggcaggagtcagacccagtcaggacaaaacagcagtggacatggacgggtcccccgctcagctccgtggggctcctgctgctctggctcccaggtcgacctaaatgtcgactactccgaagatacgaaccctacgttcccttcccttacccacgttcggttcgttcctcgcctactttcggttagggttacgggttacgaaaccgtagggtaaccgtaccctaaaccctacggttacccgttacccggttaccgggtacccccgggggaccttaacggttaccggtaacggttaagttaacggtttaacgggttagttcccgggtttagggggttccggaccgggtttaggtcctacgacggtaaccgaaaacggtaaaccggaaacggggtaaacccgaccccgttaacgtacccttaccgttaacgtaacgtacgttaacggtaaccggtaccgtttaacggtttaaagttaacgggtaccgtaaggtacccgttaaccctaggtaacgttaacggggtccggtacgggtacgtagggttcgacggttacggttaggaacgtaacggttaccttaccgtaccgttaccgaactaaccgtacgtacggtactacccggcttaacccggcgtaccgtaacggttccgtacgtacggtttacgtttacgttacgtaaccgtttattaccgtaaccgttccggaaactttaaccggtaacgtttacggttttaacgtttcgggtttaccgggacggtttacggtaacccggtaaccggtaacggtaaccggggttacggttaaaacgccgttaaaccgtacgggtaaacgttaccgggttacgtacccgggtaccgttacggacccgtttaccgtatttacccggg

SEQ ID NO: 97085 - DNA, 684 bp, Homo sapiens
  misc_feature: GYAE6OF02JZQLL.29.59.F04.1.454.CMB.1.raw
  modified_base (132)..(132): a, c, t, g, unknown or other
  misc_feature (132)..(132): n is a, c, g, or t
  modified_base (143)..(143): a, c, t, g, unknown or other
  misc_feature (143)..(143): n is a, c, g, or t
  modified_base (161)..(161): a, c, t, g, unknown or other
  misc_feature (161)..(161): n is a, c, g, or t
  modified_base (484)..(484): a, c, t, g, unknown or other
  misc_feature (484)..(484): n is a, c, g, or t
tcagatagagtactcacgaccggtgctcgatttagtacacacacttagggattgggggcaggagtcagacccagtcaggacacagcatggacatgagggtccccgctcagctccgtggggctcctgctgctntggctacccgnggtagccaaatgtcgacntccagatcgaccagtcctcctcacttgtgtctgcatcgtgtaggtgaacaggtacgtccaaccatacctacgttcgggacccgggtctacggttacaaggtaagttagttaagttacggtcgttaggtttcggccgttagggtatacgtaagccgaaaggaaaaccgaagggaaacgtacccccgtaagtcctaccagtactgtaacgtaggtcttacgtaagttaagaagttcggaacgtacccgtataccgggtaggtacgggtacggcgtaaggtgaagtacggtaggtacaagtacgttcacgttctacgactacgacncggacaacgtcgcgacgactaccggtatcgttagttactttacggtaattaccgttaattaactaccgtacctaaacgtaagttacttaagtttaaccgtttcgtaaacggttacggtacgtaacgtaaggtaccgtaggtccgggtaatacgtaaccgaacgttagtacggtacgtacgtacgtacctactacgttacg

SEQ ID NO: 97086 - DNA, 715 bp, Homo sapiens
  misc_feature: GYAE6OF02IN4ZH.29.59.F04.1.454.CMB.1.raw
  modified_base (274)..(274): a, c, t, g, unknown or other
  misc_feature (274)..(274): n is a, c, g, or t
tcagatagagtactcacgaccggtgctcgatttagtacacacacttagggattgggggcaggagtcagacccagtcaggacacagcatggacatgagggtccccgctcagctcctggggctcctgctgctctggcctcccaggtgaccaaatgtgacatccagatcgacccagtcctccttccactgtgtctgctatctggtaggtgacagagtccaccatcacgttcggccgggccagtcgagagttattagtagtcgtggtcggctggtatnagacaacgaaaccgagggaacaccctaacgccgtcagtactacgtaagtagtcgttattagttaagaagtgaaccggtacctagtacggtaacgggttccgggacggtactaggtaggtacgttacggacgggtaactaacgtacttaccgtaccttactaacctacctactacgacgacgtaccgtaccgtgaccgtacgtcgtacgttagttacgtttactttgtaaacctaaactttaccttaacgtacgtaacccttaaacgtaactttaaacggttaacgtttttaccgtttacgggttaaccggttaccgggttaacccgggaccgggttaaaccgggttaaccgggtaaaggggtacggtaaacccgtaagttaaacccggaaacgttaccggtgggtaccgtactaccggtaaccttaccggtatttacccgg

SEQ ID NO: 97087 - DNA, 544 bp, Homo sapiens
  misc_feature: GYAE6OF01ATAAL.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaggcttctggatacaccttcaccgcctactatatccactgggtgcggcacggcccctggacagggcttgagtggatgggacacatcagccctaacactggtgacaacaaactatgacacagagtatttacgagggcagggtcaccgatcgaccacggacacgtccaataagcacgtagtttacagtaggaagtaaataggtactagagtatcgtagacgaccgacggaccgtattattacgtgtgtacggttaattaacggtacgtagttacgtatttagttttgtagttttggttttacgg

SEQ ID NO: 97088 - DNA, 507 bp, Homo sapiens
  misc_feature: GYAE6OF01ASSOP.26.80.H03.1.454.CMB.1.raw
  modified_base (495)..(495): a, c, t, g, unknown or other
  misc_feature (495)..(495): n is a, c, g, or t
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatcccactgggtgcggcaggcccctggacaagggcttgagtggatgggacacatcagccctaacactggtgacacaaactatgcacagagatttcagggcagggtcaccatgaccacggacacgtccataagcacagttacatggagtaataggctagagatctagacgacacggccgtatagttactgtgcgttataacggacattacgattgttttgntttggttttacg

SEQ ID NO: 97089 - DNA, 551 bp, Homo sapiens
  misc_feature: GYAE6OF01ALD6O.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacgactcacgccctaacgacgtggtagacaacaaactatcgacacagagtatttcgagggtcagggtaccaccgtatacgaccacggacaccgtaccaataacgcaactacgtttacagtaggaagtaaagtaggctaggagatcgtagacgacgacggaccgtattatacgtgttagacgttagttaacggacgtagttacgtattgtttagtgtttggttttacg

SEQ ID NO: 97090 - DNA, 504 bp, Homo sapiens
  misc_feature: GYAE6OF01A8RTS.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtgacacaaactatgcacagagatttcaggcagggtcacatgaccacggacacgtccataagcacagtttacatggagtaataggctgagatctagacgacacggcgtatattacgtgtgcgttattaacggagattacgattgtttgtgtttggttttacg

SEQ ID NO: 97091 - DNA, 622 bp, Homo sapiens
  misc_feature: GYAE6OF01AHCWN.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcacccgcctactatactccactgggtgcggcacggcccctggacgaagggcttggaggtggagtgggacacatcacgaccctaacgactggtacgaacaacaaactatacgacaacgagagtacttttacgagggtacgaacgggtaccaccgagtacgaaccgacggaaccaccgtaccgaataacgactaacgtagtttaacagttagggaaggttaaagtacggactaggaagtagtacgtacgaccgacgtaccggtaccgttaacgttaacttacgttgtacggttacgtttaagttaaccggtacgttaacgtttacgtagtttaggttttagttagttttgggttttaaccgg

SEQ ID NO: 97092 - DNA, 684 bp, Homo sapiens
  misc_feature: GYAE6OF01CFDNB.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcgttggtggcagcagccacaggacgcccactcccaggtgcagctggtgcagtcgtggggctgaagtgaagaacgccgtggggcctacgaggtgaaggtcctccgtgacgaaggtcttcgtaggactaccaccttcaccgccttaactatactccagtgggtcgcggcgacggtccccgtaggaacgaaggtcttggagtggagtcgggaacacgagtccacggaccctaaacgacgtggtaacgaactaaacaaagtagtacgaccaacgaggtaagtacgttacggaagggacgtaacgggtaccaaccgagtaccgaacccgaacggaaccgtaccggtaaccaacgtaacgacctaacgtacggtttaacaagttagggtaaaggtaaacgtaggacgtaggtaagtacgtacgtacggaacgaccgtaaccgggtaccttaagttacgttaacgttggtacgttaacggttaacgttaaccggaagttacgttaacgtaggttttagttttagttaaggttttcggttttaacgg

SEQ ID NO: 97093 - DNA, 784 bp, Homo sapiens
  misc_feature: GYAE6OF01DOIHZ.26.80.H03.1.454.CMB.1.raw
  modified_base (339)..(339): a, c, t, g, unknown or other
  misc_feature (339)..(339): n is a, c, g, or t
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaagtgaagaagccgtggggcctacgagtgaaggtctcctgcaaggcttcgtggatacaccttcaccgcctactactatccgacgtgggtgcggcgacggcccctggacgaaggtcttgagtggatgggacanatcgacgccctaagacgtggtacacgaaacaaacgtatacgaccaacgaaggtaacgtaatttaccgggagggtaccgtaacggggttaccaaccgtacgttacggaaccccggtaaccgggaacctaaccggttacccgaaagttaaaccggacctaaacgttaacggtttttaaacgaacgggttaagggtaaaaggttaaaacggttaacgggtacgttaacgggtaacggtaacttccggtaacggtaacccgggtaaaccgtaacccggggttaccggttaaaactttaaacggttttaaccgtttagggttaccggttaaacggttttaaacggtttaaaaccggggaaccggttttaaacggtttaaaccggttttacgtttttaaggggttttttacgtttaaagggtttttttacgggtttttttaaaccccgggg

SEQ ID NO: 97094 - DNA, 509 bp, Homo sapiens
  misc_feature: GYAE6OF01D9V5R.26.80.H03.1.454.CMB.1.raw
  modified_base (266)..(266): a, c, t, g, unknown or other
  misc_feature (266)..(266): n is a, c, g, or t
  modified_base (361)..(361): a, c, t, g, unknown or other
  misc_feature (361)..(361): n is a, c, g, or t
  modified_base (418)..(418): a, c, t, g, unknown or other
  misc_feature (418)..(418): n is a, c, g, or t
  modified_base (460)..(460): a, c, t, g, unknown or other
  misc_feature (460)..(460): n is a, c, g, or t
  modified_base (490)..(490): a, c, t, g, unknown or other
  misc_feature (490)..(490): n is a, c, g, or t
  modified_base (497)..(497): a, c, t, g, unknown or other
  misc_feature (497)..(497): n is a, c, g, or t
tcagagactatactcacgaccggtgctcgatttagctgtgcgtcgaagggaaagggaactgactaccacctgcaggtcagggccaaggttatggggtcccaggttcacctcctcagcttcctcctcctttggatctctgggcagagccgacactcacgcagtctccagcattcatgtcagcgactctaggagacaaggtcaacttctcctccaaagccagccaagacattgatgatgatatgaactgcaccaacacaaaccagganaagctgctatttccattactcaagaactaatggtctcctacctggaatgccactcgactcagtggcaacaaatataggaactagtttttaacccncacaactcaatatcaacagaatctagaggatgctgactattttactcgtctacaacntagattatttccctcgtgaccgttcgaccgaaggaccagganacaaatcaaacgactgcggctgcacatctnttctacntcttcccgctac

SEQ ID NO: 97095 - DNA, 650 bp, Homo sapiens
  misc_feature: GYAE6OF01C31CJ.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaagtgaagaagccgtggggcctcagtgaaggtctcctgcaaggcttcgtggatacaccttcaccgtcctaactatactccacgtgggtgcggcacggcccctggaccgaagggtcttagagtggagtgggacacgtatcgacgaccctaagacgtggtagaaccaaacaaacgtatacgaccaacgaaggtaagtacgtttcgaaggggaccgacggggttaccaaccgtagtaccgaacccgaacgggaacctaaccggtacccaagttaaacgaccgtaaacgtaacgttttaaccaaggttacgggaaaggttaaaagtacgggactaggaacgtatacggtacgaaccgaacgtaccggtacgtattagttacgtgtacggtagttaacgttaacggagttaacgttacggtattggttttagttagttttggttttacgg

SEQ ID NO: 97096 - DNA, 684 bp, Homo sapiens
  misc_feature: GYAE6OF01CQPTF.26.80.H03.1.454.CMB.1.raw
  modified_base (660)..(660): a, c, t, g, unknown or other
  misc_feature (660)..(660): n is a, c, g, or t
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggacgcccactcccaggtgcagctgggtgcagtcgtggggctggaagtgaaagaaggccgtggggcctcgagtgaaggtcctaccgtgacaaggtcttcgtggtaactaccgtacccttccacccgcctaactaattactccagtcggggtcgcggcacggccccgtaggaaccgagggtcttggagtggagtagggacacagtaccacgacccctaaagacgtggtacgaaacaaccaaatagtacgacaacgaagtaacgtacgtttcgaacgggtcgacgggtccaaccgtaacgtacggaacccgtaacggaaccgtacgtaccaagtaacgacctaacgttacgttaacgtaagtaagggtaaacggttaaacgtacggtacgtagaagtagtcgtaacgacggaaccgtacggtaaccttaattacgttacgttcgtacggttaacgttagttaaaccggtagtaacgttaacgttagtttacggttttnttacggtttttaggtttaaccggg

SEQ ID NO: 97097 - DNA, 722 bp, Homo sapiens
  misc_feature: GYAE6OF01AVDXY.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaagtgaagagccgtggggcctcgagtgaaggtctcctgcgaaggcttcgtggataccaccttcaccgtcctactatactccacgtgggtgccggacgaccggccccgtaggacgaagggtcttggagtggagtcgggactacgagtcaacgtacccctaacacgtggtacgaaccaacgtaaactagtacgacctaacgaaggtaagttacgtttacggaacgggtcgtaacggggtaccaaccgtagtaccggaaaccccgaacggaacccgtaacccggtaccgaaacgttaaacgaccctaaacgttaacgtttaacgagttagggtaaacggttaaagtagggtacgtaggtaacgtacgttacgtacggaaccgtaccgtaacggtaccgttaattaacgtttaccgtggttacggttaacggttttaaacggttaaacccgggtaacgttaacggtttaaccgttagttttaggtttttaggtttaggtttttcgggtttttaaacccggg

SEQ ID NO: 97098 - DNA, 565 bp, Homo sapiens
  misc_feature: GYAE6OF01ENAKO.26.80.H03.1.454.CMB.1.raw
tcagagactatactcacgaccggtgctcgatttagctgtgcgtcgaagggaaagggaactgactaccacctgcaggtcagggccaaggttatggggtcccaggttcacctcctcagcttcctcctcctttggatctctgggcagagccgacactcacgcagtctccagcattcatgtcagcgactctaggagacaaggtcaacttctcctccaaagccagccaagacattgatgatgatatgaactgcaccaacacaaaccaggagaagctgctatttccattactcaagaactatggtctcctactggaatgccacctcgactcagtggacaaacaaatataggaactagtttttaacccacactaactactaatatcaacagtaactactgagtatgctgcttattttaccttcgtcttaacaacgtatagtaattaacgtttccctacggtggtacgttccggaccgaacgggaccaaggacacgaaaataccgaaacgaacctggtacggtctagaccctactactacttcgttacttctacttcccttaccccgctaacg

SEQ ID NO: 97099 - DNA, 745 bp, Homo sapiens
  misc_feature: GYAE6OF01BXUGU.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgagtgaagagcgtgggctcagtgagtctctgcagctctggatacaccttcaccgtcctactatactccacgtgggtgccggcgacggccccgtggaacgaagggtcttggaggtggtagtgggacactatacgacgaccctaagacgtaggtacgaacaactaaactagtacgacaacgaggaacgttacgtttacggaacggggtacgacgggtaccaaccgtaacgttaccggaaacccggtaacggaacccgtaccggtacccgtaaagttaaaccgaccgtaaaccgttaaggtttaaccgaaggttacggggtaaaagggttaaacgttaacgggtccgtaaagggtaacgtacggttaacgtacgggaaccgtaacccggtaaaccgggtaccgttaaacgttaaaccgttttacgtacgggtttaccggttacgggtttaaacggttaaacccgggttaacggttaacgttttaaccggttaggtttttacggtttttagggtttaaaggtttttcgggttttttaaacccggg

SEQ ID NO: 97100 - DNA, 647 bp, Homo sapiens
  misc_feature: GYAE6OF01DW14Z.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaagtgaagagccgtggggcctgaggtgaaggtctccgtgcaaggcttcgtggatacaccttcaccgcctactatactccacgtgggtgcggcgacggccccgtggaccgaagggtcttgagtggagtgggaacacgatcgacgccctaaagacgtggtacgaacaacaaactagtgacaacgaggaatacgtttacgacggggtacagggttaccaaccagttacgacccgaacgggactaccggtaccaagtaacgactacgtaagtttaacagttagggtaaggttaaatacgggacgtagaagtacttacgtaggaaccgaacgtaccggtaccttaaattacgttacgttaggttagtacggttttaaagtaaaccgggacgttaacgttacgtttaagtttaggtttttacgtaaggtttttggtttttaaacccggg

SEQ ID NO: 97101 - DNA, 708 bp, Homo sapiens
  misc_feature: GYAE6OF01A0EP2.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatactccactgggtgcggcacggcccctggacaagggcttgagtggatgggacacatcacgaccctaacacgtggtacgaaccaacgtaaaactagtacgacaaccaagtagtacgttttaccgaaggggccgtaggggtccaccgtagttcggaacccgacgggaaccaccggtacccaagttaaacgccgaacttacgttttaacgaagttaacggggaaggttaaaacgtacgggtacttacgggtaagtaacgttacggttacggaaccggtaaccggtaaccggggttacccgttaaagtttaaccgttttacggttacggttagggttaccgggttttaaagttaaacccggggtaacgttaaacggtttaaccggttagttttagggtttttacggttaaggttttttacgggttttttaaacccggg

SEQ ID NO: 97102 - DNA, 774 bp, Homo sapiens
  misc_feature: GYAE6OF01BB8J4.26.80.H03.1.454.CMB.1.raw
  modified_base (203)..(203): a, c, t, g, unknown or other
  misc_feature (203)..(203): n is a, c, g, or t
tcagagactatactcacgaccggtgctcgatttagctgtgcgtcgaaggggaaagggggagcatcacccagcaaccacgtagtctgtacctctagacgaactcccctgagagctccgttcctcaccatcggactggacctggaggtatcctcttcttggtgacagcagccagaggcgcccactccgaggtcgcagtcgtggtncagtcgtggggctagaagtagaacgacgtccggtcgggccttagaggtagtaacggtctcctggactaaggtccttagtaggtaactaaccgtccttaccacccgtacctaactacgtactccgtacgttggggtcggccggtacggaccggtcccgtaagggaacgttaacgggtcgttaggagggtaggtaacggtcgggaaccacgtacaccggtaaccacccccgttaaaagtcccgttagggtaacctaaacccgtaaactaaaacgtacgttcaaacgaacgtaaggaacgttaagttaccgggaaacgggtccggaaacggttaccgaaccgtaacgtaacccgaaccggaaccgtaaccgtaaccgtaacctaacgtaacaccgttaaagttaacggttaacgacggtaacgggtaaaggtaaacgtacggactagggtaactagtcgtaaccggacgaacggtacgtaacgttaattacgttaagtcggttagtaccggttaaaggtaaccgtaagttaacgttagtagtttagttttagttaggttttcgggtttaaccgg

SEQ ID NO: 97103 - DNA, 604 bp, Homo sapiens
  misc_feature: GYAE6OF01BIJ4U.26.80.H03.1.454.CMB.1.raw
  modified_base (248)..(248): a, c, t, g, unknown or other
  misc_feature (248)..(248): n is a, c, g, or t
  modified_base (372)..(372): a, c, t, g, unknown or other
  misc_feature (372)..(372): n is a, c, g, or t
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaagtgaagagccgtgggcctcgagtgaaggtctctgcagcttntggatacaccttcaccgtcctactatactccacgtgggtcgcggcacggccctggacgaagggtcttgagtggagtgggacacgagtccgacgtaccctaacacgtggtacgaacaacaaactntacgacacgaagtagtatttcgaagggcgtacgggtccaaccgagtacggaaccgacggaccgaaccgtaccaagtaacgcctaacgtacgtttacgaagtagggtaagttaaagtacgggtactaggtagtactcgtagacgacgacggtaccgtagtacgttacgtgtagtacgttaacgtaacgggtacgtaagttacgtagtttagtttgttagttttggtttaacgg

SEQ ID NO: 97104 - DNA, 649 bp, Homo sapiens
  misc_feature: GYAE6OF01DD1CN.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaagtgaagaagccgtgggcctcagtgaaggtctcctgcaggcttctggatacaccttcaccgcctactatactccacgttgggtcgcggcgacggccccgtggacgaagggtcttggagtggagtgggacacatcacgaccctaacacgtggtacgaacaacgaaactactcgacaacgaagtaacgtacgttttacggagggtaccgtacggggtaccaccgaagttaccggaaccgaaccgggaaccgacccggtactaacgtaaacgaccgtaacgtacgtttaacaggtaagggtaaggttaaagtacgggtacgttagagtagttcgtaggaccgaacgtaccggtaccgttaattacgttacgtggttaggttacgtttaacgtaacggtaacgtagtttacgtagtttagttttagtagtttttcggttttaaccgg

SEQ ID NO: 97105 - DNA, 800 bp, Homo sapiens
  misc_feature: GYAE6OF01BG2GJ.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtgcagcagccacgaggacgcccactcccgaggtgcagctggtgcgagtcgtgggctagaagtagaagacgcgtcgggcctcgagtgagtctccgtgacgaggtcttcgtggactacctaccttccgacccgtcctactatacctccgtacgtggggtcgccggtccgaccggtccccgtagggaacgaacgggtcttaggaggtggaggtacggactacgtacgtccgaaccgtaccctaaacgcgtacggaacgtaaacaaactaaacgtacgtacgaccgaagaacggtaagttacgttacggacgggtaccgtaacgggtaccaaccgtagtaacccggaacccggtaaccggtaacccgtaaccgtaaccctaaagtaacccgtacgtaaaccgtttaacggttaaaccgtaagggttaagggaaacggttaaacggtacgggtaccgttaagggtaaccgttacgttaccggtaaccggaacccggtaaaccggtacccggggttaacctttaaagtttaacccggttacggttaacggtttacggttaaaccggttttaacggtaaacccgggtacgtttaaacgttacgtttaacgggtttttagttttaacggtttacggtttttacgggttttaacccggg

SEQ ID NO: 97106 - DNA, 767 bp, Homo sapiens
  misc_feature: GYAE6OF01D1UAT.26.80.H03.1.454.CMB.1.raw
  modified_base (163)..(163): a, c, t, g, unknown or other
  misc_feature (163)..(163): n is a, c, g, or t
  modified_base (169)..(169): a, c, t, g, unknown or other
  misc_feature (169)..(169): n is a, c, g, or t
  modified_base (194)..(194): a, c, t, g, unknown or other
  misc_feature (194)..(194): n is a, c, g, or t
  modified_base (233)..(233): a, c, t, g, unknown or other
  misc_feature (233)..(233): n is a, c, g, or t
  modified_base (248)..(248): a, c, t, g, unknown or other
  misc_feature (248)..(248): n is a, c, g, or t
tcagagactatactcacgaccggtgctcgatttagctgtgcgtcgaagggaaagggggagcatcacccagcaaccacatctgtcctctagagaactcccctgagagctccgttcctcaccatggactggacctggagatcctcttcttggtgcagcagccaanaggacncccactcccgaggtcgcagctggtncgagtcgtgggctagagtagaagacgcgtcgggcctcgngtagtaggtcctcgngacgtaaggtcttcgtagaactacctaccttaccgaccgtaccttaactaagttacctaccgtacggttgggtccgccggtaccgaaccggtccccgtaggaccggtaacggtcgttaggtacggtaggagttacggaacctaactcgtaccaaccggtaccctaaaggtccgtacggtactaaacccgaaacgtaaaccgtatacggacctaagtaacgacgtttacgttacggaggtacgtaccgtacacgttaggaccgtaacccggaacgtacccgtatacccgaaagtaaccggtaccaaacgtttaacgttaacgaacggttaggtaaacggtacgtaacgggataccggtaaagtacgtacgaacctaccggaaaccgttccgggtaaacccttaggttaaccgttaacggttcgtaaccggttagtttaaaccgttaaacgggtttaccttaacggtttaacgttaggtttttagttttaacggtttcgggttttaacggttttaacccgg

SEQ ID NO: 97107 - DNA, 992 bp, Homo sapiens
  misc_feature: GYAE6OF01EH26Y.26.80.H03.1.454.CMB.1.raw
  modified_base (541)..(541): a, c, t, g, unknown or other
  misc_feature (541)..(541): n is a, c, g, or t
  modified_base (575)..(575): a, c, t, g, unknown or other
  misc_feature (575)..(575): n is a, c, g, or t
tcagagactatactcacgaccggtgctcgatttagctgtgcgtcggaagggaaagggggagcatcacccagcaaccacatctgtcctctagagaactcccctgagagccttccgttcctcaccagtggactcggaccgtggaggtacttccttcttcgttgggtgcgagcacgccacgacggacgaccccaccgtcccgaggtcgccgaggtcgttggcgcgtacggttcgggtcgggggtacttaggaaaggttacggaaacgggaaccggtcccggttcggggggtacccttcggaaggttacgggaaccgggtttccttaccggtcggtacggtaaaccggttccgttttacgggtacggtaaccttaaccccgttacccttacccggaaccccttaaccgttaaccttaacttaacccgttccggtaacggggtttcgggggtccggaccccggggtacccggtacccgggtccccgggtaacggaaccgggtaacggggtttccggttagggagggttacgggtaggtaaccgganaccggtaacgttccgaacccggtacttaaccggngttacgggaacctaaaccaacggtaaacttaggaaccgacgtaaaccggtaaggtaccgtttaacggttacggggaaccgggacgttacccgggtaaccgaaccggtaaccgtaacccggtaacccgggtaaaccgtaccgtttaacccggaaccgttaaacgttaacgtaaccgtttaaacgtttaaaccgtaccgttaaagggtccggtttaaaagggtaacgtaaggtacggtaaccgtaacgttacgtaaccgggaacgttaacccggaacggtaccccggttaaaggttacttaaaccggttacgtacgggttaccgtttaaaagggttccgtaaaacgggttccttaaacgggttttgtttaacgggtttttaggttttacgggtttttaaggttaacgttttacccgggg

SEQ ID NO: 97108 - DNA, 887 bp, Homo sapiens
  misc_feature: GYAE6OF01DGTNS.26.80.H03.1.454.CMB.1.raw
  modified_base (190)..(190): a, c, t, g, unknown or other
  misc_feature (190)..(190): n is a, c, g, or t
  modified_base (259)..(259): a, c, t, g, unknown or other
  misc_feature (259)..(259): n is a, c, g, or t
tcagagactatactcacgaccggtgctcgatttagctgtgcgtcggaagggaaagggggagcatcacccagcaaccacatctgtcctctagagaactcccctgagagctcccgttcctcaccatggactggacctggaggatcctcttcgttggtggcagcagccacgaggacgcccacgtcccagggtncgagtcgtggtgcaggtcgtggggctgaagtggaagacgtccggtgggcctcgagtgaacggtcctcgngcgaaggtcttcaggacctacctacccgttccgaccgtaccttactaacgtaccttaccgacggtggggtcgaccggccgtaccggggtcccccgtagggaaccgtaacggggtcttagggaagggttcgggaacggttcgggaaaccgtaccgtaagttacccggaccggtaaccccttaaaccgacgttacggggtacgaaaacctaaaccgtaaacttacggcgtaaccgtaacggtaagtaacggtttacggtttacgggaacgggtccggtaaccggtaaccgtaacccgtaacggttaacccgggaacccgaaaccgggtacccgtaaacccggttaccgaaagtaaacccggttacccgtaaacggttttaaacgttttaaccgaagggtttaaggggtaaacgtttaaacggtaccgggtaccggtaagggtaactaaccggttacgttaacggacccggttaaccggtaaccggttacggtttaaacctttacgggttaacgtttggtaaacggtttttaacccggtaaacggtttaaaccggggttaaccttaacgttttagggtttaactttttgggttttaaacttttcggggtttttacggtttaaaccccgggg

SEQ ID NO: 97109 - DNA, 861 bp, Homo sapiens
  misc_feature: GYAE6OF01DOFF4.26.80.H03.1.454.CMB.1.raw
tcagagactatactcacgaccggtgctcgatttagctgtgcgtcgaagggaaagggggagcatcacccagcaaccacagtctgtcctctagagaactcccctgagagcttccgttcctcaccagtggactcggaccgtgggaggactccttctttcgttgggtcggcagcacgaccacgacggacgcccacgtcccgaggtcgccgagtcgtggtcgacgtaggtcgtggggctaggaacggtaggaaacgtaaccggtccggttcggggtacccttacggaggttacggtaaccggttccttaccgtacggaccgtaacggttccgtacgttacggtaaccttacccgttacccttacccgtacccgtaccttactaactcccgtaccggtacggttcggggtaccggtccggaccggtaacccggtccccggtaagggtacccggtaaagggttccgttacgggaggttaacgggacggttacgggacctaacctacgtaccgaccgttaacccgtaacgtacgtacggtaacgaaacccaataaaaccgttgacgacctaaacggtacgtaacgttaacgtttaccgggacggtccggtaagggtacccaacgtacgtaccgaaccgacggaactacgtaccgtaagtacgacctaagtttacgtacaaggtaacgtaacggttaacgtaacggtctaacggtacgtacgttcgggaacgtaccggaacccgtaggttaccttaacggttaaccttacgggttcgttaaccggtaaagtttaaacccggttacggtaacgttaacgttacggtttcgttttaaaggtttcggttaacgtttttccgggtttaaccggg

SEQ ID NO: 97110 - DNA, 749 bp, Homo sapiens
  misc_feature: GYAE6OF01BOOBQ.26.80.H03.1.454.CMB.1.raw
  modified_base (435)..(435): a, c, t, g, unknown or other
  misc_feature (435)..(435): n is a, c, g, or t
tcagagactatactcacgaccggtgctcgatttagctgtgcgtcgaagggaaagggggagcatcacccagcaaccacatctgtcctctagagaactcccctgagagctccgttcctcaccatggactggacctggaggatcctcttcgttggtggcagcagccaacaggacgcccactcccgaggtgcagtctggtgctaggtcgtggggctggaagtgaagagccgtgggcctagagtgaggtcctcgtgacgaacggcttacgtggactaccgtaccttacgacccgtcctaactatactccagtgggtcgccggtacgaccggtccccgtaggaaccggtaagggtcctttaggaggtcgggtaagtcggggaacacgactaccgaacgtacccctaaacgacggttacggacgaacctaaccaaacgttanacgtaccaacgtaagaacgttagttaccggagggaccgtacgggtaccaaccggtacgtacccggaacccgaacgggtaaccgtacccgtaacccgtaaagtaacggtacctaacggttaacgtttacgaagggtttagggtaaacggttaaagtacgggagttaggtacgtaacgtagtaaccggacgtaaccggtaccggtacgtttaattaacggtttaccgtaggtttagtaaccggtttaagttaaaccgggtagttaacgttacggttagtttacggttttagttaacggtttttgggtttaacccgg

SEQ ID NO: 97111 - DNA, 810 bp, Homo sapiens
  misc_feature: GYAE6OF01ASCVT.26.80.H03.1.454.CMB.1.raw
tcagagactatactcacgaccggtgctcgatttagctgtgcgtcgaaagggaaaggggggagcatcacccagcaaccacatctgtcctctagagaatcccctgagagctccgttcctcaccatggactggacctgggaggactcctcttcttggtggcagcagccacaggacgcccactcccgaggtgcagcgtggtgcaggtcgtcgggggacttaggaaggtggaaaggacgtcccggtacgggggccctcgaggttacggaacggttcctacccgtgacgtaggtccttcggtaggtaactacccaccttaccgaccccgtaccttaacgttactaaccttccccgtaacggttcgggggaccgggtccggaccggtacccgggtccccgtaaggggaaccggtaaaggggtcggtttacgggtagggtgggaggtacggggactaaccgacgtccgaaccgtacccctaaacgtacgtgggtaaccaaccgtaaacgtaaaccgtcgtacgaaccgtaaacgaagggtaacgttacggttaacgggaccggacggtaccggtaccgtaaccgacgtacggaaccggtaaccggaactacccggtacaacgtaacgaacctacgtaacgttacgaggtagggtaaaggtaaacggttaacgaggtagtacgtactacgtaacgaccgtaaccggacggttacgtacgttacgttacgttaggtacggttaaccggtttaagttaacggtaacgttaacgtttagttacgtttaggttttacggtttaggtttttacggttacccggg

SEQ ID NO: 97112 - DNA, 573 bp, Homo sapiens
  misc_feature: GYAE6OF01ER826.26.80.H03.1.454.CMB.1.raw
  modified_base (121)..(121): a, c, t, g, unknown or other
  misc_feature (121)..(121): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (389)..(389): a, c, t, g, unknown or other
  misc_feature (389)..(389): n is a, c, g, or t
  modified_base (445)..(445): a, c, t, g, unknown or other
  misc_feature (445)..(445): n is a, c, g, or t
tcagagactatactcacgaccggtgctcgatttagctgtgcgtcgaagggaaagggactgactaccacctgcaggtcagggccaaggttatggggtccccaggtcacctcctcagcttccncctccttttggatctctgggcagagccgacactcacgcagtctccagcattcagttgtcagcgactcgtaggagacaaggtcaacttctcctaccaaagccagccaagacattgatgatgatatgaatcgcacaacacaaccagngagcngctatccatactcaagaactaactgactaccgtactggactcgacctacctcgactcgagtgacaacaagtactaggtaactagttttacccgactactaaccttcaatactcgaacntaacgactacgagacgtagtacgtagtcgtactttaactttcgtacgttactaacngtaacctacgtacgtacttacgttaccgtacgttcgacgtcgtacggtacgtacgtaagcgtacgactacgtaacacgttcgagtacgtcgtacctacgtactacgttctacttctccgtccttaccg

SEQ ID NO: 97113 - DNA, 855 bp, Homo sapiens
  misc_feature: GYAE6OF01DEV1S.26.80.H03.1.454.CMB.1.raw
  modified_base (172)..(172): a, c, t, g, unknown or other
  misc_feature (172)..(172): n is a, c, g, or t
tcagagactatactcacgaccggtgctcgatttagctgtgcgtcgaagggaaagggggagcatcacccagcaaccacatctgtcctctagagaatcccctgagagctcccgttcctcaccatgactggacctggaggactcctcttcgttggtggcagcagccacgaggacnccccgacctcccgaggtcgacgtagtccgtggtcgacgtacgttccggaggggcttaggaaagtaggaaaggtaacgccggtagggcctacgaggtagtaacggttctccgtgacgaaggtccttacgtaggtaaccttaaccgtacccttaccgaaccgtaccttactaacttactaccgacggttgggtcggacggtccgaccgggtccccgtaagggacgtaacggtcgttaggacgtgggtagtcgggaacaccggatacgaccgtaccgtaaacgtacgtcgaactaaaccaaacggtaactagacgacaacgaagtacgttacgttacggaagggcgtaaccgggttaacaccgtaaacgtaccggaacccgtaacggtaaaccctacccggtacctaaacgtaccgtacccgaagttttaacgtttaaacgtacgggtaagggttaaacgttaaaaccggttacgaccggttaaaggtaccgttaacggttaaccgtaacgggtaaccggtaaccggttaaccccggttaacttaacgggtttaacggtttaacttaacgggttacggtttaaacctttaaacgggttaaaccgggttaaccggtttaaacgttttaaccggtttacggttttaggtttttaaacggtttcgggttttttaaccggtttaaccggg

SEQ ID NO: 97114 - DNA, 553 bp, Homo sapiens
  misc_feature: GYAE6OF02GWTZZ.26.80.H03.1.454.CMB.1.raw
  modified_base (365)..(365): a, c, t, g, unknown or other
  misc_feature (365)..(365): n is a, c, g, or t
tcagagactatactcacgaccggtgctcgatttagctgtgcgtcgaagggaagggactgaccgtacacctgctaggtcagggccaaggttatggggtcccgaggttcgaccctaccgtccagcttcctcctcctttggatctctgggcagagccgacactcacgcagtctccagcattcatgtcagcgactctaggagacaaggtcaacttctcctccaaagccagccaagacattgatgatgatatgaactggcaccaacacaaaccaggagaagctgctattccattactcaagaaactaatggtctcctacctggaatgccactcgactcagtgcaacaaatatggaactagtttttacccncacaactcatatcacagaatactgagatagctgctatttacttcgttctactaactatagtataatttaccttccgtcgtacgttcgtccgtaacggtaccgaacgaagacaaactaacaaacgaacgtacgtaggtacgtacgtacgaccactactacgttcttcctactaccttcccgtacctacc

SEQ ID NO: 97115 - DNA, 521 bp, Homo sapiens
  misc_feature: GYAE6OF02G02NF.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtgacacaaactatgcacagagatttcagggcagggtcacatgaccacgacacgtccataagcactagttacagtggagtaataggctagagtatcgtgacgacgacgaccgtatattacgtgtagacgttagttaacggacgtacgttacgtattggtttagtagtttggttttacgg

SEQ ID NO: 97116 - DNA, 510 bp, Homo sapiens
  misc_feature: GYAE6OF02GF8ZN.26.80.H03.1.454.CMB.1.raw
  modified_base (345)..(345): a, c, t, g, unknown or other
  misc_feature (345)..(345): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtnacacaaactatgcacagagatttcgagggcagggtcacatgaccacggacacgtccataagcacagttacataggagtaanaggntgagatctgacgacgacgcgtatattacgtgtgtacgtagttaacggagtattacgtattgtttgtagtttggttttacg

SEQ ID NO: 97117 - DNA, 573 bp, Homo sapiens
  misc_feature: GYAE6OF02HJ31A.26.80.H03.1.454.CMB.1.raw
tcagagactatactcacgaccggtgctcgatttagctgtgcgtcgaaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcgaagcttctggactaacacccttcaccgtcctactatactccactgggtgcggcacggcccctggacaagggcttgagtggatgggacagatcgacgaccctaacactggtacgaacaacaaaactatcgacacgagatatttcgagggacagggtacaccagtacgaaccaacggacaacgtccaataacgacaactagttacataggaagtaaagtacggctagagtatcgtaggacaacgacggccgtaatacttacgtgtacgtacggttaattaaccgggactagtttaacgagtttacggtttagtacgtttaggttttaaccg

SEQ ID NO: 97118 - DNA, 622 bp, Homo sapiens
  misc_feature: GYAE6OF02HPCT0.26.80.H03.1.454.CMB.1.raw
  modified_base (358)..(358): a, c, t, g, unknown or other
  misc_feature (358)..(358): n is a, c, g, or t
  modified_base (382)..(382): a, c, t, g, unknown or other
  misc_feature (382)..(382): n is a, c, g, or t
  modified_base (604)..(604): a, c, t, g, unknown or other
  misc_feature (604)..(604): n is a, c, g, or t
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcgagtgaaggtctcctgcaaggcttcgtggatacaccttcaccgcctactatatccacgtgggtgcggcacggccccgtggacaacgggtcttaggacggttggatggggacacgatcgacgtaccctaaacnccgtggtcgaacgaacaaaacgtntacgccgaactaggaacgtacgtttacgacgggtcgtaaggggtcccaaccgacgttacgaacccgaacgggaccaaccggtccaagttaaacgacgtacgtaacgtttaacagttacggaaggtaaacgtaacggtcgtagaagtatacgtgaacgacgacgccgtattacgttacgtggatacggttaagttaacggacgtatacggtacttaggttttntagttttaggttttacgg

SEQ ID NO: 97119 - DNA, 640 bp, Homo sapiens
  misc_feature: GYAE6OF02IDYC7.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagccgtgggcctcgagtgaaggtctctgcaaggcttctggatacaccttcaccgctactatactccactgggtcgcggcacggccctggaccgaggcttggaggtggagtgggacacgatcgacgccctaacacgtaggtacgaacaacgtaaactagtacgaccaacgacgtaagttactttacgagggtcgtacgggtaccaaccgtagtacgaaccgacggaccacgaccaagtaacgctaacgtacgtttacaagtaggaaagtaaagtaggtacgtagtaacgacgttacgtacggaaaccgaccgtacgggtacccgttaattacgtttagtacggttaggtaccgtttaaaggttaacggtagttacggttaacgtttaaggttaaggttttacggttttagttacggtttttttacggg

SEQ ID NO: 97120 - DNA, 653 bp, Homo sapiens
  misc_feature: GYAE6OF02HVIJZ.26.80.H03.1.454.CMB.1.raw
  modified_base (358)..(358): a, c, t, g, unknown or other
  misc_feature (358)..(358): n is a, c, g, or t
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaagtgaagaagccgtgggcctcgagtgaaggtctccgtgacgaaggtcttcgtggataccaccttcaccgcctactatactccacgtgggtagcggcacggtcccctggacaagggcttaggagtggagtgggacacgatcacgccctaaancgtaggtcgaacaacaaaactatacgacaacgagtaagtagtttcgaagggcgtaacgggtaccaaccagtacgaaacccgaacggaaccaccgtaccaaataacgacaacgtaacgtttaacaggtagggaaagttaaagtacggtacgtagaagtacttacgtacggaaacgaccgtaacgggtaccttaagtttaactttacgtggttacgtaaccggtttaaacgttaaccggtaagttaacgtttacgtaagtttaggtttttacgtacggtttttaggttttaaccggg

SEQ ID NO: 97121 - DNA, 598 bp, Homo sapiens
  misc_feature: GYAE6OF02GISJL.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagagccgtgggcctcagtgaaggtctcctgcaggcttctggatacaccttcaccgcctactatactccactgggtgcggcacggccccgtggacgaagggattggagtggagtgggacacagtcacgtaccctaacacgtggtacgactaacaaactagtcgacacagagtatttacgagggtccgagggtccaaccgtagtaccggaccgaaccgggacctaccgtaccgaataaacgacctaactagtttaaccagtagggaaggtaaagtaggacgtaggagtatcgtacgacgacgaccggacgttatacgttactggtactacggtttaagtaacggtagttagttacgtagtttggttttagttagttttaggttttaccgg

SEQ ID NO: 97122 - DNA, 573 bp, Homo sapiens
  misc_feature: GYAE6OF02IYUSF.26.80.H03.1.454.CMB.1.raw
  modified_base (360)..(360): a, c, t, g, unknown or other
  misc_feature (360)..(360): n is a, c, g, or t
  modified_base (421)..(421): a, c, t, g, unknown or other
  misc_feature (421)..(421): n is a, c, g, or t
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctgggctgagtgagagcctgggcctcagtgaaggtctcctgcaaggcttctggatacaccttcaccgcctactatatccacgtggtgcggcacggcccctggacgaagggcttggagtggatgggacacatcacgacccctaacacgtggtagacaacaaactancgtacacagacgtagtttacgagggacgaggtacacatgaccgtacggacaccgtaccaanaacgacactacgtttacagtaggaagtaaagtaggacgtagagtacgtacgtacggacgacgtacggtaccgtagttacttacgtgtacgtacgttaagttaacggtactacgtttacgtagtttagttttcgttagtttggttttaaccgg

SEQ ID NO: 97123 - DNA, 594 bp, Homo sapiens
  misc_feature: GYAE6OF02HGOLC.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggacgcccactcccaggtgcagctggtgcagtctggggctgaagtgaagaagccgtgggcctcgagtgaaggtctcctgcaaggcttcgtggactacctaccgttcaccgcctactatactccacgtgggtcgccggcgacggcccctggaccgaagggcttggagtggagtgggaacacactcgacgacccctaaacgcgtggtacgaaccaactaaactatacgacacgaagagtatttacgagggtcgtagggtccacgagtacgaaccgacggacacgaccaagtacgacacgtagttacagtaggaagtaagtaggacgtagagtatcgtacggaacgacgacgtaccgtattacgttacgtgtacgtacgttaacgtaacggtagtacttacggtagtttgtttacgtagttttaggtttacgg

SEQ ID NO: 97124 - DNA, 586 bp, Homo sapiens
  misc_feature: GYAE6OF02F42W2.26.80.H03.1.454.CMB.1.raw
  modified_base (191)..(191): a, c, t, g, unknown or other
  misc_feature (191)..(191): n is a, c, g, or t
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtncagtcgtggggctgaagtgaagaagccgtggggcctcaggtgaacggtctcctgacgaaggtcttcgtggatacctaccttcacccgtcctactatatcccacgtgggtgcggcacggcccctggacgaagggcttggagtggagtgggacacatcgacgaccctaacacgtggtacgaacactaaactatcgacacgagtagacttcgaggacgagggtcacgatacgaccgaccggacaccgtactaagtaacgacaacgtagttacagtacggaagtaaagacggtctaggaagtatcgtacgacgaacgtaccggtaccgtattacgtgttggtagtacgttaagttaacgagtacgttacgtagtttgtttagttagtttggttttacgg

SEQ ID NO: 97125 - DNA, 556 bp, Homo sapiens
  misc_feature: GYAE6OF02FISE2.26.80.H03.1.454.CMB.1.raw
  modified_base (249)..(249): a, c, t, g, unknown or other
  misc_feature (249)..(249): n is a, c, g, or t
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagagcctgggcctcagtgaaggtctcctgcaaggcttcnggatacaccttcaccgcctactatatccactgggtgcggcacggcccctggacgagggtcttgagtggagtgggacacatcagccctaacacgtggtcaacacaaactatgacacagatattcgaggcgaggtcacgatcgaccgacggacacgtacaataacgctactacgttacagtacgggaagtaaagtaggactaggaagtattcgtacgacgtacgaccggtacgttatacgttacgtggtagtacgttaagttaacggagttacgttacgtagtttagtttgttagtttggttttaccgg

SEQ ID NO: 97126 - DNA, 520 bp, Homo sapiens
  misc_feature: GYAE6OF02HDP49.26.80.H03.1.454.CMB.1.raw
  modified_base (342)..(342): a, c, t, g, unknown or other
  misc_feature (342)..(342): n is a, c, g, or t
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcgagtgaaggtctcctgcaaggcttcgtggatacaccttcaccgcctactatatccactgggtgcggcacggcccctggacaagggcttgagtggatgggacacatcagccctaacnctggtgaacacaaactatgcacagagtatttcagggcagggtcacatgaccacggacacgtcaataagcacagttacatggagtaaataggcgtgagagtctagacgacacgcgtatattcgtgtagtacgttagttacggagtacttacgtattgtttgttacgttaggttttaacg

SEQ ID NO: 97127 - DNA, 950 bp, Homo sapiens
  misc_feature: GYAE6OF02G0CNZ.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggacttccttcttcgttgggtcggcgacgacgacgaccaacgacggaccgaccctacctcccggtaggtacgcgacgtcggttggcgacgtacggttcgggtgggtacgtaggaaggtaaggaaacggtaccggtccgggtacgggtaccctacggtaaggtagggttaccgttccgttaccgtacggtacggtacggttcctttacggaacgtaaccttaaccccttacccgttacccgacccttaccttacttactaccgtccgtagggtcggggccgaccggaccggtacccggtacccggtaggaacggtaccgggttgttaagggtacgggacggtacggtaacggaacctcgtaacgacccggaacccttaaccgtacggtacggttaccggaaaaccgaacctaaaaccgttaaatccgtcccggaaacaacgggttaaggttacccgttttaacgggaccgggaacgggttaacccgggtaccgtaacccgaacggtaccggtaaccccgaacccggtaaccgtaacccgtaccgtaacgaaacgttacgaaccctttaacgttaacgttaacggtaagggtaaaccgggtaaagttaacggtaccgtaggttaacgacggtttaaccgaaccggtcggtaaacctaaaccggttacgtttaaaccgtttacgttacggttacgtttaaccggggttaacttaaccggtttaaacgtaaccggggtttattttaaaccgggttttacggtttttacggtttttacgggttttttacggtttacgggtttttaaccggttcccggggg

SEQ ID NO: 97128 - DNA, 702 bp, Homo sapiens
  misc_feature: GYAE6OF02HBXCU.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaagtgaagagccgtgggcctcgagtgaaggtctccgtgcgaaggtcttcgtggatacctaccttcaccgcctactatactccacgtgggtgcggcacggccctggacaaggcttgagtggagtgggacacgatcgacgtaccctaacacgtggacgaacaacaaaacttatacgacaacgagacgtacgtttacggaagggtacgtagggtacctaaccgtaagttacggaacccgaacgggaaccctaaccgtaccgtaaacgtaaacgtaccaacgttaacgtttaaacgaagtaacggggtaaacgttaaaaggtacggtacgtaagaacgtaactacgttacggaaccggaaaccgtaccgggtaccgttaagttaacgttaaccgtacggttacggttaaccggtttaaacggtttaaacgggtaaccggttacgttaacggttaaggtttaggttttttaacgttacggttttttaggttttaaacccggg

SEQ ID NO: 97129 - DNA, 697 bp, Homo sapiens
  misc_feature: GYAE6OF02G37N8.26.80.H03.1.454.CMB.1.raw
tcagagactatactcacgaccggtgctcgatttagctgtgcgtcgaaggggaaagggggagcatcacccagcaaccacatctgtcctctagagaatcccctgagagctccgttcctcaccatgactggactggaggatcctcttcttggtgcagcagccacaggacgcccactcccaggtgcgagcgtggtgcagtcgtggggctagaagtgaagaacgtccgtggggcctcgaggtgaggtctccgtgcaggtcttcgtaggactacgaccttcaccgtcctactatctccagtggtgcgcgacggcccgtaggacgaggtctggagtggatggacacatcaccgtaccaactagtggacgaaccaacgtaaactgtagaccgacagtagttacgttacggacggacggtacgggtaccaaacctacggtacgaacccgaaccggaaccgtacccgtaccgtaaacgtaaccgaccgttaaacgttacgttaaacgacggttaaacgggaacggttaaaacggtacggtaaccgtaggaacggtaagttccgtaaggaacccggtaaaccggacggtaaccgtttagtacgtttaacgtcggttaacgtttaccgggtttaaacgtaaccggtaacggtttattaaccggttagttttacggttttacggtttacggtttttaaggtttacccggg

SEQ ID NO: 97130 - DNA, 608 bp, Homo sapiens
  misc_feature: GYAE6OF02F0SY6.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaagtgaagaagcctgggcctcagtgagtctcctgcgagcttctggatacaccttcaccgcctactatactccacgtgggtgcggcaggccccgtggacgaggcgtgagtggatgggacacatcgacgaccctaacacgtggtagacaacgaaactagtgacacagagtactttacgaggacgagggtccaccgtagtacgaccgaacggaccaccgtccaagtaacgactacgtaacgtttaacagtacgggtaagtaaagtcggtactaggtaatacgtacacggaaccgacgtaccgtaccgttagttacgttacgttggtacgttacggtttaacgttaaccggacgtaacgttttacgtaagtttggttttaggtttacgtttagggtttttaacccgg

SEQ ID NO: 97131 - DNA, 773 bp, Homo sapiens
  misc_feature: GYAE6OF02GSCJ2.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggacgcccacctcccaggtcgcagcgtggtcgcagtcgtgggctgaagtgaagacgccgtcggggcctcgagtaggtaaggtcctccctggacgaaggtcttcgtaggactacctacccttaccacccgccttactatactcccacggttgggtacgccggcgtaccggtccccgtaggacggaacgggctttggaggtggtaggtggacctacgtagtaccgaccgtaacccctaacgacgttcggtaacgaacctaaccgtaaaacttcgtacgacctaacggaaacgtagttaaccgtttacggggacgggtaaccggtaccggggtaaccgtaacccgtacggtaaccggaaacccggtaacccggaaaccggtaacccgtaacccgtaaagttaaaccggacccgttaaacgtttaacggttaccgtaaacggtacggggtaaaggttaaacggtaggtaaccggtagtaacggtacgttaggacgaaaccgtaaccggtaccggtaccgttagttaacgttacgttcgtacggttacgttaacgttaaacggtcgttaacgttacgttagtttagtttaggtttacggtttaggttttaccgg

SEQ ID NO: 97132 - DNA, 713 bp, Homo sapiens
  misc_feature: GYAE6OF02GOZA8.26.80.H03.1.454.CMB.1.raw
  modified_base (271)..(271): a, c, t, g, unknown or other
  misc_feature (271)..(271): n is a, c, g, or t
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggacgcccactcccaggtgcagctggtgctaggtcgtggggactggaaggtgaagacgccgtaggggcctacgaggtggaagggtcctccgtgacgaaggtcttcgnggactaccgacctttcacccgtacctactactactaccacgtgggtcgccggtacgaccggtccccgtaggacgaaggggtcttaggaggtacggagtacgggactacgtactaccgacgtaccctaagaccgttaggtacaacaaactaacgttacgacgtacaacgagagttacgttacggacgggacgtacggtcaacctacgtaccgaacccgaacggaacctaccggtaccaagttaacgactaaccgttacgttaacgaggtaggtaaaggtaaagtacgggactaggagtacgttacgtacggaaccggtaacgacccggtacgttacgttacgttacggtaggttacggttacggttaaacggttaaccggtaagtttacggttaacggtttcgtttaggtttttacggtttacgttttacgggttttaccggg

SEQ ID NO: 97133 - DNA, 682 bp, Homo sapiens
  misc_feature: GYAE6OF02GK558.26.80.H03.1.454.CMB.1.raw
  modified_base (254)..(254): a, c, t, g, unknown or other
  misc_feature (254)..(254): n is a, c, g, or t
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaagtgaagagccgtggggcctcagtgaaggtctccgtgcaaggcttcgnggataccaccttcaccgccttactatactcctagtgggtgcggcgacggcccctggacgagggcttggagtggagtgggacactatcgacgtacccaacgacgtggtacgaacaactaaactatgacacgagagtacgtttacgagggtacgacgggtacaaccgtactacggaccaaccggaaccgaaccgtaccgtaacgtaaacgaccgtaacgtaacgttaactaacgtaagggtaaggtaaagtacggtacgtagaagtaacttacgtaacgaaccggtaccgtaaccggtaccgttacttaacgtttacggttacggtttacggttaacggttttaacggttaaacgggtaacggtttaacgtttacggttaacgttttcgggtttttaaggttttacggtttttagggttttttaacccgg

SEQ ID NO: 97134 - DNA, 705 bp, Homo sapiens
  misc_feature: GYAE6OF02HVK9P.26.80.H03.1.454.CMB.1.raw
  modified_base (147)..(147): a, c, t, g, unknown or other
  misc_feature (147)..(147): n is a, c, g, or t
  modified_base (192)..(192): a, c, t, g, unknown or other
  misc_feature (192)..(192): n is a, c, g, or t
  modified_base (207)..(207): a, c, t, g, unknown or other
  misc_feature (207)..(207): n is a, c, g, or t
  modified_base (246)..(246): a, c, t, g, unknown or other
  misc_feature (246)..(246): n is a, c, g, or t
  modified_base (357)..(357): a, c, t, g, unknown or other
  misc_feature (357)..(357): n is a, c, g, or t
tcagagactatactcacgaccggtgctcgatttagctgtgcgtcgaaggggaaagggggagcatcacccagcaaccacatctgtcctctagagaatcccctgagagctccgttcctcaccatggactggacctggaggatcctcttnttggtggcagcagccacaggagcccactccagcgcagctggcgcngtcgtggggctgaanagagaacgccgtgggctcagagaggtctctgcaaggctnggatacacttcaccgctactatcacacgtggtgacggcaacggtccccaggaccgtaaagggctttagaagttgggacgacgggtacacgactacgacgacccgttaaacncgttacggtacggtaaccaaactaaacctagtacgacaaacgaggaagtaccgttttaacgacggggaccgttacggggtaacaccccgaagttacgtaaaccggtaaaccgaaccgggtaaccgtaaccgttaaacggaaaaccttacgaaaaccgttaacggtttaacaacgttaacggggtaaagttaaaacgggtaacgtcgttaacgaagtacgtacgttacggaaaccgtaaccgacgggtacgttaaccgttattaacggttcgtaggttcgttaaacgttaaggtacccggttaggttaacccttatttaaccggtttgttacgtttaggtttaacccgg

SEQ ID NO: 97135 - DNA, 630 bp, Homo sapiens
  misc_feature: GYAE6OF02F9PRS.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagagcctggggcctcagtgaaggtctcctgacaaagcttctggatacaccttcaccgcctactatatccactgggtgcggcacggcccctggacgaaggcttgagtggatgggacacatcacgccctaacacgtggtacgacaactaaactatacgcacgagagtatttcgagggacgagggtcacgatcgaacccacggacgaccgtaccaacgtaacgcctaacgttagtttaacagttacgggaaaggttaaacgtagggtctaggagtactaccgtagaacggaaccgtacgggaccgttagttacgtttacggttacggttacggttacgtttaaacggtttaaccgggtaacgttacggtttaacggttacgttttaggtttttaggttaagtttttcgggttttttaaccggg

SEQ ID NO: 97136 - DNA, 693 bp, Homo sapiens
  misc_feature: GYAE6OF02G0P5G.26.80.H03.1.454.CMB.1.raw
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaagtgaagagccgtgggcctcgagtgagtctccgtgcgaggcttcgtggactacaccttcaccgtcctactatactccacgtgggtgccgggcacgggtccccgtgggaccgaacgggtcgttggaggtgggagtcggggactaacgatccaacgcccctaaacgactggtagaaccaacgtaaactacgtacgaccaacgaacggtaagtacgtttacggaacggggtaccgtaacggggtccaaaccgtagttccgggaaacccgaccgggtaaccgtaaccggtacccgtaaagttaaccggacctaaccgttaacgtttaacgaaggttagggtaaacggttaaacggtagggactttaagggagtaacgttcgtaacggaaccgtaaccgacggtaccgtatttacgttacggtgttacggttacgttaacgttaaggtacgtaattacgttgtttagttttagttagtttggttttaaccgg

SEQ ID NO: 97137 - DNA, 752 bp, Homo sapiens
  misc_feature: GYAE6OF02FYVQO.26.80.H03.1.454.CMB.1.raw
  modified_base (170)..(170): a, c, t, g, unknown or other
  misc_feature (170)..(170): n is a, c, g, or t
tcagagactatactcacgaccggtgctcgatttagctgtgcgtcgaagggaaaggggagcatcacccagcaaccacatctgtcctctagagaatcccctgagagctccgttcctcaccatggactggacctggaggatcctcttcgtggtggcagcacgccacgaggacncccgacctcccgaggttcgccgaagcgtggtcgcgagttccgtggggactggtaagtgaagacgtccggtggggccctcgagttaggaacgtcctccgtgacgaacgtcgttacgtcggtactaccaccgtttacaccccggccttaacttacgttactcccgtaacggttcggggtacgcccgggtaccgaccgggtcccccctaggggaaccggaagggtcctttagggacggttcggaacggttcgggaactaccggtactaaccggtacccggaccctaaacgtaccgttggggtaaccgaacgtaaaaccgttaaaccttagtccggtaaacaacccggtaggttaaaccgtaggtttacccggagggtaccggaggtacccgaacgtacgtacgtaccgaaccgtacgaccgtacctaagtaccactacgttagtacgtagtagggtaacgtaaggtacgtctagaagtacgtattaggaacccgtgtaccgacttacgttagttaccgtggtaccgttaggttaacgtaacggtattacggttcttaagttttgtcggttagtttggtttaaccg

SEQ ID NO: 97138 - DNA, 643 bp, Homo sapiens
  misc_feature: GYAE6OF02GBEJ6.26.80.H03.1.454.CMB.1.raw
  modified_base (184)..(184): a, c, t, g, unknown or other
  misc_feature (184)..(184): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (348)..(348): a, c, t, g, unknown or other
  misc_feature (348)..(348): n is a, c, g, or t
  modified_base (385)..(385): a, c, t, g, unknown or other
  misc_feature (385)..(385): n is a, c, g, or t
tcagagactatactcacgaccggtgctcgatttagctgtgcgtcgaagggaaagggggagcatcacccagcaaccacatctgtcctctagagaatcccctgagagctccgttcctcaccatggactggacctggaggatcctcttcttggtggcagcagccacaggacgcccactcccgaggtncagctggtgcagtcgtgggctgaagtgaagacgcgtgggcctgagtgaaggtctccgngcgagtntcgtggatacaccttcaccgacctactactactaccacgttgggtacgcggccgacggccccgtaggacgaacgggtcttggaggtggtagtgggacanacacgtacgaccctaacgcgtggacacgaacaactancgacacgacgaagtactacggaggacgtacgggtacacccgtagtcgtaaccgaaccgggacgtaacccgtaccgaaagttaaccgaccgtactacgtttaaacgaggtaacggttaagggtaaacgtacggtacgtagaacgtacgttcgacgaaccggtaccgaacggtacgtattaagtcgttaaggtacggttaccgtttaaggtaaccggtactacgttacgtagttgtttgttaggttttagttttaccggg

SEQ ID NO: 97139 - DNA, 519 bp, Homo sapiens
  misc_feature: GYAE6OF01CTX7B.38.53.E09.1.454.CMB.1.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctccagataccaccggagaaattgtgttgacgcagtctccaggcacctgtctttgctccaggggaaangccacctctcctgcagggccagtcagactgtagcagcagctacttagcctggtaccagcagaaacctggccaggctcccaggctcctnatctttggncatccagcagggccacgtggcatcccagacaggttcagtggcaggtgggtctgggacaggtacttcactctacaccatcacagactggagccgtagaagtatttgactagtttatactgtcagtctagtatgacttagtttacctcttctacgtttcggacggtacggacgtagggtcggactagtacgaaagtactggtacggctcgacacatctgtcttacg

SEQ ID NO: 97140 - DNA, 507 bp, Homo sapiens
  misc_feature: GYAE6OF01DSB0M.38.53.E09.1.454.CMB.1.raw
  modified_base (149)..(149): a, c, t, g, unknown or other
  misc_feature (149)..(149): n is a, c, g, or t
  modified_base (157)..(157): a, c, t, g, unknown or other
  misc_feature (157)..(157): n is a, c, g, or t
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
  modified_base (370)..(370): a, c, t, g, unknown or other
  misc_feature (370)..(370): n is a, c, g, or t
  modified_base (393)..(393): a, c, t, g, unknown or other
  misc_feature (393)..(393): n is a, c, g, or t
  modified_base (411)..(411): a, c, t, g, unknown or other
  misc_feature (411)..(411): n is a, c, g, or t
  modified_base (423)..(423): a, c, t, g, unknown or other
  misc_feature (423)..(423): n is a, c, g, or t
  modified_base (438)..(438): a, c, t, g, unknown or other
  misc_feature (438)..(438): n is a, c, g, or t
  modified_base (486)..(486): a, c, t, g, unknown or other
  misc_feature (486)..(486): n is a, c, g, or t
  modified_base (497)..(497): a, c, t, g, unknown or other
  misc_feature (497)..(497): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccgganaaattgtnttgacgcagtctccaggcaccctgtctttgtctccaggggaaangccaccctctcctgcagggccagtcagactgttagcagcagctacttagcctggtaccagcagaaacctggccaggctcccaggctcctcatctttggncatccagcagggccactggcatcccagacaggttcagtgcagtggtactgggacagcttcactctcaccntcaccagactggagcctgaagtnttttgctagtttattacngttcagcagtangtactagtttacctnttcacgtttcggcggtagggaccaggggtcgacatacgaaagtactgnggctgcaaccntctgtcttac

SEQ ID NO: 97141 - DNA, 728 bp, Homo sapiens
  misc_feature: GYAE6OF01DE0V7.38.53.E09.1.454.CMB.1.raw
  modified_base (200)..(200): a, c, t, g, unknown or other
  misc_feature (200)..(200): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctccagataccaccggagaaattgtgttgacgcagtctccaggcaccctgtcttgtctccgaggggaaancgccaccctctcctgcagggccagtcagactgtagcagcagctacttagcctggtaccagcaagaaaccgtggaccaggcctcccgaggcctccgtctattcgtttggctctactcccgaggtccgaacgggccctaacgtcggacctactcccgaagacgtaggtttcaaggtcggacgagggttcggggtcgtacggggactacggtacctttccgaacgttcctaccgaaccctatacccgaaccgtacgtaaccgttgggaccgtcccgttaaggtaaacgttacgtttttacggaccgtttaaggtttttaactttaaccgttcgtacgtaaggtcttaagggttaacttaggttaacgtttaccgtttttaccctacgttaccgttacgttttaccggggacgggttaaccggggtacggttacggggtaacggtaaccgtaacgttaacccggtaaaaggtacggttcggtacgggtacctacggtaccctaaccgtagttaccgttcgttaccgttaccg

SEQ ID NO: 97142 - DNA, 539 bp, Homo sapiens
  misc_feature: GYAE6OF01DLP3V.38.53.E09.1.454.CMB.1.raw
  modified_base (535)..(535): a, c, t, g, unknown or other
  misc_feature (535)..(535): n is a, c, g, or t
tcagtcgatcacgtcacgaccggtgctcgatttagagagagtgtgttgggactgagctggattttccttttggctattttaaaaggtgtccagtgtgaagtgcagctggtggagtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccgattcaccatctccagagacaacgccaagagctcctgtatctgcaaatgaacagtctgagacctgaggacacggccttctattctgtgacaaaggcccgtatggcagtagctaagaggttctttgactcgtggggccagggaacccggtcaccgtctcctcacgccctccaccgaacgggcccacgtccggtccttcccccgtggccgcccctcgcctccgacggacgccacccgtccgngacg

SEQ ID NO: 97143 - DNA, 548 bp, Homo sapiens
  misc_feature: GYAE6OF01DIUZ8.38.53.E09.1.454.CMB.1.raw
  modified_base (401)..(401): a, c, t, g, unknown or other
  misc_feature (401)..(401): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagactgttagcagcagctacttagcctggtaccagcagaaacctggccaggctccaggctcctcatctttggtgcatccagcagggccacgtggcatcccagacaggttcaggtggcaggtgggtctgggacagacttcactctcaccatccaccagactggacgcctgaagtntttgctagtttattactgtcagctagtatagtattacgtttacctctactacgtttcgggcgggtaagggtacccgtaggggtacggactaagtaccgaaacggtacgttggacgggtactcgaccacctattcttgttccttaccg

SEQ ID NO: 97144 - DNA, 550 bp, Homo sapiens
  misc_feature: GYAE6OF01C9DTR.38.53.E09.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (456)..(456): a, c, t, g, unknown or other
  misc_feature (456)..(456): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangcccacctctcctgcagggccagtcagactgtagcagcagctactgcctggtaccagcagaacctggccaggctcccaggctcctcattcgtttggncatccagcgagggccagtggcatccccagacaggttcaggtggcaggtgggtctgggacagtcttcactctcaccatcaccagacgtggacgctagaagttatttcgacttagttttacttacgtgtacagtctagttatagtatttacgtttacctnttcgtaccgttttcggacgggtaacgggaccgtaggggtacgactagtaacgaaacgtacgttcggtagcgtcgacactatcgtgttcttaccg

SEQ ID NO: 97145 - DNA, 818 bp, Homo sapiens
  misc_feature: GYAE6OF01DG229.38.53.E09.1.454.CMB.1.raw
  modified_base (181)..(181): a, c, t, g, unknown or other
  misc_feature (181)..(181): n is a, c, g, or t
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
  modified_base (317)..(317): a, c, t, g, unknown or other
  misc_feature (317)..(317): n is a, c, g, or t
tcagtcgatcacgtcacgaccggtgctcgatttagagagagtgtgttggggtcctagggggagaccttggtaggagcctcggcaggtccctgagactcctcctgtgcagcctctggattcaaatttatgataatgccatgcacgtgggtccacaacgctccagggaggcctggagtggtcnagtgtagtgacngtgtaccagtacncctatgacggactcgtgtaggaagggcctattccaccacttccaccagacgaacaaccgcctaaggagctccctgtactctgacaaatgaacagtctgagccgtgaggacncggtccttctatttcgtgtcgaaccgaaaacggtcccgtagtcggacgaagtaacgacgtaaggtacggtttacgtttacgacctccggtacggggaccgtaaccggggtaaccccgggtacgtaaccccggtacctccccttaccgaaccggtcccctaccccgaaaccccggaaccgggtacccctaacgttcccgggttacccctttcccccggtaccgggccccgtcccccgttcggtacccctaccccggtaacgggtaccgaaccccgtaccccggttaccccgggaacgggtacgtaccccgtaacggtacccgggtcccgggccccggttacgggggtaccctaccgggtaccccgggttaacggggttaaaccgtaaacggggttaaccccgttttaaccccgtttaacccccgttaaccgggtttacgtaacccggttaacccgggtacccggttaaccggggaacccggggtcccgggggtaaccccggg

SEQ ID NO: 97146 - DNA, 552 bp, Homo sapiens
  misc_feature: GYAE6OF01CGG82.38.53.E09.1.454.CMB.1.raw
  modified_base (201)..(201): a, c, t, g, unknown or other
  misc_feature (201)..(201): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacctctcctgcagggccagtcagactgttagcagcagctacttagcctgtaccagcagaacctgccaggctccaggctcctcattctttggcgcatccagcacgggccacgtcggcatcccgagactaggttcagtggcaggtggtctgggacagtacttcactctcacatcacagactggacgcctagaagtattttgactagttttatactgtcagcaagtatgtattacgtttacctcttactacgtttcgggacggtagggaccgtaggggtacgaactagtaaccgtaaacgtaacgttcggtacggtcttacggacctaccgtattccgtcgttccttaccg

SEQ ID NO: 97147 - DNA, 726 bp, Homo sapiens
  misc_feature: GYAE6OF01CDWBO.38.53.E09.1.454.CMB.1.raw
  modified_base (204)..(204): a, c, t, g, unknown or other
  misc_feature (204)..(204): n is a, c, g, or t
  modified_base (312)..(312): a, c, t, g, unknown or other
  misc_feature (312)..(312): n is a, c, g, or t
tcagtcgatcacgtcacgaccggtgctcgatttagagagagtgtgttgggtttggggagaagggctgctcagttaggacccagagggaaccatggaaaccccagcgcagcttctcttcctcctgctactctggctcccagataccaccggagaaattgtgttgacgcagtctccaggcaccctgtctttgtctccaggggaaancgcccaccctctcctgcagggccagtccagactgttagcagcagctacttagcctggtaccagtcaacgaaacctggccaggcctccgagcctcctcattcgtttcgngtcactccagtcagggccacgtggacacgtcccgaggtactacggttccaggtcggcgaggttcgggtctacgggacacggtacctttccgacctttcctaccgaccctaatcccgaaccgacgtaccgttaggaccgtccgttaaggaacgttacgtttcgacgttaaggttttaacttacgttggttaccaaggtccttaagttatagttaacgtttaaccggttttaccttaccgttaccgtaccggtttttaccggggaccggtttaaacgggggacccggttaacgggggttcgggtaaacccgtaaggttaaccccggtaaaacggtacccgggttttacggtacgggtaccgttaccggtaccctaaacccggtacgtttccggttaccggttccccgtttaacccg

SEQ ID NO: 97148 - DNA, 666 bp, Homo sapiens
  misc_feature: GYAE6OF01BKVSJ.38.53.E09.1.454.CMB.1.raw
tcagtcgatcacgtcacgaccggtgctcgatttagagagagtgtgttgggtttggggagagctgctcagttaggaccagaggaaccatggaaccccagcggcagcttctcttcctcctgctactctggctaccagataccaccggagaaattgtgttcgacgcacgttcctcccaggccacccgtgtctttgtctccgaggggaaacagccaccctctcctgcctagggccagtcagactgttagcagcaggctacttagcctggtaccagcaagaacctggcccaaggcctcccgagcctcctacgattcgtttggtcgactacgttcccagcgtagggccacgtggacacgtcccagaccgaggttacaggttcggactaggtcgggtactagggacaggtacctttcgaccgttctaccacctactccgaacctaggtacgttacggaacgtacccgttagtaacgttagttttacgacttaagttttattacgttgttactacgtactaacgttacgttacggtacgttaacggtttacctacgttaccgttacgtttaccggacggtaacgggtaccgtacggggtcggtacgtacgtaccgtaaaccgtaacgttcggtacggtctacgtaccctaccgtacttccgttcgttcttaccg

SEQ ID NO: 97149 - DNA, 603 bp, Homo sapiens
  misc_feature: GYAE6OF01CMNHQ.38.53.E09.1.454.CMB.1.raw
  modified_base (281)..(281): a, c, t, g, unknown or other
  misc_feature (281)..(281): n is a, c, g, or t
  modified_base (307)..(307): a, c, t, g, unknown or other
  misc_feature (307)..(307): n is a, c, g, or t
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggattttcctttggctattttaaaaggtgtccagtgtgaagtgcagctgggtggagtcgtggggggagacttgggtagagcctggcaggtccctgagactctcctgtgcagcctctggtattcaaaatttangataatgaccatgcacgtgggtccanaagcctaccgaggggaaggccgtgggagtcgggtctcgaaggttgttaggttggaacaggttggtaccatacgcctagtcgcggtactcgtggtagaacgggtccgtattcacctatcctccaagacgacaacgaccaagacgtcctacccgtgtactctagactaaagtcgaaacctagtcgtaggacgtaccgtaggacggaccgccggttaccctttacttactttccgtcgtacgaaccgtaaaccgggtccccgtaagtcggacgtagtacgtacgttaaggtcggtttcg

SEQ ID NO: 97150 - DNA, 610 bp, Homo sapiens
  misc_feature: GYAE6OF01EN6FJ.38.53.E09.1.454.CMB.1.raw
  modified_base (201)..(201): a, c, t, g, unknown or other
  misc_feature (201)..(201): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctcgaggggaaangccaccctctcctgcagggccagtcagactgttagcagcagctacttagcctggtaccagcaagaaacctggaccaggcctcccgaggcctcctctattcgtttggtcgctactccgagcgacgggccacgtggcactcccgaagacgtaggttcaggtcggctaggtgggtcgtaggggactaggtaccttcgactcctaccacctactaccaacccgaggtaccgtggaaccgtccgtaggaacgttattttacgactttaaggttttaacttacgtgtaccagtactagttagtgtaactttacgtttacctcttaccgttacgtttcgggacggtaagggaccgtagggtacgactacgtacgaaaggtactggtacgctacgcctacgtattcgttgtcttacg

SEQ ID NO: 97151 - DNA, 762 bp, Homo sapiens
  misc_feature: GYAE6OF01ASIN7.38.53.E09.1.454.CMB.1.raw
tcagtcgatcacgtcacgaccggtgctcgatttagagagagtgtggttgggtttgggggagtagctgctcagttaggacccagagggaaccatggaaaccccagacgcagcttctcttcctcctgctactctggctcccagactaccaccggaggaaacttgtcgttgacgcagtctccaggcacccgtgtcgtttcgtctccaggggaaagagcccacccgtctcccgtgccgacgggaccagtcacgtacgttgttacgcgacgcacgacttacgttacgccgttacggtaaccacggtacctaaaccggtaaaccgtcggggacccgtacgggtacccttaccccggacggtccccttccccgtaacgtaacggtttccgttttggggtcgtacgtaccgttaccggaggtaccgtaccgggacctaggtcgggactaccgtaccccgaagaccgtacggttaccaggtacccggagtagggtcggtcgtacggtaacgacgtactaccaccgtcctaccgaacctacttaccaccgacgtacgtacgggacgtacccgtaagtaacgttcgtttacgaccgtttaacgtttacttacgtacggtacgtaggtacctaagttactacgttaacgttacggtttacctcgtaccgttacggtttccggacgggtacgggtaccggtagggttacgacgtacgtaacgtaacggtacgtggtcggtacgtacgaccgtacgtagtccgttgttccttaccg

SEQ ID NO: 97152 - DNA, 683 bp, Homo sapiens
  misc_feature: GYAE6OF01BHRMA.38.53.E09.1.454.CMB.1.raw
  modified_base (196)..(196): a, c, t, g, unknown or other
  misc_feature (196)..(196): n is a, c, g, or t
  modified_base (306)..(306): a, c, t, g, unknown or other
  misc_feature (306)..(306): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctccagataccacggagaattgtgttgacgcagtctccaggcacctgtctttgtctcgaggggaancgccacctctcctgcgagggccagtcagactgtagcagcagctacttagcctggtaccagcaacgaacctggaccaggcctcccgaggcctcctctacgttcgtttggcnctactccgagccgacgggccacgtcggaccactcccgaagtaccgtagggttcaggttcggacgtaggttcggggtacgttacggggaactacggtacctttaccgaccgttcctacccaacccttactacccaaccgtaacggtaccgtacgggaccgtaccgttaaggtaaagttacgttttacggacgtttaagttttacgttacgttcgtaccgtaagtacttaagttacttacgttaactttacgtttacctacgtttaccgttacggtttacgggacgggtaacgggtaccggtagggtacgtaacgtaacgtaaccgtaaacgtacgtcggtacggactacgacctacgtattccgttgttcccgttacg

SEQ ID NO: 97153 - DNA, 533 bp, Homo sapiens
  misc_feature: GYAE6OF01BX8DE.38.53.E09.1.454.CMB.1.raw
  modified_base (299)..(299): a, c, t, g, unknown or other
  misc_feature (299)..(299): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagactgttagcagcagctactagcctggtaccagcagaaacctggccaggctccaggctcctcatctttggngcatccagcagggccactggcatcccagacaggttcagtggcaggtgggtctgggacagtacttcactctcaccatcaccagactggacgcctagaagtattttgctagtttatactgtacagctagtatgtaattacgtttacctcttcgtacgtttcgggacggtacgggtaccgtagggtcggaactagtacgaaacgaacgtggtaggctcgacacctatcttgtcttcg

SEQ ID NO: 97154 - DNA, 579 bp, Homo sapiens
  misc_feature: GYAE6OF01A2JEN.38.53.E09.1.454.CMB.1.raw
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccattcaccatctccagagacaacgccaagagctccctgtatctgcaaatgaacagtctgagacctgaggacacggccttctatttctgtgcaaaacggccccggtatggcagtagctaagaggtttctttgactccgtgggccacgggaaccctggtccaccgtctcctcacgccctccaccgaacgggcccacgtccggtccttccccctcggcccacccctccctccaacgacgccaccctcgtcgggggcaccacggccggcccgtgggcctcggcccgtcgggtaccgaacgggtacctaccgttcccgaacgttgactccgactggacggccgggtcgtcgggg

SEQ ID NO: 97155 - DNA, 779 bp, Homo sapiens
  misc_feature: GYAE6OF01CVLZD.38.53.E09.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
tcagtcgatcacgtcacgaccggtgctcgatttagagagagtgtgttgggtttggggagagctgctcagttaggacccagagggaaccatcggaaaccccagcgcagcttctcttcctcctgctactctggcctccagactaccaccggagaaattgtgttgacgcagtctcagccacctgtctttgctcgaagggaaancgccacctctcngcagggccagtcagactgtagcagcagctactagcctaggaccagacaagaaactggaccaggcctccgaggtcctcctactatttcgtttggtcacaactcccgagcgaacgggcccaagtcggaccaacctccccgaagaacgtacggttacaggtcggcgtagggttcgggtaccgtaggggaacctaacggttaccttaccgaaccttccctaccgaaccctactacccgaacccgtaaggtaacccgtgggaaccgtacccggttaaggtaaacgtttagtttttacggaaccgttttaaggtttttaacttaaccgttgtaaccgaacggttacttaaaggtttagttaacggttaaacgttttaccggtttttaacccctaccgtttaacccggttaaccggttttaccgggggaccggggtaaacgggtaacccgggtaaggggtaccggtaaacctaaacggttaaaccggaaaaacgggttaccgttggggttacggtaccgttaaccgggaaccctaaccgttaacgtttcccgtttaggtttaccctttaacccg

SEQ ID NO: 97156 - DNA, 547 bp, Homo sapiens
  misc_feature: GYAE6OF01D7PNH.38.53.E09.1.454.CMB.1.raw
  modified_base (200)..(200): a, c, t, g, unknown or other
  misc_feature (200)..(200): n is a, c, g, or t
  modified_base (295)..(295): a, c, t, g, unknown or other
  misc_feature (295)..(295): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaattgtgttgacgcagtctccaggcaccctgttcttgtctccaggggaaanagccaccctctcctgcagggccagtcagactgtagcagcagctactagcctggtacagcagaaacctggccaggctcccaggctctcatcttggngctatccagacgacgggccacgtggacactccgagactaggtcaggtgactaggtcggtcgtagggacacgtactcactctcacatcacgagacgtggactcgtagattagtttgctagtttatacgcgtacagtactagtatagtaacttacgttacctctacgttacgttcggacggtaacggcgtagggtcgaacgtacgtaacgaaacgtacgtggcgtacgtcgacactagttcttagtccttaccg

SEQ ID NO: 97157 - DNA, 578 bp, Homo sapiens
  misc_feature: GYAE6OF01CJW3R.38.53.E09.1.454.CMB.1.raw
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
tcagtcgatcacgtcacgaccggtgctcgatttagagagagtgtgttgggactgagctggattttccttttggctattttaaaaggtgtccagtgtgaagtgcagctggtggagtctgggggagacttggtagagcctggcaggtccctgagactctcctgtgcagcctctggattcaaatttaatgataatgccatgcacgtgggtccgacaagctccaggggaagggcctggagtgggtctcaagtgttagttggaacagtggtaccatagcctatgcggactcgtgtggaaggccgattccaccatcctccagagacaacgccaagagcctcctgtatctgacaaatgaacngtcngagactgagacacgtccttctattctgtgacgaaacggcccgtagtggcagtagacgtaagtagttcgttgaccgtcgtcgggaccgacgggtaacccggtcgtaccgtccgtccgtaccgacgtccctaccgaaccgacgggtccccacgtcccgttcccgttcccccgtggcccgtcccgtcgcccgtcgacggacgaccgaccctccggagaccgg

SEQ ID NO: 97158 - DNA, 693 bp, Homo sapiens
  misc_feature: GYAE6OF01B0V2V.38.53.E09.1.454.CMB.1.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcacgtgggtccacaagctccgaaggggaacgggcctggagtgggtctcaagtgttagtggaacngtggtaccatagcctatgcgactctgngaaggccatcacatcncaganacacgccaagngctcctgtatctgacaatgaacagtctagacgacctagacggaccacggtccttactatttctgtacgacgtaaaacggcccgtagtcggacaggtagactaaggacggtttactttacggacctccggtacgggggaccgtaacggggtaaccccggtcacccgttcctacccgtcgaccgtcccctaccgaaccgaacgggtccctaacgttccggtccccttccccgtggtccccgtcccgtacgcccgtaccgaacggaccgacccgtaacccgtcccggaacggaccgaccgaccgtaccgggcccggtccccggttacggggtcccgttccggtacccggttacgggtaccgtaaacgggtaccccttacccgttaccccgacggttacgtaccgttaccggacgttcgggaacgggtcccgggtaccgg

SEQ ID NO: 97159 - DNA, 903 bp, Homo sapiens
  misc_feature: GYAE6OF01CKG2C.38.53.E09.1.454.CMB.1.raw
tcagtcgatcacgtcacgaccggtgctcgatttagagagagtgtgttgggtttgggggagagctgctcagttaggacccagagggaaccatggaaacccagcgcagcttctcttcctcctgctactctggctccagataccaccggagaaattgtgttgacgcagtctccgaggcaccctgtcttgtctcgaggggaagacgccacctctcctgcgacggccagtcagtacgtgtacgcagcagtctacgttacgtccgtacggtaccacgacaacgaaccgtcggaccgacggtccctaccgacggtccctacctactacgttcgtttggcgtactacctaccgacggaccggacggtacccacggtacggacctacccgtacccgaacggtacggttaccggttacgtacgggtcggtaggtacgggttcggggtacggtacgggacgtaacggttaccttaccgtaacctccgtaacctacctaccgtacccgaccgtaacggtaccggtaggggtaaccctaccggtttaaagggtaaacgttttacggtttttacggaaccgtttttaacggtttttaacgtacccggtttacgttaaccgaacgggttaacgtttaacgggtttacgtttaaacggtttaaccgttttttaacccggttttaaccccgttccgttttaaacccggggtttttaacgggttttaccccgggggggaacggggtaaaccgggggttaacccgggttaacggggggtaacggttaaacccgttaaaccgggtaaaaccgggttaaaacccggttaacggggttttccggggttaaacggtaccggttaacccggtaacccgttaaaccgttacggtttttccccgggttacgttttacccgttaacccgg

SEQ ID NO: 97160 - DNA, 689 bp, Homo sapiens
  misc_feature: GYAE6OF01C4XFO.38.53.E09.1.454.CMB.1.raw
  modified_base (631)..(631): a, c, t, g, unknown or other
  misc_feature (631)..(631): n is a, c, g, or t
  modified_base (640)..(640): a, c, t, g, unknown or other
  misc_feature (640)..(640): n is a, c, g, or t
  modified_base (671)..(671): a, c, t, g, unknown or other
  misc_feature (671)..(671): n is a, c, g, or t
tcagtcgatcacgtcacgaccggtgctcgatttagagagagtgtgttgggactgagcgtggatttcctttaggctattttaaaaggtgtccagtgtgaagtgcagctggtggagtctgggggagacttggtagagcctggcaggtccctgagactctcctgtgcagcctctggattacaaatttaatgaataatgccatgcacgtgggtccacaagctccgaggggaaggcctgggagtgggtctacaagtgttagttgggaacaggtggtaaccatacggcctaagtcggacggtactcgtggtaggaacggggtccctaattcaaccatcctaccgagacggaacaacgccaaagagtcctccctagtaactcctagacctaaaagtgaaacgtagtctaggagtaccctaggacggaacctaccgggtactttcttatttcctagtacgaaccgtaaaaccgggcccggtagtcggactagtacgacttaaggtcggtttacttggaccttccgggaggggtacccaagggggaacccccggttcaccccggttactcccgttccgaacgtccccgtaccgaaacccgggacgggtaccccaacggtcccgttaccccgttcccccgngggtccccncccgtacgccgttaccggacggaccgtaccncccgtacggactaaccgg

SEQ ID NO: 97161 - DNA, 564 bp, Homo sapiens
  misc_feature: GYAE6OF01EGO8I.38.53.E09.1.454.CMB.1.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (390)..(390): a, c, t, g, unknown or other
  misc_feature (390)..(390): n is a, c, g, or t
  modified_base (419)..(419): a, c, t, g, unknown or other
  misc_feature (419)..(419): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaanacgccaccctctcctgcagggccagtcagactgttagcagcagctacttagcctggtaccagcagaacctggccaggctccaggctccncntctttggncactccagcacgggccacgtggcactcccagacgtaggttcaggtggacgtaggtgggtcgtgggacaggtaccttcgacttctcaccntaccaccagactggacgtcctagaagttntttcggcttagttttacttacgtgtacagtctagtatagtattacgtttacctcgtacttacgttcggacggtacggacggtagggtcgacgtagtaccgaaacgtacgtggtcgacgtcgacctacgtatcgttgtccttaccg

SEQ ID NO: 97162 - DNA, 520 bp, Homo sapiens
  misc_feature: GYAE6OF01ACGGR.38.53.E09.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagactgttagcagcagctacttagcctggtaccagcagaacctggccaggctcccaggctcctcatctttggncatccagcagggccatggcatcccagacaggttcagtggcaggtggtctgggacagacttcactctcaccatcacagactggacgcctagaagtattttgacttagtttattacgtgtcagtctagttatgtaattacgtttacctcttactacgtttcgggcggtacgggtcgagggtcgacagtacgaaagtacgtggtgctagcacatctgtcttacg

SEQ ID NO: 97163 - DNA, 583 bp, Homo sapiens
  misc_feature: GYAE6OF01B8F7V.38.53.E09.1.454.CMB.1.raw
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccaggggaagagccacctctcctgcagggccagtcagactgttagcagcagctacttagcctggtaccagcagaaacctggccaggcctcccgaggcctcctcacttcgtttggcgcatccagcgagggcccatggcactcccagacaggttcaggtcggacaggtgggtctgggactaggtacttcactctacacctactcaccgagacgtggactccctagtaagtattttacgacttagtttacttactgtacagtactagttatgtaattacgtttacctcttacgtacgtttacgggcggtaacgggtaccgtaggggtcgaacgtagtaaccgtaaacggtaacgtggtacggtactcgtaccgaacctagttctcgttccttaccg

SEQ ID NO: 97164 - DNA, 801 bp, Homo sapiens
  misc_feature: GYAE6OF01CTHBQ.38.53.E09.1.454.CMB.1.raw
tcagtcgatcacgtcacgaccggtgctcgatttagagagagtgtgttgggtctgggggagacttggtagagcctggcaggtccctgagactctcctgtgcagcctctggattactaaatttaatgaataatgccatgcacgtgggtccgacaagctccgagggaagtcgccgtggaggtgggtctacgaaggttgtttaggttggaactaggtcggtaccagtacgcctatggcggtactcgtgtaggacgggccgtattcaccatcctccagagaccaacgacaagacgtcctccctgtactctgactaatacgaactagtctagacgaccgtaggacggaccgtaccggtcctttacttactttcgtggtacgaaccgtaaaaccgggtccccggttagtcggaccgtaaggtaacgtacgtaaggttacgggtttcctttacggaccgttcccgggttacgggggacccggtaaacccgggggtaaccccggttaccgtaccccgttccgtaccccgtaccgaccgtaccccgtaccccgaaacccggacgggtaccccctacgttccccggttcccctttaccccccggtcgggaccccgtccccgttcgccccttacccggaacggtccgaccccgtaaccccggtaccggaacggtaccgacccgtaccgaccgggcccgggtacccggtcgggacccgttccggacccggttcggtaacccggtaacggttaccccgtttaccgttacccggcggttaccgtacgtacccggtacgcgggtccgggtaccgggg

SEQ ID NO: 97165 - DNA, 553 bp, Homo sapiens
  misc_feature: GYAE6OF01ELPM4.38.53.E09.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccaccctctcctgcagggccagtcagactgttagcagcagctacttagcctggtaccagcagaaacctggccaggctccaggctcctcatctttggngcatccagcagggccactggcactcccagacaggttcaggtggcaggtgggtctgggacagacttcactctcaccatcacagactggacgtccgtagaagttagttttcgacttagttttacttacgtgtactagctagtatgtattacgtttacctcttcgtacgtttcgggacggtacggacgtagggtcgaacgtacgtacgtaaacgtacgttggtacgtcgtacgactaccgtattcttgtccttacg

SEQ ID NO: 97166 - DNA, 664 bp, Homo sapiens
  misc_feature: GYAE6OF01AG1C4.38.53.E09.1.454.CMB.1.raw
  modified_base (358)..(358): a, c, t, g, unknown or other
  misc_feature (358)..(358): n is a, c, g, or t
  modified_base (414)..(414): a, c, t, g, unknown or other
  misc_feature (414)..(414): n is a, c, g, or t
tcagtcgatcacgtcacgaccggtgctcgatttagagagagtgtgttggggtttggggggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtggggggagacttggtagagcctggcaggtccctgagactctcctgtgcagcctctggattcaaatttaatgaataatgccatgcacgtgggtccacaagctccgaggggaacggccgtggaggtgggtctcgaagtgttagttggaacnggtggtaccagtagcctagtcgcgacttcgtggtaggaagggccgattcaccatcnccagacgacaacgccaagcgcctcccgtgtactctagaacctaaagtcgaaactacgttcgtacggaacggtaacccgtaagggaaccgggaaccgtaacccgggtacccttttaccgttaacgttttcccgttaccggttaccggtaaacccggtaaaaacccgggggttccccccgggttaaaggttcgggtaacccgttaacgggttaaggtaacccggtttaaagggttcggggtttttaaccccg

SEQ ID NO: 97167 - DNA, 568 bp, Homo sapiens
  misc_feature: GYAE6OF01CWLNC.38.53.E09.1.454.CMB.1.raw
  modified_base (201)..(201): a, c, t, g, unknown or other
  misc_feature (201)..(201): n is a, c, g, or t
  modified_base (293)..(293): a, c, t, g, unknown or other
  misc_feature (293)..(293): n is a, c, g, or t
  modified_base (397)..(397): a, c, t, g, unknown or other
  misc_feature (397)..(397): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctccagatacccaccggagaaattgtgttgacgcagtctccaggcaccctgtctttgtctccaggggaaanagccacctctcctgcagggccagtcagactgttagcagcagctacttagcctggtaccagcagaaacctggccaggcctcccaggcctcctnattcgtttggtgcatccagcgagggccactggcactcccagacgaggttcaggtgcaggtgggtctgggacagtacttcgactctcacatccacagactggacnccgtagtaagtactttggacttagttttattactgttcagtcaagttagtagtattacgttttactccgttctaacgttttcgggacgggtacggaccgtagggttacgaactacgtaacgaaacgtacgttggtacgggacttcggacctaacagttcctgtcgtttacc

SEQ ID NO: 97168 - DNA, 618 bp, Homo sapiens
  misc_feature: GYAE6OF01BADV8.38.53.E09.1.454.CMB.1.raw
  modified_base (201)..(201): a, c, t, g, unknown or other
  misc_feature (201)..(201): n is a, c, g, or t
  modified_base (305)..(305): a, c, t, g, unknown or other
  misc_feature (305)..(305): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcacctgtctttgtctccgaggggaaangccacctctcctgcagggccagtcagactgtagcagcagctactagcctggtaccagcaagaaacctggaccaggcctcccgaggcctcctcattcgtttggcncactccgagcacggaccacgtggccacgtcccaggactaggttcaggttcggacgtaggtcgggtcgtaggggaacacggtaccttcaacttcaccacctataccgaccaggtactacgggactccgtaaggtaaacgttagttttacgacgtttaagttttaacttacgtcgtacgagtactaagtttactagtaactttacgtttacctcgttacgttacggtttcgggacggtacgggtaccgtagggtacgactaacgtacgaaaggtcgtggtcgtacttacgacctacgtagtcttcgtcttaaccg

SEQ ID NO: 97169 - DNA, 588 bp, Homo sapiens
  misc_feature: GYAE6OF01ET9J5.38.53.E09.1.454.CMB.1.raw
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
  modified_base (408)..(408): a, c, t, g, unknown or other
  misc_feature (408)..(408): n is a, c, g, or t
  modified_base (420)..(420): a, c, t, g, unknown or other
  misc_feature (420)..(420): n is a, c, g, or t
tcagtcgatcacgtcacgaccggtgctcgatttagagagagtgtgttggggtttggggagagctgctcagttaggacccagagggaaccatggaaaccccagcgcagcttctcttcctcctgctactctggctcccagataccaccggagaaattgtgttgacgcagtctccaggcaccctgtctttgctccgaggggaaangcccaccctctcctgcagggccagtcagactgttagcagcagctacttagcctggtaccagcagaaacctggccaggcctcccaggcctcctcattctttggngcatccagcagggccacgtggccactccccagacctaggttcaggtggctaggtcgggtctgggacaggtaccttcgactctcaccatccaccagactggacncctagaacgttnttttgactagttttacttactgtcagtctaagtatgtaattacgtttaccttcgttacttaccggtttcgggacgggtacgggtaccgtaggggtacggaacctacgtaccgaaaccgtacgttggtacggtacctacggacctacctagttcgttcgttccttaccg

SEQ ID NO: 97170 - DNA, 952 bp, Homo sapiens
  misc_feature: GYAE6OF01CGX7J.38.53.E09.1.454.CMB.1.raw
tcagtcgatcacgtcacgaccggtgctcgatttagagagagtgtgttgggactgagctggattttccttttggctattttaaaaggtgtccagtgtgaagtgcagctgggtggagtcgtgggggatacttggtagagccgtggcaggtccctggagactctcctgtgccagcctcgtaggattacaaaagttttatagataatcgaccagttcgctacgtcggggtaccgaacaacggtcctaccggaagggggaacgggtccgtaggggtacggttcggggtaccttacggtaaagggttggtttaacggttaggaaacgtacggttacgggtaacctagtacggtaccgttaagtcggtaccgggtaaccttcggtagggtaaccggaaacgggggtcccctaagttttacccgaaccgttaactccgttaacccgaagggtaaaccgaaaccctaaaaccggtaaccccgaaaagtaccggttcccccttaccccggttaaggttaactttacccgttaagaaaaccgttaaaaaacgcgggttaaaaccgttaccgtttacgtaacgggaaccgtttaaacccggtaggaaacccgggtaaccgttaacccgggttcccttttaacgtttacgttttaccggtacggttaaccggtaaaccggttaaaaccccgggtccccgggttaagtaccgggttaacgtaacgggtaagttaaccgttaaggttacggtttaccgtttacggaacccggttacccggggacggtaaaccggggtaccccgggttaccctaccggttacctacccgtaccgacggttaccccgaaccggtaaccggaaacccgggtcctaccggttacccgggttccccgtaccccggtcggtacccctccgtcggtacccgtaccgacggtaccgtaccgacccgtacggaaccgtcgacccgg

SEQ ID NO: 97171 - DNA, 600 bp, Homo sapiens
  misc_feature: GYAE6OF01CLYAO.38.53.E09.1.454.CMB.1.raw
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (282)..(282): a, c, t, g, unknown or other
  misc_feature (282)..(282): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccacaagctccgaggggaaggcctggagtgggtctcaagtgttagtggaacagtggtaccatagcctatgcgactntgtgaagggccatcacatcncaganacacgccaagagctcctgtatctgacaaatgaacagtcngagacctgaggacacggccttctatttctgtgacgaaaaacggcccggtatggcaagtagactaaagtacgtttctttagacctccgtgggaccgaagggaacccgggtcaccgtctcctcacgtccctaccaaccgaaacgggccctaacgtccggtcccttcccccgtggccctaccccttcccaccaagaccacccgaacccgtcggtcggggaccaaccgacggcccgcccggtgggccttcggcccgtggtaccgaagggacccttacttacccgacgtcgtactcggtactggacggcggtcgtggaaccgg

SEQ ID NO: 97172 - DNA, 707 bp, Homo sapiens
  misc_feature: GYAE6OF01AFE1T.38.53.E09.1.454.CMB.1.raw
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaancgccaccctctcctgcagggccagtcagactgtagcagcagctactagcctggtaccagcaagaacctggccgacggcctcccgggctcctcacttcgtttggcncctactccgagccgacgggccctacgtcggaccacgtcccgaaggtaccgtaggttccgaaggtcggacgtaggggtcgggtccgtacggggactaggtacctttaccaaccgttcctaccaaccctactacccgaaccgtacgtaccggtacgggtaccgtaccgttaaggtaaacgtttacgttttacgaccgttttaacgtttttaccgtttaaccgttcggtaccgtaacggtacgttaaggttacgtttagttaacgttttaccgtttacccttaccgttaccgttaccggttccgggaccgggtacggaccggtagggtacgaaccgtacgtaaccgtaaacgtggtacggtcggcgtacgaccgtacttacgttactcgttcctacgttacccg

SEQ ID NO: 97173 - DNA, 827 bp, Homo sapiens
  misc_feature: GYAE6OF01C44TG.38.53.E09.1.454.CMB.1.raw
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaaggggaaagacgccaccctctcctgcacgggccagtcagactgttagcagcagctactagcctggtaccagacaacgaaaccgtcggacccgaacggtcctaccccgacggtccttaccctcgtaacttttccggttttcggtcgtacctaacgttccccgaaacggtccggaaaccggggcccctaaacggttccgggacctaacccttacccccgaaagtaccgtacggggtttacgaacgggtcgggacgtaggggttcggggtacggttacggggaaccgtaacggtacccgtttaccgaaccgtttccgttacccaaacccctagttacccgaacccgtaacggtaccgttagggacgtacccgttaaggtaaagtttaacgttttggaacttttaacggttttacttaccgttgtaccgtaagtacctaaggttacttaggtaacttttaccggtttaccttacgttaccgttaacgggttttccgggacggggttacgggtaacccggttaacgggggtacgaaaccgttaacgtaaacccggtaaaacgggttaaccggttggttaccgggtacccgttacgtaccgaacccgtttagttaccgttcgtttacccgtttacccgg

SEQ ID NO: 97174 - DNA, 707 bp, Homo sapiens
  misc_feature: GYAE6OF01EA5LD.38.53.E09.1.454.CMB.1.raw
  modified_base (197)..(197): a, c, t, g, unknown or other
  misc_feature (197)..(197): n is a, c, g, or t
  modified_base (316)..(316): a, c, t, g, unknown or other
  misc_feature (316)..(316): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctccagataccaccggagaattgtgttgacgcagtctcaggcaccctgtctttgtctcgagggaaancgcccacctctcctgcgagggccagtcagtactgttagcagcagcttacgttacgccgtggtaccagcaacgtaaacctgggaccagggcctacccgaggtcctcctctatcgtttggncactcgagcgagggccacgttcggactactccgaggaccgtaggttacaggtcggacgttagggtcgggtacgtcgggactaggtaccttcgaccgttctaccgaacccttataccaacccgtagtaccgtacgggactacccgttagaaacgtttacggtttacggtaaccttttaggtttaactttcgtacgttacctaacggttactaaggtttaacgtaggtttaaaccgttttaccgttttaacccgttccgttaaccgtttaaccggtttccggggaacgggtacggggttaaccgtacgggggtacgtaaccttaacggtaaccgaaacggttacggtgggtaccgtccgtacgtacctaacgttcgttcttggtcccttaccg

SEQ ID NO: 97175 - DNA, 660 bp, Homo sapiens
  misc_feature: GYAE6OF01D8OX2.38.53.E09.1.454.CMB.1.raw
tcagtcgatcacgtcacgaccggtgctcgatttagagagagtgtgttgggtttgggggagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagtacgttggtagagcctggcaggtccctgacgactctcctgtgcagcctctggattacaaaatttatgaataatcgaccatcgacacgtgggtacccaacgaacgcctaccgaggggaacggtccgtggaggttgggtctacgtagttgttagtaggaactagtcggtacagtacgctagtgccgtactcgtggaggtaacggcgtacttcacctactcctacaagtacgaacgaaccgaccaagaccgtcctacccgtagttacctcgttacgaaccaaagttccgtaaacgacgttacgtaggaaccgtacggtacgtacggtaaccgtacccggttaccttaccgttactttccgttacgtaccggtaaaccggtaaacccgggtaccccggttagtacggtaccgtaaggttaacgtacgttaaacggttcggtttaaccgg

SEQ ID NO: 97176 - DNA, 782 bp, Homo sapiens
  misc_feature: GYAE6OF01A5G7R.38.53.E09.1.454.CMB.1.raw
  modified_base (202)..(202): a, c, t, g, unknown or other
  misc_feature (202)..(202): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggcctcccagataccaccggagaaattgtgttgacgcagtctcaggcaccctgtctttgtctccgaggggaaanagcccaccctctcctgcagggccagtcagtactgttagcagcagctacttagcctggtaccagcaagaacctggccacggcctacccgaggtcctcctactacgttcgttttagggcgtctacgtcccgagaccggtacggggacccacgttcgggacctaaccgtacccccgaaggtaacccgtacggggtttaccgaagggttccggggtacgtaggggtttaccgggggttaccgtagggggtaaaccctaacgggttacccttttacccgaaccgtttccctacccaacccgttactacccgaacccgtaacggtaaccgtgggaaaccttcccggtaaggtaaacgtttacgttttaggaccgttaaaggtttttaacttaccgtacgttaccaacggtagtaacgtttagtacgtttaacgtttacgtttacccgttcgttaccggtttcgttacgggggaccggttaacgggtaccggtaggggtcccgtaaacttaccggtaaaccgaaacggttacggttggttaaccggtcgttaacggaccttaccgtagttcttacgttcccgttacc

SEQ ID NO: 97177 - DNA, 762 bp, Homo sapiens
  misc_feature: GYAE6OF01AQOS0.38.53.E09.1.454.CMB.1.raw
tcagtcgatcacgtcacgaccggtgctcgatttagagagagtgtgttgggactgagctggattttccttttggctattttaaaaggtgtccagtgtgaagtgcagctggtggagtctgggggagacttggtagagcctggcaggtccctgagactctcctgtgcagcctctggattcaaatttaatgataatgccatgcactgggtccacaagctccgaggggaagggcctggagtgggtctcaagtgttagttggaacagtggtaccatagcctatgcggactctggtaggaagggtccatttaaccatcctccagacgaacaacgccaaagacgcctccctgtactctgacaaatgaaacagtctagacgtaccgtggaacgacaccggtcctttacgtattttccgtggttacgaaccgtaaaacgggtcccccggttaagtcgggtaccgaaggttacgtaaccgttaagggttacggttttccgtttacggtaccccgggttacccccggggggacccggtaacccggggggtaaacccccggggttccgtaaacccccgggtttccgttacccccgtaccgaacccggtaccccttacccggaaacccggtaaccccgggacccccgtaaccggttccccggggtttcccccttaccccccggtaccggggtccccgtacccccgttccggccccgtacccggtacggacccgacccgtaaccccgtcccgaaacggtaccgacccgtaacccggg

SEQ ID NO: 97178 - DNA, 726 bp, Homo sapiens
  misc_feature: GYAE6OF01C5WTT.38.53.E09.1.454.CMB.1.raw
  modified_base (210)..(210): a, c, t, g, unknown or other
  misc_feature (210)..(210): n is a, c, g, or t
  modified_base (694)..(694): a, c, t, g, unknown or other
  misc_feature (694)..(694): n is a, c, g, or t
tcagtcgatcacgtcacgaccggtgctcgatttagagagagtgtgttgggtttggggagagctgctcagttaggacccagagggaaccatggaaacccagcgcagcttctcttcctcctgctactctggctccagataccaccggagaattgtgttgacgcagtctcaggcacctgtctttgtctcgaggggaagacgcctaccctctcngcaggccagtcagctgtagcagcagctacttagccgtaggtaccagacaacgaaaccgtcggaccacggcctacccgaggtcctccctactagtttccgttttggcgactacgttccgacggcgtacgggcctaacgtcgggacctaccgacccgacggtacgtaacgggttcgagtcgggacgtaggtcgggtcgtacggggacacggtcttacaacttcgtaccaacgtctacacccgagtacgtacgggactcccgttaggtaacgttacgttttcggactttaacgttttagttaccgtggtttacctaggtacgtagttagttacgtaacgttttaccgtttaccgttcttacggtaccggtttttcgggggaaccggggtacggggtaacccggtagggggttacgtaaccgtaacggttaaacccgtaaagggtaacgttacgggtccggtaccggttaccgtacccgttaaccgtntttaaaccccggttggtttacccttaacccgg

SEQ ID NO: 97179 - DNA, 616 bp, Homo sapiens
  misc_feature: GYAE6OF01A7V2H.38.53.E09.1.454.CMB.1.raw
  modified_base (203)..(203): a, c, t, g, unknown or other
  misc_feature (203)..(203): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagngcccaccctctcctgcacgggccagtcagactgttagcagcagcttactagccgtggtaccagacgaacgaaaccgtcggaccacggcctcccgacggcctcctctacgttcgtttggtcgacctactccgagccgacgggccacgtcggcactcccgagacgtacggttcaggtggcgtaggtgggtacgtgggactacgtacttacactcctaccaccactccaacgagtacgtggacgtcgtagaacgttcgtttagacgttagtttactacgtgtccagtctagttatagtattacgttactcttacgttcgttaccgggacggtagggccgtagggtacgacgtaacgtaacgaaacgtacgtcggtacgggcttacggtacccacctagttcgttcgttccgttacg

SEQ ID NO: 97180 - DNA, 616 bp, Homo sapiens
  misc_feature: GYAE6OF01D1VXR.38.53.E09.1.454.CMB.1.raw
  modified_base (202)..(202): a, c, t, g, unknown or other
  misc_feature (202)..(202): n is a, c, g, or t
  modified_base (503)..(503): a, c, t, g, unknown or other
  misc_feature (503)..(503): n is a, c, g, or t
  modified_base (597)..(597): a, c, t, g, unknown or other
  misc_feature (597)..(597): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaanacgccaccctctcctgcagggccagtcagactgtagcagcagctactagcctggtaccagcaacgaacctggcccaggcctcccgaggctcctctattcgtttggtgcctactccgagcgacgggcctacgtcggcactccccgaagtacgtacggttcgaggtcggacgtaggtcgggtacgtacggggactaacgtacttcgactcctcaccactaccacacgactggacgtcctagaattatttcgacttagtttacttactcgtacagtactagttactgtaacttacgtttacctnttaccgttcgttcgggacggtaacgggtaccgtagggtacgaacgtaacgtaaccgtaaacggtacgttcgggtacgtctacggactaaccgtntacggttcgttcttacccg

SEQ ID NO: 97181 - DNA, 796 bp, Homo sapiens
  misc_feature: GYAE6OF01AJDMH.38.53.E09.1.454.CMB.1.raw
  modified_base (198)..(198): a, c, t, g, unknown or other
  misc_feature (198)..(198): n is a, c, g, or t
  modified_base (312)..(312): a, c, t, g, unknown or other
  misc_feature (312)..(312): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctccagataccaccggagaaattgtgttgacgcagtctccaggcacctgtctttgtctcgagggaagngccaccctctcctgcgagggccagtcagactgtagcagcagctacttacgcctggtaccagcaacgaacctggccaggcctcccgacggcctcctctacgtttcgttttgggcncctacgtccgacgccgacgggtccacgtcggacactcccgagaccgtaggttcgaggtcgggcgtagggtcggggtcgtaggggaactacgtaccgtttaccacttcctaccaacctacttaccgaacccgtacggtaccgttacgggacgtacccgttaggtaacgtttacgttttacggtacgttttacggtttttaacttaccgttacggttaccgtaacggtaccgttaaggtttaacgttacgtttaaacgttttaccggtttttaacccttaccggtttaaccgtttaccggggttttacccggggaacggggtaaccggggttaacccgggtaggggggtttaaaccggtaaccggttaaacggttaaaccgggtaaaacccgggtttaacggttacgggttacgggtacccgttaacgggtaaccccgttaaccggttaacgttttacccggtttcggtttaccccgtttaacccg

SEQ ID NO: 97182 - DNA, 667 bp, Homo sapiens
  misc_feature: GYAE6OF01D9JI6.38.53.E09.1.454.CMB.1.raw
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagcgccaccctctcctgcagggccagtcagactgttacgcagcagctacttagcctgaccagcaagaacctgccaggcctccagctcctcattcgtttggctcgactcccgagccgacgggccacgtcggccactacccgagtaccgaggttcaggtcggacgaggttcgggtacgtacgggtactacgtaccgtttccgaccttccgtaccaacccgtacgtaccaaccctacgtaacgtcgggacgtccctaggtaacgttattttcggacttaagttttacttaacgttcgtactacgtactaagttactagtaacgttacgtttacctccgttacgttacgttcccgggaggtaccgggtaaccgtagggtacgtaacgtaacgtaacccggtaaaacgttacggttggttacccggttgaaccggttaccaacccgttattccgttacgttccggttaaccc

SEQ ID NO: 97183 - DNA, 702 bp, Homo sapiens
  misc_feature: GYAE6OF01C2Y14.38.53.E09.1.454.CMB.1.raw
  modified_base (202)..(202): a, c, t, g, unknown or other
  misc_feature (202)..(202): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccacctctcctgcagggccagtcagactgttagcagcagtctacttagccgtggtaccagcaacgaaacctcggaccgacggcctcccgacggcctcctctagtttcgttttggcgaccacgtccgagccgacgggccacgtcggaccactccccgaaggtaccgtaggttcgaaggtcgggacgtaggttcggggtacgtcggggaactaacggtacctttaccgaccttccgtaccaacccgtacgttcccaaacccgacgttaccgtacgggaccgtacccgttaaggtaacgttagttttcgtacgtttaacggttttactttaaccgtgttaccgtacgtacttaggttaattacggttaactttaaccggttttacccttcttaccgttaccggtttcgggaccgggtaacgggtaccgtagggtacgtaactaacggtaacctaaacggtcgttggcggtactacggactaccagtttcgcgttccttaccg

SEQ ID NO: 97184 - DNA, 673 bp, Homo sapiens
  misc_feature: GYAE6OF01E12GL.38.53.E09.1.454.CMB.1.raw
  modified_base (203)..(203): a, c, t, g, unknown or other
  misc_feature (203)..(203): n is a, c, g, or t
tcagtcgatcacgtcacgaccggtgctcgatttagagagagtgtgttgggtttgggggagagctgctcagttaggacccagagggaaccatggaaaccccagcgcagcttctcttcctcctgctactctggctcccagataccaccggagaaattgtgttgacgcagtctccaggcaccctgtctttgtctcgaggggaaagngccaccctctcctgcagggccagtcagactgttagcagcagctacttagcctggtaccagacaagaaacctggccaggcctcccgaggcctccctctacttcgtttgggcactactccaggccgaagggcccacgtcggacacgtccccgaggtaaccgtggttacgaggtcggacgtagggtcggtcggtacgggacgtacgtaccttccacgtccgtaccaaccgtactaccgaaccgtacgtacgtcgggactacgtagtaagttcgttttacgaccgtttaagttttacgttacgttcgtacgtagtcgtaattagtaacgtttaacgttacgtttaccctacgtttaccgttaccggtttacggggaccgggtaacggtaccggtaggggtacgtaacgtaacgtaaccgtaaacggtacgtgggacggtacgtacgtacctactagttccgttgttccttaccg

SEQ ID NO: 97185 - DNA, 745 bp, Homo sapiens
  misc_feature: GYAE6OF01CNAC4.38.53.E09.1.454.CMB.1.raw
tcagtcgatcacgtcacgaccggtgctcgatttagagagagtgtgttgggtttgggggagaggagccccagccctgagacttcccaggtgtttccattcagtgatcagcactgaacacagaggactcacagtggagttggactgagctaggtatttttcctttggacttaattttaaaggtgtccagtgtagaagtcgcagcgtgggtggagtcggtgggggatacgttggtaagacgtccgttgggccgtaggttcccgtaggaacgtaccttcgtcccgtgtcgacagtcctcgtagtattactaaaatttagtagaatacgtcgacctatcgccgtaacggtcgggtaacccaagtaacgccgtaccggaggggtacggtcgtagggtaggtcggtactacgtaaggtgtttaggtaacggaacgtcgggttacggtaactaaacgttaacgtacgtaggacggttaccttaggtacggagggtaacccgggaccttacgttacccgacctacgtaccgtaccgaaggaacaaccgaaacgaccgaaagtcgtacccgtactacgttacgtacgtacgaactaacgtacgtaacgtacgtacgaacggtacgaccggtacggtaaccgtaccgtaccggttaccttttacgtaccgtttactaccgtacggtacccggtaaaccggtcccgtaaggtaccggtacgtacggtaatacggtaaggttcgtttacgttaccggg

SEQ ID NO: 97186 - DNA, 808 bp, Homo sapiens
  misc_feature: GYAE6OF01AXYDJ.38.53.E09.1.454.CMB.1.raw
  modified_base (263)..(263): a, c, t, g, unknown or other
  misc_feature (263)..(263): n is a, c, g, or t
tcagtcgatcacgtcacgaccggtgctcgatttagagagagtgtgttgggactgagctggattttccttttggctattttaaaaggtgtccagtgtgaagtgcagctggtggagtctgggggagacttggtagagcctggcaggtccctgagactctcctgtgcagcctctggattcaaatttaatgataatgccatgcacgtgggtccgacaacgctccgagggaagggcctggagtgggtctcgaagtgttagttggaacngtggtaccagtagcctatgcggactcgtggtaggaacgggccgtagtttccaccactctaccagagaaccaacgaccaagagtcctcccgtgtaactctacgactaaagtacgaaacagtcgtagacgtacctaggtacggaacgtaccggtccgtttacttactttacgtaggtacgtaacgtaaaacccggggtcccccgggttaagtcgggtaacctacggtaaacggtacgttaaacgggtttacgggttttacgttttaccggtaacccgtttcccgggttaccgggggaaccccgggtaaacccggggggtaacccccgggttacccgtaccccggttttaccccgttaccccgtaccgttaaccccggtcccccgttaacccgtaaccccggaaacccggggtaccccttaccgggtttcccccgggttacccccgtttccccccggtacggggttcccccggtaccccgtttccggccccgttacccggacgggttaacccgacccccgtacccggttcccgggaacgtaaccccgg

SEQ ID NO: 97187 - DNA, 773 bp, Homo sapiens
  misc_feature: GYAE6OF01D2JRZ.38.53.E09.1.454.CMB.1.raw
  modified_base (203)..(203): a, c, t, g, unknown or other
  misc_feature (203)..(203): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggcctccagataccacggagaaattgtgttgacgcagtctccaggccaccctgtctttgtctccgaaggggaaancgcccaccctctccgtgcgacgggccagtcagtactgttagcagcagtcttacgtacgccgtacggtacaggacaacggtaaacctggaccctacggcctacccgaggtccctccgtctacgttcgtttacggcgactacgccgagcggacggcctagtcggactaccgtaccgaacggacgtacggttacgacggtcggggacgtagggttacgggtccgtacggggtaactacggtactttacccgaacttctaaccgtaaccgtactaccgaacccggtaagtaccggtacgggtaactccgttaaaggtaagtttctttaccggaacgttttaacggtttaactttaccggtgttacaacggttactaacgttagttaacgttaacgttttaccttttacccggtaccgtttaccggttaccgggtaccggggtaccgggtaacggggtcgttaacggggaaccgtaacctaaaggtaaacccgtaaacgggttacgttcggggttaccggaccttaccggtacccaaacgttttaaggtttccccgttaagttaccccgttcccg

SEQ ID NO: 97188 - DNA, 752 bp, Homo sapiens
  misc_feature: GYAE6OF01A5IME.38.53.E09.1.454.CMB.1.raw
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggcctcccagataccaccggagaaattgtgttgacgcagtctccaggcaccctgtctttgtctccgaggggaaanagccctaccctctccgtgcagggccagtccagactgtagcagcagctactagcctgtaccagcagaacctggccaggcctccgaggcctccgtcattctttggngccagtccagcgacgggtcccacgtcggctacgtcccccgaagtaccgtaacggggtttccaacgggttcgggaccgtaagggttcgggggttaccgtagggggtaacctaacggtacccttttaccgaacgtttccctaccgtaacccgtaagttaccccaacccgtaacggtaccgttaggggaaccgtacccgttaacggaaacggtttacgtttttacggaacgttttaacggttttaacgtttaacccgtttaggtacccgtaggtaacccgttaggttaagttacgtaacgttttaccggttttaacccttcgttaccgttaacgtttccggggacggttaaccgggaccggttaagggtcggtaacctaacgtaaccggtaaaccgtagttcggtacgggccttacggaccctaacgtagttaccgtgttccgttacg

SEQ ID NO: 97189 - DNA, 713 bp, Homo sapiens
  misc_feature: GYAE6OF01BOXX2.38.53.E09.1.454.CMB.1.raw
  modified_base (205)..(205): a, c, t, g, unknown or other
  misc_feature (205)..(205): n is a, c, g, or t
  modified_base (333)..(333): a, c, t, g, unknown or other
  misc_feature (333)..(333): n is a, c, g, or t
  modified_base (481)..(481): a, c, t, g, unknown or other
  misc_feature (481)..(481): n is a, c, g, or t
tcagtcgatcacgtcacgaccggtgctcgatttagagagagtgtgttgggtctgggggagacttggtagagcctggcaggtccctgagactctcctgtgcagcctctggattctaaatttatgataatgccatgcacgtgggtccgacaagctccgaggggaacgggcctgggagtgggtctcgaaggttgttaggttggaaacnggtcggtaccatagcctagtggccggtactcgttggtggaacgggtccgattccaaccattccaccgaagacaaccaacgccaaagcggtcctcctagtactctagactaaaatcgaaacctagttcnggaacgtaccgtggacggaccgtaccggtcctttacttactttcgtagtcgaacgaaaccgggtcccgtagtcggcaagtacgacgtaagtgttcttagacgttccgcgggaccgtacggggacccggtcctaccgtcgtaccgtacnccgaccccgtccgaacccggaaccgggcccctacgttccggtcccccttcccccggtcgggaccccgtccccgtcgtacccgtaccgaacgggcgacccgcccgtaccggacgtaccgccgacggaccggtaccggcccggtcggcctccggtccgtcgggtaaccgaacggttacccttaccggtaccgtaccggtacgttacgaccggaccgtaggcccggcgggtacgg

SEQ ID NO: 97190 - DNA, 706 bp, Homo sapiens
  misc_feature: GYAE6OF01DC0TT.38.53.E09.1.454.CMB.1.raw
  modified_base (199)..(199): a, c, t, g, unknown or other
  misc_feature (199)..(199): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctccagataccgacggagaaattgtgttgacgcagtctccaggccaccctgtcttgtctcgagggaaancgccaccctctcgtgacgacgggccagtacagtacgtgttacgcagcacgtcttacgttagccgttaggtaccacgacaacgaaaccgtggaccacggccctacccgaggtcctcctctattcgtttggctctactccgagcgacgggacctagtcggactacctaccgagtacgtggttacaggtcgacgtagggttgggtcgtacgggactacggtaccttcgaccgttcctaccgaaccgtctacccgaaccgtagtaaccgtgggaacctacccgttaaggtaacgtttaacgttttacgaaccgttttaaggttttaacttaccgtggtaacctacggtaataaggtttagtacgttaactttacgtttacccttcgtaacgttcgggtttaccgggacgggtaacgggtaaccggtgggttaaaccgtactaaaccgttaaccggtaaacggttcggttggaccggtctacgaccgttaactggttcttcgttcctaaccg

SEQ ID NO: 97191 - DNA, 724 bp, Homo sapiens
  misc_feature: GYAE6OF01BN4B3.38.53.E09.1.454.CMB.1.raw
  modified_base (197)..(197): a, c, t, g, unknown or other
  misc_feature (197)..(197): n is a, c, g, or t
  modified_base (301)..(301): a, c, t, g, unknown or other
  misc_feature (301)..(301): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctccagataccacggagaaattgtgttgacgcagtctccagcacctgtctttgctacgaggggaaangcccaccctctcctgcagggccagtcagactgtagcagcagctacttagcctggacagacaagaacctggaccaggcctccgaggctcctacattcgtttggcnctaactccgaagtccgacgggccaacgtcggacctacgtaccccaaggtaccgtagggtttacagggttcggacgtaagggttcggggtactacgggggaacctaggtaccctttcgtaaccgttaccgtacctaaccaacgttaccgaacccgtacggtaaccgttagggaaccggttccctaagggtaaacgttagttttacggactttaaaggtttttactaccgtacgtacgaacgtcgtaagtttagtaacgtaagtttaacgtttacccgttcttaccgttaccggtttaccgggacgggtaaccgggtacggtacggggtagaaaccgtacgtaaaccgtaaaacgggtaacggttcggtacgggtaccgtacggtacaacccgttaagtttcccgttaggtttacccttaacccg

SEQ ID NO: 97192 - DNA, 707 bp, Homo sapiens
  misc_feature: GYAE6OF01B9I99.38.53.E09.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggctcccagataccacggagaaattgtgttgacgcagtctccaggcaccctgtctttgtctccgaaggggaaancgcccaccctctcctgcagggccagtcagactgtancagcagctactgccgtaggtaccagcaacgaaccgtggaccacggtcctacccgaggcctctctacttcgttttggcgtctactacccgagccgacgggtccacgtcggaccacgtacccgaagaccgttaggttaccgaggttcggccggtaagggttcgggggtacgtacggggtaacctacggtaccctttcctaaccgttccctacctaacccgtacgttaccaacccgtaacgtaccggttacgggaccgtaccggttaaggtaaacgtttgttttaacgtacgtttaagttttacttaccgttagtacgtaacgttactaaggttagttaccgttaatttaccgtttaccgtacgttccgttagtttccgggacggtacgggtaccgtgggtaacgaactaccggtaacgtaaacggtagttggccgtacgtcgtacctactagttccttaggttccttaccg

SEQ ID NO: 97193 - DNA, 735 bp, Homo sapiens
  misc_feature: GYAE6OF01AB8FJ.38.53.E09.1.454.CMB.1.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttggactgagctggtatttttcctttggcttattttaaaaggtgtccagtgtgaagtgcagctggtggtagtcgtggggatacgttggtagacgtccgtggctacggtccctggacgtacctctccgtggtcgcctaacggtcccttacggtaggttaactttaaccgtaaaagtttttaacgtaggtaacttaaacgtttcggaccctaagttcggtacccgtaaccggtttacgggggtaccccgaacgtaaacggtcccgttaaccgggaagggggaaccgggtcccggtagggtacggttcgggttacctacggtaagggttcggtttacggttaggaaccgtaggttacggacctagtacgtacctagtcggtacgtactcgtaggtacggtacgggcgtacttcgaaccttacgtcctacgtaagaacgaaccgaacgaccgaagtcctccgtaccgtagtactacgtagaacctaagtcaacgtgtaccgtacgtacgacgttaggaccgtacgtccggtctttactacgttcgtacgtaggaaccgtaaacggtcccgtagtccggatacggtacgtagttaggtcttacg

SEQ ID NO: 97194 - DNA, 586 bp, Homo sapiens
  misc_feature: GYAE6OF01BCMN1.38.53.E09.1.454.CMB.1.raw
  modified_base (195)..(195): a, c, t, g, unknown or other
  misc_feature (195)..(195): n is a, c, g, or t
  modified_base (352)..(352): a, c, t, g, unknown or other
  misc_feature (352)..(352): n is a, c, g, or t
tcagtcgatcacgtcacgaccggtgctcgatttagagagagtgtgttgggtctgggggagacttggtagagcctggcaggtccctgagactctcctgtgcagcctctggattcaaatttaatgataatgccatgcactgggtccgacaagctccagggaagggcctggagtgggtctcaagtgttagttggaacngtggtaccatagcctatgcggactctgtgaagggccgattcaccatctccagagacaacgccaagagctccctgtatctgacaaatgaacagtctgagacctgaggacacggtccttctattctgtgcaaaacggccccgtatggcagtagctaagnggttctttgactccgtgggccgacgggacccggtcaccgtctcctcacgcctccaccgaacggccctaacgtccggtcccttcccccgtcggcccgtccctcgccctccgaggcgccacccgtccggagtacgccacgacggccggtcccgtgggcctcgtccgtcggtccgaaggtaccttaccgttcccgacggtacggacgttaccgaacgtcgggacggtcggggtaccg

SEQ ID NO: 97195 - DNA, 862 bp, Homo sapiens
  misc_feature: GYAE6OF01CDQN7.38.53.E09.1.454.CMB.1.raw
tcagtcgatcacgtcacgaccggtgctcgatttagagagagtgtgttgggactgagctggattttccttttggcttattttaaaaggtgtccagtgtgaagtgcagctggtggagtctgggggagacttggtagagccgtggcaggtccctgacgtactctcctgtgcagcctcgtggtattactaaatttaatgaataatgccatgctacgttcggggtaccaacaacgccgtaccggaagggggaacgggtccgtaggggtagttcggggtaccttacgaaggtttggtttaggttacggaaacgtaggttcggtaacctagtacgtcctaagtcggacgtactcgtggtaggaacgggcctagtttccaactgtacctacgaacggaacgaaccgaaccgaaccgaaacggacgtcccttccccggtagttacttcgacgaactaaacttaggaactagtaccgtagaccgttaaccgaggaacggaaccgttccgtacccgttttacgttactttacgttacggtaacgtaaccggtaaaacccgggtacccggttacggtacggtaacggtaggttaacggttaacgtaaggtttacggttttaccgtttacggtaacccgtttcccggggtaaccggggtaacccgggtaacccggggggtaaccccggttcccgacccggtttacccgttacccgtaccgttacccggaccccgttaccccgaaacccgggtaccgggttcccccgtaacgttcccccgggttacccccgttccccgggttccgggccccggttcccgtacccgccgttacccggaactcccggaccccgttacccgcccgggtaaggaacccgg

SEQ ID NO: 97196 - DNA, 841 bp, Homo sapiens
  misc_feature: GYAE6OF01CVVLF.38.53.E09.1.454.CMB.1.raw
tcagtcgatcacgtcacgaccggtgctcgatttagagagagtgtgttgggtttggggagagctgctcagttaggacccagagggaaccatggaaaccccagcgcagcttctcttcctcctgctactctggctccagataccgaccggagtaaattgtgttgacgcagtctccaggcctaccctgttctttgtacctaccggaaggggaaagacgcccaccctcctccgtcgcgacgggccagtcagacttgttagcacgcgacgtaccttacgtacgtccgtacggtaccgagaccgaacgtaaaccgtacggaccaacgggccctacccgacggtcccttaccgtactacgtttccgtttcgggtactacctaacgtcccgacgggtaccggaccggggtaccacggttcgggacctaaccgtaaccccggaagtaaccggtacggtttaccgaaggggtcgggtaacccggtaggggttacgggggttccgtaacgggggtaactaccggttaacgttacctaaccgtacccgttaccaaccgtaaccttaccgaaccgtaacggtaccggtacgggtaacgtaccgttaacggttaaacgtttacgttttacggacgttttaacgttttaacgttaaccggttacgtaaccgtacggtaacgtttaacgttaacggtttaattaaccggttttaccgttttaacccgttaccgttaacgtttaccgggtttacggggacggggtaaccggggtaacggtacggggtaacgtaacgtaacgtaccggtaaacgtacgtcgggtacgtacgcgtacgtacgtacttcgttcgttcttccg

SEQ ID NO: 97197 - DNA, 907 bp, Homo sapiens
  misc_feature: GYAE6OF01DHBD8.38.53.E09.1.454.CMB.1.raw
tcagtcgatcacgtcacgaccggtgctcgatttagagagagtgtgttgggactgagctggattttccttttggctattttaaaaggtgtccagtgtgaagtgcagctggtggagtcgtgggggagacttggtagagcctggcaggtccctgagactctcctgtgcagcctctggtattctaaaatttaatgaataatcgccatgcacgtcgggtaccgaacaacgcctaccggaaggggaacgggccgtagggtacggtcgggtcctacgtaaggttggtttaaggttaggaacgtaggttacggtaacctagtacgtacctagtcggaccggtactcgtggtaggaacgggcctaattaccgacctactcctaccgaaggaaccgaaccaaaccggaccgaaacgtcgtccctacccgtagttacttccgtacgaaactaaagtacgaacgtacgttcgaggaacgtaaccgtagggaaccggaaccgtacccggttccctttacgtttacgtttacgttaggtaaccgtaaaccgggtaaaacccgggtccccggttaaggtccggtaacgttaagtaacggtaacgttaaggtttaccggttttaccgttacgggtacccccgggtacccgggggaacccggtaacccgggggtaaccccggttacccgtaccccggtacccgttacccgtaacccgtacccgtacccccgtaacccgggtaaccccggtaaccccggggtaccccttaacccgggtaccccccggttttccccccgttacccccccgggtcccgggtaccccccgttcccccggttacccggtaccccggtaaccccgggtaaccgggtaccccgtacccccgttaacccggtacccgggaaccggtacccgaaacccccggg

SEQ ID NO: 97198 - DNA, 786 bp, Homo sapiens
  misc_feature: GYAE6OF01A7TWA.38.53.E09.1.454.CMB.1.raw
  modified_base (201)..(201): a, c, t, g, unknown or other
  misc_feature (201)..(201): n is a, c, g, or t
  modified_base (606)..(606): a, c, t, g, unknown or other
  misc_feature (606)..(606): n is a, c, g, or t
tcagtcgatcacgtcacgaccggtgctcgatttagagagagtgtgttgggtttgggagagctgctcagttaggacccagagggaaccatggaaaccccagcgcagcttctcttcctcctgctactctggctccagataccacggagaattgtgttgacgcagtctccgaggcctacctgtctttgctaccgaaggggaaancgcccacctctacctgcagggccagtcagtcttgtagcagcagtcttacgtagctcggtaaccagtacgaacgtaaccgtggccgaacggtcctaccgaggccctttccgactacgtttccggtttacggaccgtcctaccgttacccgaggaccggtaaccgggtcccctacggtaccgggtacctaaccgtaccccgtaaggtaaccggtttaacgggttcgacgggttacggggacctaacggggttagggttcccggtaacgggtaacaaccgttaccggtttaccacttcccggttaacccaaccggttacgtaacctaccgacgaccgttaggacgttacccggtaagtaacgtttacgtttcggtacgttacgttttagttactcgggtaactacggntttaaccgtagttaccgtaacgtttacgttacctccgttacggttacgttaacccggggcggttaaacccgggtaggtacgggttaccgaaacgtttaacggaaccttaaccgggtagtttccggaacgggttacaccgggttaacccacggtttaacgtcccgtttgtacgttaccccg

SEQ ID NO: 97199 - DNA, 690 bp, Homo sapiens
  misc_feature: GYAE6OF01E3D7A.38.53.E09.1.454.CMB.1.raw
tcagtcgatcacgtcacgaccggtgctcgatttagagagagtgtgttgggactgagctggattttccttttggctattttaaaaggtgtccagtgtgaagtgcagctggtggagtctggggggagactttgggtagagcctgggcaggtccctgagactctcctgtagcagcctctggattcaaatttaatgataaatgccatgcacgtgggtccgacaagcctaccgaggggaacgggccctgggtacggtggggttctacgtaaaggttggtttaaggttacggaaactaaggtagggtaaccagtaacggcctaatggcgggaccttcgtggtagaaggggccgaatttcaaccactacctccaggaacgaaccaaaccggaccaaagagtacctccccttgtaactctacgacaaaatagaaaccagtctgacgacctgacggaccacggtccttctactttctgtagacgaaaacggcccggtagtcggacagtaagacttaaggtacgtttactttacgtaccgtccggtacggggccggaacggggaacccggtaccgtacccggtaccttccttaccacgccctacccgaaccgaaccggacccgacgtcccggtaccttcccccgtcggcccgccctcgtccgtaccgacggtacgacccgacccgtcccggacgaaccgg

SEQ ID NO: 97200 - DNA, 833 bp, Homo sapiens
  misc_feature: GYAE6OF01AUXD2.38.53.E09.1.454.CMB.1.raw
  modified_base (219)..(219): a, c, t, g, unknown or other
  misc_feature (219)..(219): n is a, c, g, or t
  modified_base (813)..(813): a, c, t, g, unknown or other
  misc_feature (813)..(813): n is a, c, g, or t
  modified_base (822)..(822): a, c, t, g, unknown or other
  misc_feature (822)..(822): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggcctccagactaccaccggagtaattcgtgttgacgcagtctccgaggccacctgttcttagtctccgaagggaagcgcctaccctctcncggcacgggcctagtacgagtacttggtacgcagcgacgtccgttacgttacggcccgttaggtaacccaggaaccctaaacggtaaacccgtcgggacccggtaacggccgtaccccggaacgggtcccttaccccgtaccgttacgttttaccgggtttttacgggaccgtaccttaaccgtaccgtaacggggccgtaaccggggtccctaaccggttcggaccccaccggttaccccgaagggtacccgtttaggtaccgtaggacggtaccggttaacggggttcggttacgggtaccgggaaccgtaacgtttcccgtaccctacggtacccacgttaaccgaacctttccgaaacctacggtaaccggtcggaccgttacccgttaaggtaaaggttcgtttaacgtaccggtttaacgttttaacgtaccgtttacgtacgaacgttacggtattcgtaactacttttaccggttaccttacgtaccggtttaccgtaacggggtcgggaacgtttacggacgggttacgtaaacgtaccgtaacggtaacgtaccggtggttcccggacgtcgtaaactacgttntaccggttnttacgttaccg

SEQ ID NO: 97201 - DNA, 747 bp, Homo sapiens
  misc_feature: GYAE6OF01CUWT6.38.53.E09.1.454.CMB.1.raw
  modified_base (210)..(210): a, c, t, g, unknown or other
  misc_feature (210)..(210): n is a, c, g, or t
  modified_base (254)..(254): a, c, t, g, unknown or other
  misc_feature (254)..(254): n is a, c, g, or t
  modified_base (549)..(549): a, c, t, g, unknown or other
  misc_feature (549)..(549): n is a, c, g, or t
tcagtcgatcacgtcacgaccggtgctcgatttagagagagtgtgttgggtttggggagagctgctcagttaggacccagagggaaccatcggaaaccccagcgcagcttctcttcctcctgctactctggcctccagactaccaacggagtaaattgtgttgacgcagtctccgaggccaccctgtctttcgctaccgaaggggaaacncgcccctaccctctcctggaccgacgggccagtcagacttgtancagcagtctacgtagccgtagtaccagacaagaaaccgtggaccacggcctacccgaggtcccttaccgtactaacgttccgtttacggctacctaactcccgaacggacgaaccgggtcctaacgtcggacctaccgtaccgaagacgtacggttacgaggtcggacgtacggttcggggtacgtacgggaactaacggttaccttccgaacttccgacctaacccgattaccaaccgaggtaccgtaggacgtccgtaagtaacgttcgttttagacgtttaagtttaccgtntacgtacgagttactaacgttagttacgtaacgtttacccgtttacctacgtacccgttaacggtttaccgggacgggtaaaccgggtccgtaacggggtaccgtaacgaaaccgttaacgggtaaaaccgtaccggtttgggtaacgtccgtaacggtaaccgtaacctaagtttcccgtttcgtaaccctttaccg

SEQ ID NO: 97202 - DNA, 922 bp, Homo sapiens
  misc_feature: GYAE6OF01CKB8K.38.53.E09.1.454.CMB.1.raw
tcagtcgatcacgtcacgaccggtgctcgatttagagagagtgtgttgggactgagctggattttccttttggctatttttaaaaggtgtccagtgtgaagtgcagctggtggagtctgggggagacttggtagagcctggcaggtccctgagactctcctgtgcagcctctggattctaaatttaatgataatgccatgcactggggtacccaacgaagcctaccgaaggggaacgggccgtgggaggtggggtctacgaaggttggttaggttacgggaactaggttacgggtaccctaagttacggtacccttaagttcggccgggtaaccttccgttagggttacgggaaacgggggcccgtaacgtttcccgaacccctatacccgtacccaaggaaccgtaaccgaaacccgacccaaaacggtacgcccttaccccttaggtacttccgtaggaactaaaagtacgaaacctaaggttaccgtacggaacgtaacccgtaggaaaccggtaccgtaaccggttccctttactttagttttaccgtagggttaccgaaccggtaaaaccccgggtaccccgggttaagttacgggtaaccgtaaggttaaccggaacgtttaaaccggggtttaggttttcccgtttaaccggtacccgtttcccggggtaccggggggaaccccgttaacggggggaaccccccccgggtttaccgtaaccccggttccccgttaccccgttaccgtaacccggtacccctacccccggaaaccccgggtacccgggtacccccgtaccgtttaccccggtttcccccgtttccccccggtaccgggtcccccgttcccccgtcggtacccccgtaccgggaaccgggtacccgacccgtacccccgtaccggacgggtaacccg

SEQ ID NO: 97203 - DNA, 912 bp, Homo sapiens
  misc_feature: GYAE6OF01BCK6E.38.53.E09.1.454.CMB.1.raw
tcagtcgatcacgtcacgaccggtgctcgatttagagagagtgtgttgggtttggggagagctgctcagttaggacccagagggaaccatcggaaaccccagcgcagcttctcttcctcctgctactctggctaccagactaccgacggagtaattgtgtgacgcagtctcaggctaccgtgtctttgtctccggaaggggaacgacgccacctctacctcgacgacggaccagtacgacgtacgttgtacgcgacgcacgtcttacgttacgtccgtacggtaccagacgaaacgtaaccgtcggaccacggtacctaccgtacggtccttacctcgtacgtttacggtttcggtcgacctaacgtacccggtacggaccgggtaccgggtacccgtacggttaccggtaaccctaccggtaaccccggaacggttaacccggttacggttaaccggtacgggtccgggtacggttagggggttaccgggttacgggtaaccgggtaaccggttaacggttaccctttaaccgtacccggttaccctaaacccgtacccgtaaccgttaaccccgaccggtaacggtaccgggtacggtaacccggttaccgtaaacgggtttaagttttcggttttaaccgttaacgtttaagggtttttacctaccggttagaccgtacgttaacgtaagtttacggttaaacgtttacctttttaaccgtaacccgttttcggttaacccggttttaccggtacgggggggtaaccggtaaccgggggttaaggttaccgggttaaaccggtaaacgttaacccggtaaaccggttaaaccggttaaggggttcccgtaaggtacccgtacgttacccgtaaacgtttccggttcctttccggttaacccttacccgg

SEQ ID NO: 97204 - DNA, 739 bp, Homo sapiens
  misc_feature: GYAE6OF01AJL2O.38.53.E09.1.454.CMB.1.raw
  modified_base (217)..(217): a, c, t, g, unknown or other
  misc_feature (217)..(217): n is a, c, g, or t
tcagtcgatcacgtcacgaccggtgctcgatttagagagagtgtgtttgggtttggggagagctgctcagttaggacccagagggaaccatcggaaaccccagcgcagcttctcttcctcctgctactctggcctcccagtactacccgaccggaagtaaagttgtgttcgacgcagtcctcgagccacccttgtctttgtcctcgaaggggaaacncgccctaccctctcctgccgaggcctgtacagtctgtacgcagcagtctacgtgccgtagtaccacgacacgtaaccgtcggcctaggcctaccgagtcccttactcgtacttcggtttcggtcacctactcccgagccgtacggcccagttcggcacgtaccgagtacgtacggtcgtagtcggacgtaggttcgggtcgtacggtaacgtaccggttacctacgtacgtaccctacgaaccttacgttaccacggtacgtacgggtaccggtacgttaacccgtaaggtttacgttccgtttaacgttacgttacgttttacgttaccgttggttaacgcggtttacgtacgtttaacgttagttaacctttaccggtttacctttaccggtaccgttacgggtttaacgggaccggtaacggtaccggttagggtaccgtaacgtcgttaaaccggaaactcggttcggtaacgtccgtacgtacgtttcccgaacgtttccttcggttcttaccccgg

SEQ ID NO: 97205 - DNA, 817 bp, Homo sapiens
  misc_feature: GYAE6OF01EDCKP.38.53.E09.1.454.CMB.1.raw
  modified_base (213)..(213): a, c, t, g, unknown or other
  misc_feature (213)..(213): n is a, c, g, or t
  modified_base (555)..(555): a, c, t, g, unknown or other
  misc_feature (555)..(555): n is a, c, g, or t
tcagtcgatcacgtcacgaccggtgctcgatttagagagagtgtgttgggtttggggagagctgctcagttaggacccagagggaaccatcggaaacccagcgcagcttctcttcctcctgctactctggcctccagactaccaccggataattgtgttgacgctagtcctcgaggcctacccttgttctttcgcctaccggaaggggaaacncgccctacccttctccgtggaccgacgggaccacgttacgaacggtacgtttggttaacgccgacgcctacggtacctttaacgttacggtccgttagggtaacccgaacgtaccgaaaccgtaaacccggtcggacccggtaaccggtcccgtaccccgacggttccccttccttaccgttacgttttccgtttcgggtaccgacctaccggtaccggaccggaccggtaccgggtaacccctaacggttccggaacctaccgtaccccgaaggtaccgtacggttacgaggggtcggtacggttagggtcggggtacgtaacggggtacacggtttaccncgtaccttaccgtaccaaccgtactaacccgtaccgtaccgaacgggttcggaaccgtttacgtaaggtaacgttttacttacggtactttaacggtttactacggttcgtaccgtagttaacgttgttaacttacgttaacctttaccgtttacgttaccgttaccggttacgggttcgggaaccggtaccgggtaggccggttacgactacgtaacccgagttagtcggctcgacgtaccagtacctgttcgttctaccg

SEQ ID NO: 97206 - DNA, 781 bp, Homo sapiens
  misc_feature: GYAE6OF01DEORT.38.53.E09.1.454.CMB.1.raw
  modified_base (203)..(203): a, c, t, g, unknown or other
  misc_feature (203)..(203): n is a, c, g, or t
  modified_base (412)..(412): a, c, t, g, unknown or other
  misc_feature (412)..(412): n is a, c, g, or t
tcagtcgatcacgtcacgaccggtgctcgatttagagagagtgtgttgggtttggggagagctgctcagttaggacccagagggaaccatcggaaaccccagcgcagcttctcttcctcctgctactctggctcccagactaccaccggagaaattgtgttgacgcagtctccaggccaccctgtctttgctacgaggggaancgcccacctctctgcgacggccagtcagtacgtgtacgcagcagactacgttacgccgtaggtaccaagacaacggtaaaccgtccggaccgtaacggtccgtacccggtacggcctaccgtctacgttcgtttggcgtacctactacccgaggtccgaccgggacctacggtccgtaccgtacctaccccgagtaacgtggttaccgngggtacggtacggtagggtcggtaccggtcgggactacgtaccgttctaaccgtccgtactacccgtactaccgtaaccgtacggaaccggttaggacccgttacggttaacgttaacggggttttacttttcggttaacttttacgttttaacggttaccgttacgttaacgtcgtaacggtttgttaacgtttaacgttaaccgttttaccgttttacccgttaccgtttaccgggtttaacccgggtttacccgggggacggggtaacccgggttaaccgttacgggggtaacctaaccgtaacgtaaacggtaacgtacggttcggtacgtcgtaccctactacttccgtgttcccgtcgttccc

SEQ ID NO: 97207 - DNA, 755 bp, Homo sapiens
  misc_feature: GYAE6OF01BQ4G4.38.53.E09.1.454.CMB.1.raw
  modified_base (333)..(333): a, c, t, g, unknown or other
  misc_feature (333)..(333): n is a, c, g, or t
tcagtcgatcacgtcacgaccggtgctcgatttagagagagtgtgttgggtttggggagagctgctcagttaggacccagagggaaccatggaaaccccagcgcagcttctcttcctcctgctactctggcctcccagactaacccaccggagtaaattgtgttgacgcacgtctccaggccacccgtgttctttcgtcctcgaaggggaaagacgcccaccctctccgtggcgacgggccagtcgagacttgttagcacgcagtctacgttacgccttacggtaccagacgagaacccgtggacccgacggcctcccgagtccctcgtactnttcgtttggcgtactacgtaccgagaccggcggaccacgtacgcctaccgtccccgagtaaccgtacggttcaggttcggagtacggtgggtccgtacgggaactaccgtacgttaccgaccctttccgaaccgtaccctaacgtacccaaccgtaaccgaccgttacggaccgtacccggttagtaacgtttcgtttacgtacctttaaaggttttaccttaccgtacggtactaacggtacttaaggtttacgtacgtttaaccggtttcctttaccgttaccctttaccggttacgggtttacccgggacgggttaaccggggacggttacgggtaaaccgtacgtaaacgtaccgttaaaccggttggtcgggtcctacgtaccaccgttaaccgtgttaacctcgttttacccgtcg

SEQ ID NO: 97208 - DNA, 787 bp, Homo sapiens
  misc_feature: GYAE6OF01AL4ME.38.53.E09.1.454.CMB.1.raw
tcagtcgatcacgtcacgaccggtgctcgatttagagagagtgtgttgggtttggggggagaggagccccagccctgagattcccaggtgtttccattcagtgatcagcactgaacacagaggactcaccatggagttgggactgagctggtattttcctttggctagttttaaaaggtgtccagtgtgaagtgcagtctgggtggagtcgtgggggagtacgttgggtagagcccgtgggcctagggttcccctaggagtaccttctcccgtggtcgcacgccgttcgtggtaacttactaaaattttaagtcgtaataagtcgtaccctagtcgacgtacggttcggggtacccaacgaacgtccgtaccggaaggggtaacggtccgtgggtacggtgggtcctacggtaaggttggtttaggtacggaacgtagggttaccggtaacctagtacggtaccttaggtcgggtaccggtaccgttcggttaggtaacgggtaaccgggccgttaacttcccgtaaaccgtcgttccctaccgaacggaacgaaccgtaaacccggaccgaaggtaccgtccccgttaccccgtggttaaccttcgtacgaaccgtaaaggttacgaaccgtacggttacgacggtaaaccgtcccgtacggaacgggtacccgttaacccggtccttttaccgttactttcccgtaccgtacggtaacccggtaaaccgggttcccgtaagtcgggtacgtaacggttagtaccggttaggttacgtttacccgg

SEQ ID NO: 97209 - DNA, 800 bp, Homo sapiens
  misc_feature: GYAE6OF01CYD1E.38.53.E09.1.454.CMB.1.raw
  modified_base (670)..(670): a, c, t, g, unknown or other
  misc_feature (670)..(670): n is a, c, g, or t
tcagtcgatcacgtcacgaccggtgctcgatttagagagagtgtgttgggtttgggggagaggagccccagccctgagattcccaggttgtttccattcagtgatcagcactgaacacagaggactcaccagtggagttgggactgagcgttggtagttttttccgttttggtactttaagtttttaaaaacggtgttaccgtagtgtaggtaagtgacgagtcgtgggtaggtaggtggtagggggagtacgttagggttaagaccgtccgtaggccgtacggtcccgtagtacgtaccttccgtccgtgtcgccgacgtccgttcgtacggttacttaacgttaaaagttttaacgtagtaaacttaagtacgtacctaagtacgtaccgttacggtttaccgggttaaccaacggtaaccggtcccggtaaaccgggaacgggggtacggtcccggtaaggggttacgggtttacgggttaccgtaaggttagggtttacggttacgtttacgggaaacgttagggttacggtaacctaaggttaaccgttcgtacggttacggacggttacttccggtgggtaaccggaaccgggttcgttaacgttccgtacctacgtacccgaccgaagaccgaacgtaaccgacgaacgacctccgtacccgngtttaccgtctacgaacgtaacgaacgtacgtaacgttgacgtacgacgtacgacgacgtaccgtcttacttacgtgtcgacgtacggtaaccgtccgtgacgtacgtagtagtacgttagtacgttacg

SEQ ID NO: 97210 - DNA, 745 bp, Homo sapiens
  misc_feature: GYAE6OF01EPVJI.38.53.E09.1.454.CMB.1.raw
  modified_base (151)..(151): a, c, t, g, unknown or other
  misc_feature (151)..(151): n is a, c, g, or t
  modified_base (207)..(207): a, c, t, g, unknown or other
  misc_feature (207)..(207): n is a, c, g, or t
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
tcagtcgatcacgtcacgaccggtgctcgatttagagagagtgtgttgggtttggggagagctgctcagttaggacccagagggaaccatcggaaaccccagcgcagcttctcttcctcctgctactctggctcccagataccaccggganaaattgtgttgacgcagtctccaggcctaccctgttctttgtctccgaaggggaanacgccctaccctctcctgcgagggccagtcagtactgttagcagcagtcctacttagcctggtaccagcaacgtaacctggccacgcctaccgaggcctccncttattcgtttggcnctactccgagacgcgggcccactggaccactcccgaagtaccgtacggttaccgagggtcgggtaccgtaggggttcggggttaccggtaagggacctaaccggttaccctttaccgtaacttaccccgttaccgaaacccttacgttacccgaaccccgtaagttaccggtcgggtaaccgtaccgttaacggtaaacgtttacgttttcggttaaccttaacggttttttaccttacggttcgtacggtaacgttacggttaagttacgtttacgtttaactttaccgttttacccgttacgttaccggttaccggtttccgggacgggtaccgggttaccgagggttaccgaacgtacgttaaacgaacggttacgtggacggtcgtaaccgctaactacttcgttcgtccgttaccg
